United States Patent 9,328,346 (POLYCOMB-ASSOCIATED NON-CODING RNAS) - sequence listing, part 82

SEQ ID NO: 15360 - RNA, 63667 nt, Homo sapiens
cgcucuucagcagccggucgcgggcgguggaaaagcgagugaagagagcgcgacggcggcggcggcggcggcgcagcuauugcuggacggccagugggagagcgaggccugagccucugcgucuaggugagaagggggugcgccagcgggagcggccgggcugcgggcuccuccucgccuggcucgggaagugguugcgggagcucgggcugcaggccuggccgaggcgggggcgccgaccagccgucccgcccccgcccccgcccggguacgcccagaagugagggcgcccgccucaccccggguggucucugccccucuuugccccgccgccgcccuucacagggccgggaccgcgugggggacguacgguggggccugguuugcagccgcggagcccggggagccgccuggggugggaggccgcuagagguggcgaagguggggcggggugguuagccgagcagcgggcuccgcgugcucgcgggaggguagcggcaaagggaggccuagugauugcaggauuccgggucuggggaggaagaaaguggugggaaauaggugaugcucagaaaagggugcugagggagaaggcgcggggccggggagugugguuggccuauuagaaguaaggauugauagggccuggguggagaucagcugggagugaaggggggacgggcuuggguuuugaaggugaaggucucuggagaacuggggacacguggaucuggaguaagaggcaccuacugaaaccggaagguggcugagaagguuuuaugugagguguggacgggaggcuauuggacuagaaggcauuaguuggucuguuaggacaaaguauacaagcagcaaacgcgguagauuuaugugugguaggugaaggcugugaaucuuuuaugaguaguugagcaagaacaguugucugauucugcggugucggagaguggagggucucagguagugucuuggucagguuugaagguuaauuuacugcuaguggagggccaaauacucaaaagaguuuuuaauucucacuacuggggcugauccuccuccuacacuccaccccuccugccaucccugugacaguucaucucguuuugccucagcagcacaagaacucacucccuccgaaguaauggcauacauauuguuugcuuuugacuagauggcagucaggaaucccuuaauucuuuauguuaaaaaaaaaaguguugguuuaaagacaacaucagaagauacucucagaaaaucugcccuccaggggaguuucucagcugucauguugggcauguguaauauagcauaaaaaugaugcaagaucucuuacaguaauacaagugagaauuaacguauaaguacaauccugauguauuuuuuucaaauuaauuuaaaaaguaaacagagacaggguuugcugucgcccaggcuggagugcaguggcgagaucauagcucguuccagccucaaacuccucggcccaagagaucuuuccaccguggccucucaaaggcuugggauuacaggggugagccaccccacccaggcccuguuauuccauacauuuuccauaaaauuauuuuauaauuuuuguuuuguuuuguuuuuauuuuauaaauuugugugugugugucucgcuuuguugcccaggcuggagugcagugacgcgaucuuggcucgcugcaaccuccaccucccagguucaagugaucagcucuugccucagccucucgaguaguugggacuacagagacaugccccaccgcaccggcuaauuuuuguauuuuuaguagaggcgggguuucaccauauuggccaggcuggucucgaaccccugacuucaagagauccauccgccucggccucccaaagugcugggauuacaggcguuagcugccgcgccggccaaaauuauuccauaaauuuauccauaaaaauuccacauaaauuuucuggaguuugauuauguauuaggcuuguugggaaauuuauuacccuugugaagaauuuuguagcuaaguagcuugaggguuuuuuuuuuuuuuucacucaggaaagacaugguauguaugcaucacugcuauucuauuugaagcuuuuggaauuuuuauuuaugggguguggauagaggcuggaggcagagacugaggucagagaagagguaguagaaaagaagguggcccacuaccauauuuccaguguauuuaaaugggagauagaguuucuguuugaggauaggacaaaagguuugugaagaguuauagagucaaggacagaagccaaagagagcauuugcuguguaacauguuugcuuguuaaccagaucagcaaagcauuuuaacuaauggaccauuauuuaugaucuagaaacaauuuugugaaagcgauuucuuagugaugcuguuuacugugaucacauuugcccuuaguauaacaauaccuaagugcugaggcgacuugcaguagagaaguaaucugaguggcguggagugaaucagggaagguuuccugaaagaggugaguuuugagccaucaugugaacuagaaguugggauguggguuauuacaagacaugaggaugacauuccaguaguuuguacuugguauaagcaacuguggacaagagugacaaauuaaaaaugguuuuuaaggaugauugaagauucgaaugaagauuuagggguuuggaaaucaaccaaggcuauguugcagcuuagcugauaaauaauuuuuuauguugguuaggagagaaaauuaacaguugauaauggauuggagauagguaguaaaggaaagagcauaaaauauuugauaguuauaggagaaugaagugaaaguaagguuauugagagguagguuuaacagucaaccauauaucauaaguuggaaacauuuuugaguccugugcuagaguauauugauaauaauagcaaaauuuauugggugcuacuuuguggcagacacuguuuugaaccuuccaaauauuaucucaucuucugauuaucuguauuuuauagaugagggagauaagacucagagagauauaacuugcccaaggucacacagcuaggaggggacaggucaggauuggcagaaucagucaguaaauguuaauugagcaucugcuugaugccaggcacuguaguaagugcuggguguucaauauugacaagaaaauucaagucagaccucaucuauuuucuagagauugucaguuuauguaagaagagccagugaagaaagaaaaagauuaguuggagagauuucuguagauacugaggaauacacuguuuagagaaaccugggauagaguuuuaaagagguggugguuagcaacaaaguauauagcugagagacucagaacgauugagaagaaaccauugaguuaaguaaguaaaaaaguaaugugaauuuagucacaagaaagcuggaaugaagauauuaauguuugggcugguaguuaauuguguuuaguggcagguacucuauacaaauuuaaauauuuucacaguuauggucagauucauaggaaagaugaugguaugaccccuuguaauguuuuaaucuuuggcuggaagaucauggaugcuuuaaaaugcuugcacuuuuuaguuuuuucaaauuuaaaaaaaugagcaggcagaccgccugagcucaagaguucaagagcagccugggcaacauggcaaaaccccuuuucuauccaaaaaaaaaaaaaaaauuaguugggcaagguggugugcacaccuguaaucccagcuacuuggggggcugagaugggagccugggagguugaggcugcagugaaccuugaucaugccgcuguacuccagccuaagugacaaagugagacccugucucaaaaaaaaaaaaaaaagugagcauuauuuuuauaauuaguggggacaagcauucaacugaaaugagcuaauacucaggaaaauguggguaggcuagucugaacuugggguaggagagaagauagucuuauuucagucccuacuugguaagagccaccuugguagguguguuccuaucuuggaaaugacuggauugucacugauggaaacugaaacuguauguacugaaaggugguauuugcuuaaccugaaggaucaaguuacuaacccacccugaaugguggagauacagucuuuguuuuccugaacacuuguuuucuuagaguuuaauacaugaauuuaagguuuaaaaaaacccaacaaaccacugauagaauugugucauuuuaacugcuucuuuuggcuuuauauccuucuuccuacacauugguucuauaguuccucucauuaauggguuugcaacaggcuuagaguuucaguucaguaagacaaaauggaagugcuggauuuagauauagcugaucaacuuaaacacuuauaaauucaccauuguuuucgguucccaauuugaagaguggagacagaagucaagaaaauaagcuuuucuuauucaaagaaugauucccaaaccaauaggauuugcccuaggaucaguacagacuuauuacagucuccuaaacagagaggaaagaguugcguaaauucaucuagcuuuuaguuuaauuucacuuagcccauagggauucugagaggaaacgauauuaaugugauuccuauuucaucuaggcacuguagcauaauccuucaacaaauuaccacauuugauucucauauaauucucuaaaaugugaauaccauauuacagaugaggagagugagacucagagaaguuaguaacuuuccaagguuggagagcuaagugacagagcugggauucaaaccuuucuuugucuaacuccaaaacuccaugcuugugaaacuaauagcacggaggacugauuuauaccuucaacugaaaaaaaaugccacaagccuuagguauuuguuaccuuagaagaugagacucuugcucugaguguuugugcucugugacacugccucuaaauaaaugacagugauuuuuuagugucuaauaggauaccuuauauuuucuugcuuuagagauguauguuuucauauuuuagaauuuuuugaagauguauauugucuauauuuacuucaaaauguuugugaaaugguuacuaugucuuaaauguaucucaaaauugaugaagcauggcauaugccuguaguuuucacacauaaguaucuuaccaauuuguugugcacuuuuucuucccagccuuccccaucuuauccuauuauuuuuuuaaauaugauuuaauaaauaauugaaauauauacuaccaauaaaauaacucauucucuuucauuaguuaacauuacaguguacagaaaagcauuaugauguagaaaauucaaauugggccgggugcgguggcucacgccuguaaucccagcacuuugggaggccgaggugggcggaucaugaggucaggaguucgauaccagccuggccaauauggugaaaaccccaucuaguaaaacuacaaaaauuagccgggcgugguggcgcccaccuguagucccagcuacucgggaggcugaggcaaaagaauugcuugaacccgggaggcagagguugcagugagccaagauagcgccacugcacuccagccuggacaacagagcaagacuccgucucaaaaaaaaaaaaaaaagaaaaaaagaaaauucaaauugaacugugaaucagcagaucugagcuuuaauuuugguuuuguuagcuacuugauguguaacuugcuaggcaagucacuuccccucuaugggcuuuaguuuccucaucuguaaaauggagggggaggagaaauuuuaagcccgucuuccuugaauagguuguaugccuucuuucuaauuaaaaacauagaugcccuagaugccuuucuuaaaaacuguauuacugcauuuuacaauauuuucuuuuaaucuuccuucuuucccuucuuaauuuaguagagaggauaaauuauuuuugguauccuacauuuaccaggacagcauaucuuaggaagcagggacccagaaaauaaugaaugagugaauauauguuuuauuugagcuaaugaaaaauuuuuuaaauaaaguaccgucaaaaagauguugaaguuucauugaaaaguaguucuaccuaaagaaugaaacguguuuaguaaaguucaauuggucuguucuguauuggauagauguacaaagaagaacacucuugaacuugucuuuaagaagcccucuuacuaguaggagaggcaagcuucuaaacuuuguauuauggaaaauugacagcaauaauacacacaucaccaacuuuaagaguuacuaacuuguggucagucuugcuucauccauaccuccauccacuuccuucuuuauuuugaagcaaaucccuagacuuuuuuuuuuuuuuuaaccaguuguuaccaugcagugugauaaguauaauaauagacauguuaauccaagugaggugcaaauuuguucauauaaauauauuuugagacuugagcauuauacuguucugggcacgagaaauuagauauaguaagcuacuguagggcagggauaauauaauugaagagacuguacauaugugaaacagaauguagcaacacuggaucaugugccaaaauuggugguagagacucuuaagugggaacugacauuauuuuagaaugaaaguagaacuuaaacaaguggcgauagagagaaagaacauucagggauaaggugaggguaaucacauggauaaagcgugcgguuaggaaaucuaauuuuggcgcuauagaauaaguuauaucuaaaucuguaucucucuaucuuuaucuuuuagacuacuacaacauguaauuggcauacuguagauguuauaucagaacuugaacaaagccgguugcuguagcagaaauuaggacacacuacuuugugaauauaucacuguucgugguuaauuuuuuggcacguucuguuaaaaagccuucuaaauaucuuaauaccacauguauuaauggauccauucuuguuagaauguuuguggguuugugccaucagcuuuggugugcaguuguguguguguguuuaacuuaaauguuaacuauuugacaauuuuaagauuauuuugaaauaucuaguuuagaucauucuugucuuacaugaaauuuuuuccagaaauguuggcauaauucaugagaaauccuugaauuuagggaauuguuaccauuauagcuuauuuugaaguauucugagaauaaaaucuuaaaguauauucccuaaugcagaaauugcuugucaaaggucaugaacuucucugagcaucuccucaaaguguugugcuaucucaucagaaaaauguacguucaaauauccuuggggggucuguggauucugucuuaauaauuuauucuuuaauguguaggcagaaagcauacugcuaaaauucaacucaauuaucuuucuguguguucugcuugccuuuuacaaacaaguguuuuuaauuauuaagagugauaaaaugauaaagcuuauuauugcaaaugccuaauuaaaaaauuagacauucuuaauugaauucuuggggaaaaacaagcuguagccaguuuaauaaauaggaauuauuucacuaaagauuuuggaauaagcaugugguacuuuauuuauggcuccuguccauccuggauuaacaggaaguagaauauaugacauaugaaugaauaaaugcauaaauaccuuuuuuucccccagaaguaaaaacuuugacuuacuguguccuuaggcaguuaagaucuguggaggaaaggaucugcuaaaguauuuugagguucacaucuguguugaaacaaccagaaguaaugcaggagcuuagaaacuguuuuuggcugacaaaggauugauucucaguggagcccugagauacaagugcucauaguucacuuaguuugaggaauggcccuaaaugaguuucuuagaaauaggugguuuuaaaaacuuguggauuguaauuaaaauguaauuaugauaaugauuaugagcauaagcagaauucucaggagauaggaacaggugaauuagcugguaaugggacauuugaccccacagagcugugcacagacuguucgaaguucagugaauauuaggugaauugcuuuaaagugauacccuugugaccuguuggaguuaauaauuuuucaaguaccuaaucuacuaguaggaaacaacuuauuccaauacauaguaguaaaaauacagacugugaaagccagaagagauuuuaacaaucagugaucuggccucuccuucaauaaauuuaaagagugaucagagagguugacuugccuaaggucuguugguuauggcaaucccaacagcguuguuucucauuaccugauuuuugguaagucuauugugcuuauuuauuuuguuugucuuuucauucuggaucucaguauuuggagaaggaaguauauuaacuuuagcaugguaacuagauuauugguaaauuggcuaagaauucccugaaauguuauaccauaauguuuuuacuuugccaucauauacuccuuccaucuuuaacauaauaacccauaguuacaagauuuauuaggguaggcguguuuuaggagcuuaauuccauuccacaguuggaaacagauauuaagaauccacaguucuuaaaacauuuuccucaugcuuuuuuauaccuuucuaggaugaucuuugccuaacagcauuuaguugcaagcugugucuaugaacuuggcaaaguuuuaaaaauaaacuaggaaaagauuuuugagaagagaguuuguuaugggauuuagucauuuaaauacauuccuaaaagcuguuuuuuccccacucaaaacuagacacuggaaggaucauugacauccagguucaaagaaguuacugcuuacaugacugaucccgauucugaguucuuuugccacauuugguucauguggaaaggcuggcuggggcuaagacuugcccguacauuagcgacaucauagccagagugaggacccuuagaacagugccugucaagcuuuuuuaguccuagccuuuuggcugagucauucuuuagcucaauaauuucuacuuucuaauggaauaauaacacuugucaagguauaagcauuuuuugggaagagcuauauggaugguuccuaauugaaucacaaaaaauaugcuugucauaaagucuagacuaauuagaaaacugcaggccucaaauccuagugauggaauuguaucaauauauucucuacaguuauaauaaaauaaccaaaaacuaaauugauaacgaugagccaaaccuaaugguaauuuaauuaaaaggcaagaauaaugacaauugaaaacgaagaccaacuaaagacaacacaguuucacugauggcaagugccccucuugaaaguuacggacuucuacguuuugaguaugcauaugugguaggagcuugcagcauugccaguugcagcaacuggauauacuaguggaauacaaauugaaguuuuugguacauucuaguaaagucuucauuuuugcaacucuugguaacuagcuuaauaguuuauucauaaguagcuuuauggauuaaaggaaggucauguuuucuuuuuuuuugagacugagucucgcugugucgcccaggagggagugcaguggugcgaucuccgcucacugcaagcuccgccuccuggguucaugccauucuccugccucagccuccugaguagcugggacuacagaugccugccaccaugcccagcuaauuuuuuguauuuuuaguagagacgggguuucaccguguuagccaggacggucucgaucuccugaccuugugauccacccgccucggccucccaaagugcugggguuacaggcauggccacgaaggucaugcuuucuaaaucauuuauaguccaucaggaggcuuggcccuuucuuggaaaaucauuacuuuugaaggcugguuuaguaauccuugagcuucucaugagcauuauuucccuagcuguguugggacauuuaugaagagcagggcuuagauagaauuuagugggucuuuuuuuuguuuuuuaccucaggacauuuguaaucuuugauaugcuaauauacaucuuuaaucugguugggauaaagcauauaguuuccuagcaccauuuaccacaaaugcugccuuggaggacugaguccuguuuuuagguucaggcuugagaacaagauucagaaggcagccauaagaaagugacacaagaaaaauagaaaauacagcauauauaugaagcauacauaauuuaccuuuguuaaucuugggcgaagcgguauguaguauauauguaguguucaggguaaauaugguauguuuuccuauaacaucgguuuuacuucaguaauuugaaauauuuuauauaaaucuucagguauauugugaagucaaauuuuauaaauuuuuuuuagcaaaaaagauauugcaauucuguuauaaaaguuugaaaagcucugucuuugguaguacaguuaaaauauuaguauaucuuuguauauugaaauauguguuucacuucucugagucugaaaguguuaggauuaaaauuucaugucuuaauaugaaaacauuauuauuaagguaaaaagugaucaagcacaauaguuuaccuaaaaaaagagucauguaugacuuacgggaauuacuuuauuuaaaaaaacuguuuucuuccccuagaaggaaauugaauacauguuuuugcaagcagcagacuguuuuuucccccuccaauuucucuaacuuaacuaauuguuagaacuauuuacuuuuuuguuauuuugggugcuucuuccuguuuauuauucaguguuaucaagcuguguguuaacaagaacacagcccaccuucuguaggcuuuauaguagagaaguuacccuacugguucuggccuuaaggacagaaacagaaacaaaggaaaauguauauuauugaaaaauuuguuuucugaucagcagauaauuuuagugcuacaaaacugacauuuccucucucauagaguagaauuugacuuuuuaaaggugucuuuauguuugauuuuuacaucacucagaggaauucugaaucuuauuuuucucaguguguaacauuucccaggauaguaagauccuagaagcauuuuaacucuugucaaagugccaugcuuauggaacagcaucauuauaugaaacaguuguauaguggccuaagaacuaaugaacgucuuuagauuccuuacuaccgagaagugccuuggggggaaguauuggggaaaauaggauauagacaguuaaauauugguaaaucagugcuuguguaggcaaacaaaguggccauuauaucuacuucaauggguacuuaccacaggguuggacacuagcaucuuuuauugaaaaaagaaauguuaaccaggaugcuacagcugaucuuuauuuguggaaaaugcucaauaagccuuaauuuuugaaaaaggaaaaaggaacccacuguuauuaggagcuugacuacacuaaauaauuuguacacuuuggguuugcauuuuggcucuuuuuuuguugcuuauagauuucuuucaggugagguuuucuuuuuugagauagguucucacccuguugcauaggcuggacucaaacucuucgccucaugcacuucuucugcuucagccucccaaguaguugggcacacaguugugugccacugugccuggcucagaggauguuuucuuugauguugagucugucuuaguccauuuguauugauauaaaggaauaccugaagcuggguaauuuguaaagaaaagagguuuauguggcucacaguuuugcaggcuguacaagaagcacggcaucaguaucugcuucugaugagggccucaggaggcuuccacuccugguguaaggugaaggggagcaggcaucacacagugagagaggaagcaagagagaaagaggaagagcugccagucucuuuucaacagccaguucuuguggcugagaacugagccaguucucacuaugagugagaacgcuuaguggcaccaagccauuaaugaggaaucugcccacaugacccaaacaccucccaccaggccccaccuccaacauugggaaucagauuucaacaugagacuuggugggaccaaacaaaccauauguaaaccauagcagucuuaaucaaaacauuaagugaugauugcaguuaccaaaauauaguaggaaaaacacuggaggauugguuuucaaugcuucagaugggaaucuaucagaaaaucuuaauggauauacuuagcucgaggcuucuucauaaucuaacuucuguaaaacaaguugucuugcuuuugacuagaggugugucaacuccagaugguaaugcugcagaacuuugcuccuuaguucagcuaaaaccagguucaggaguucauaguuaauugaacaugggaaaguuaauugaacaugggaaugugaaauucucguucaguagaugagguuauuggguagacagaauauuucaaagugugagauccaugaguccauauuuuuaaaauggguuuugaguggcuaaaaaaaacaguaagaaacaacucuucguuguaccguaguccugugaaauagguccaacauggguuggugguugacagucucaagaguaacaggcaguuacuugaugcuguuugugacagacuguauuuucuaaggaugguugcaacaguauuuuccaucgcacaugugugagcuuguacagacccuaacuguucucucauucugaggugggauuuaagucccuugaauuugggcagucuuguaaaucacuuguagccaauagaauguggcagaaaauuacacuguaugacuuccaaggcuaggucagaaaaggugagagagcuuuugccuagcucacaagaauacuggucuuuaagccauuagcagcuuuguaaguaucugacuauucugagguccccaugcuauaaggaagcccaaacuaucucauggggaaaaucgaagaggcuaaaguccggagcuagaacugcucagccagaauugcuuagcugagcccuuuacaaauuccuaacucauaaaaauuguggaagaaaauaaaauggugguuguuuuaaaacacuaaguuuuagagugauuuuguuauguagugauagguagccagaauacuccauuccauacuacuuucccauccauacuuuuaaauucugugcuuuuuuauuauuauuauuauaucaaguuuuugaacaaaguagugggcaagaguuucucugaguuugugacaggauuauguuaugugcucuucuucacuuguagucuuuucugcaaaauaauacaacccaagccucaucccugcauaucuuaaugggcuuuccuuuuagaaauacagauuuuuaaaaauauauaucuugaaaaaggcuauaggucaugucauccuuuugcauucagccucuggcauaucuguauuucugaagccuggcauuaauguguuguuuuguucaugaagauauuauuguaucaaacaagcauuuguuggccauuuuacagugugucaguaacaauaguaguagugaaaucauagacaacgaauauuuagacuguacugcuuucccauugaugucuuucucauuuauacuucauuuuucugaauguuuguggaauauuggaaaucauuguuuaaaacagagguuggcaaacuauggccugcaaacugucuuccuguuuuuuuaaaguuuuauuggaacacagccacacccauucauuuauuuauuauccauggcugcuuuucugguacaguggcagagcugagaaguuguugcugagauuguaugguucacaaaguggaaaauacuuguuacuuggcccuuuacagaaaccuuugccagcuccugguuuagacuguuucuuagaaguugauuauccuuuuuacuuuuuuaguuuuuuacuuuugaggcagggucucacucugucacccaggcuggagugcaguggcacaauuauggcuaacuguagucucaaccuccugggcucaagugauccuuccaccucagccucucaaguagcuagaaucacaggugugcaccacuacaacuggcuuauuuuuguauuuuuuuuuuucaaggugggguuuugccuuguugccaaggcuggucucaaacucacgggcucaagcaaucugcccaccuuggccucucacagugccgggauuacaggcaugagccacugcacucagccaguucccccuuuuaaagggacauuuauuugaaguuauuuuuucuucuacuuuuaaagacaugcaaucuaaugaauauuaaaagauuauuuaacguaacuuucuaucugcugcuugaauuucuuucaguacuccuaccauaugaucuuccagcugaaagggauaagauaaugagauaagcagaauuaauuaaauaaugacagcugggagugguggcucacgccuguaaucccagcacuuugggaggcugaggcagguggauuuuuugaggucaggaguuggagaccagccuggccaacauggugaaaccucaucucuacuaaaaauacaaaaauuagcuggacgugguggugggugccuguaaucccagcuacuugggugguugagguaggagaauugcuugaaccugggagguggagguugcagugagccgagaucacaccacugcacuccagccuggcugacagaacaagacuccaucucaaaaaaaaaaagacaaagcagcauuggauauggguguguuaaacacagaaauugcaccugauugggaguaaaaaaaacauagaugaaauacuaauauuuuguuauuuguccauuugcucaaaacugucucuucauugguaaguuuuuuguuuuuuuuuaacaauuuuucauagagauggggucuagcgauguugcccaggcuggucucgaacuccuggccucaagugauccuccugccugggcucccaaagugcugggaucacaggugugaacaacugugcuuagcuucauugguagguuuugacuuugaauuuguuuacuugcagaaggcacagaagagccaauuuuaauagaaaaaacacguaaaugggcuggacuuccagguauagcuauaggugguagaaauuuuuagguagcuggauuuaaugguuagauauucaauuugagacuuuccauugcaguacuuaguuucccuaaauaaauguguagcagcuaaaacauggaacuaaaaguccuuacaaauauaccuguugugaguuacuggguuuguacaauaaaugaugauacagaaagaugcauacaaguagagccagucuagacuugacugcaguacuauauuguguauuguacuauauuuguauauucuauguacuuuauugcuuugugaacauggugaacauugugaaugaggugaaucucacaggagauagaagaagguacauccauuuccaagaucaacauuaucucgagagggaaaguaauuuuucacauuccauucaggaaauccauccuguuagagucccguuaauuauuuguuucauacauaaguaaccaucuaauguuuuuaauacauuuuccaucuaauaaagaaauggaaugaauuuaaguaauaaagauuaguaaaagaaggaaaacauagguugagcaucacauuaaaaauuuuuagacuauuucugaaauauuacagaucagacugacagcugaaggaccauacugagaaucauuaccauagaaguaaagggaagaugcauaaggaaauguaauugugugcccagucuuuuguguuuauuuucacaaaaaugcuauaagguggaguuggguggguuggauguuuuaucuguauuuuaaagauaaagaaacugcagacccaaacagguaagcaagcucaacagcaagguaaacaggugaguuuagauucuaaccuaaaccugcuagacuuggagucccagggauuucuauugugucuuggugcuggauuaucugaaaggcuuguuucuauaaagggccuaccuuauuuaggaaggagcaguuuauaagcugggccucauuucauucaguauugaaaauguuuucacuaaacauuuaguuuccuaauagcucacuagucuguguacuuuauugcuuugugaacauggugaccauucaaguuuaaggcauuuaaguuacaguauauauuuucaaacugaagugauccauaggauuaccuugguauaggaauuuguagaaacauguuugaauguauuauuagucuuaagcaagaccgcaaaucuucuuguuuucuaccuuaccuuauuaacucuacugccuuggggguuuuuuguuucuaauauuucaauaaaagauucuaucuagguaagaucucucuguggaucagguaggguggaguuggaaauaaagccacugaucuuugauaugugcgucuuaccugaaaaugaugucuuuuuauucaaauugauagugacaauaauuaaauccaccuagaagauggucuucugaguaguguucuaagguugacaguagacuuuucucccucuuguuuuggcugccucuggaaauggcccucagggaaauccugguaaagucuaauugccuuuagauuuuaacuaccugauuuuuuuuuuuuuguuuuuugaaaugcaagaucucacauauuuauuauugaacccagccaacuggcaccuucauagcacauacagagagaaaaaauauauucccaauaagacguguccaacuguccagauaguggugacauuuucagcuugauaugguaacaugguugugaucuugacauagcauaaguaugugugccaucucaugugcaauucuuuauagacccagucugguucuucuccaguguuuccuuuuggaguuguaccugauuuuauuaccaguuuucaucuaaauccacugggagugggacaauuuuuugcuuuuguuucuuggccaggaaacacuuaauccggaaacucuugugagaagacauggugagaagccaagucgagcacacacaaugaugguggagaaaggaagagagagccugaauuuuuuaacaguaaaauuucuauacugaguugcuaguuuggcccaucaacuuuuaaugcaaugauguggaauuuuuaaggauucucagcaagagguugucuuauuucauauguuaaaauuuucuguggagcagauuuuuguccauuguaugcaguuaguaaaagcugaggccuuguaguggagacugcuguuguuuccuccugucgugagucauacaacuuuagaacuggguaggaccuuucagaucaucuauuuuaaccccuucacuuucucugaacuucucuucuagcgcugugcacucaauucucauucaugaugugaugccuugaccucgcugaaggacaaguagaaacuuuaugugccuucucuaaaagugggauuuaguuagaagauuugguuccaauuucacccuacccguauagacgugcugagggaccucaggcaagaaaaguuauuaaggagacuuuuggaaaauaguaucugaaggcaugagagagagacaguuugugcuaaauaaauuuuucuuucccuuucuucccuuaacuauguauuuuucuccucacuggugagucuucuuuaaaacuucauucuuauucuaccuggcugacccauggaauuuccucucauuuccuuuccgcauaccccacuucuuauauauuuguucauaauuugucuuacugcuuagcaaguaucugaaauaaucagcuaacauuauguuaaaaguuuuaauuaauuugaguuguuuuaaauucuaauacagaaaaaggaauucucauuucucggcaccaaaaagcugccguuuaaaaaaaagugguaauuuuuugugcuuuuuaaaaaaugacuagucaagugcaauagugagaagaagggaacaaguagagcaaagaguucagucuauaacugugaacaaucaguugugauaauucacuaucuucggaccagcuuuacacuuuucugauuauuggaauacuccaaucucuccuuuuaauuguuuuaucuguuuaaaaaaaacucuuuuaaaaaguugaagaugagaggaucuugucuuuaauuauccagaaguuucuaaaauuaaugaaacaacaugauuagccuuccauuaauauuagggcauuuauuaagagaauacaaucauguuacaaaagugcagguuuauauugagugggguguuaccuuagaaguucucugugauucuccauuuguggucauuucaggcucuuuuggcccaugagaccugcguguucuuuugcaaaugaggaaacagguucagaguaguagcuuuaucuuaggaucucauagcugcuaaauugcagaguuuggacuugaacuccuagcaaguaaauauaucuuaaguagcuuuguauuauguuucucuuagugcauuuauaaaugcaaauaugugauaauuuuuuuuacagccacuaggaaaacccacuuuguaaguaagccuaagugaauuccuugaaaauaauggugauacaugguacucagcauuuugcugaucuucagaaagauugcuucuuuaacuugagucaaaagauaagguguguuuugaacaaaauagcuagcuacgacugcuaggugcuauuuccuaaagcagcucaagaacagugaaaauaaauguaaauuaccuuucacaguccugucguccccuuccccaagugugugggaaugcuaaugcugcagcuuuucucauauugcaguggugcagcuacuuuucaacagaugacaggcgcuuguagauaucuugcuguguagcaggaaucugaacagcaugcucuggaaggauugucagcauuccuuucauggcuuuugcuuuucuaguugcuucuggccacucuggcaggacuguggaagauaggacaagucugaacuucccuuaaaagaacucucauuuuuauuggcuuugccaauaaguuuguagggugaaguguauugguugaauggggaagccaagaauacauuucuuuucaaauuagugcggcuuuccuuugagccagaggcagaguuuaaaaauauuuagugcuugucauauacaccauggaauacuaugcagccauaaaaaaugaugaguucauguccuuuguagggacauggaugaagcuggaaaccaucauucucagcaaacuaucgcaaggacaaaaaaccaaacaccgcaugcucucauaggugggaauugaacaaugagaacacauggacacaggaaggggaacaucacacaccggggacuguugugggguggggggaggggggagggauagcauuaggagauauaccuaauccuaaaugacgaguuaaugggugcagcacaccaacauggcacauguauacauauguaacaaaccugcacauugugcacauauacccuaaaacuuaaaguauaauaauaauaaaauuaaaaaaauuugaaaauaaauaucaaaaugcacaauaagaaaauaaaaugagucucuuguuggcagcaaaaaaaaauauauauuuagugcuugugaaguuuuugguggcauuaugcuaaguugugggaauuguuuuuuuuuccccuaggaggaaaauuguguaagucauuauaguaguauaaaaucacuuguuaauagcuuugaaagaagccgcuucauucuacaacucucuuagcaagcaaucuuuauucuguuaggcuugaggagaauuaagccuaacagaauauuuauuuucugcuauuugguggugacagauuagcuguuuaggcuuugguagggcagaugucuugauaacugaaggaaguacaucauucuggguuuuuuuuaggguugaacucaucccaggcucuaauuucucaauuguuagagggaaaacugcuuaauaucuuucccugucuuacaugcauauguacaccuauggaaaacuuucuggugccugguaccuaguaggcccuuaauaaauauuuguugaauaaauuuuuacauaagaaaaaaauaaagcucaaagaauuagcugaucuagguauguucucaguauacuauuuaauauauauugaguauguaauugucauuaauaccuacuuguuaggaaguauauugaugcagaauuauucuucauaucucccauaugagguuauugacaucaaaccguuuuauuuauuuauuuuuuuuaagagauggggucuucuguguugcccaggcugaccuugaacuccugggcucaagugaucccucugucucagccuucaagaguagcugggaccauucauuugaacuucaaugcucuguaguuuuaauuaggcuuuuugucacugaaaucuugaaauagucucaaaccugaaguagauuauaaugaaaguaaccauauaauuuauugugcaaacugagacacuucugagaaaucaaucaaaauuaaguuggagcagcauguauaaaccaggcuuguucuaggcaaacuaggacauaugaucccuguuuguuuuuauuuuucaaaguaaauguuuuaucgaaauauaauaaauucagaaaguccauauauucgaaguggacagcuugaugaauuuuuaaaaaaugagccucccagaucaagaaauagaaauagaacaucaccagaaucccagaagucuccuucauguuaccuucuggucacucccucuucuucccugcaagacuuuuggccguagauguuuugccuaguuugaacuuuauauaaauggcaucauauaguaguacacacuuuuuuaccuggccuuacuagcucaacgcucccuuugugagaucccuccacauguguuuuagcgaucguuccuucauuuuuauuguuuuuaaauauuucaucauaugcauauaccacacuguauauguuauauuguugaugaacacuuggguuuuauuuugggccaacaaaaauggugcuguuauaaccauacuugcuuguucuuuugaugaacauauguacuuauuucuauuggguauauaaucaagaguggaauugcuagguccuaugauaugugaauguucagcuuuaguggguaguaccaucuccuaaguaucauaucaaccuguacuuccuccagcaguaagaugagaguuccaguuauugugcacccuuauucugagggucaguguagugggaucacauagggguuuuaacuugauaacuaaugaaguugagccccuuuucaugugcugucauuucgaucuuuuuuuuuuuuuuuuuuuugaguuagagucuugcucugucggccaggcuggagugcaguggcacggucuuggcucacugcaaccuccguaucccgggcucaagcaauucuccugccucagccucccaagucgcugggauuaaaggcgugugccaccacgcccgacuaauuuuuguauuuuuaguagagacgggguuucaccauguuggccaggcuggucucugaacuccugaccucagguaaucugcccgccucagccucccaaagugcugggauuacaggugugaaccaccgcgccuggcccaauccuuuuuuguaaugcccauuuguauacuuucuuuucuuguuuguucaagccuuucccauuuuucuauugguuuaucucucauugauuuggaauuuacauauuuauguauucuagauauuaauguuuucauuauauauauauuacaaauaucuuuuacucugguuugccuuuucucuuuauuguuaaugucuugggauaaacuucauuuuaguuuuguccaguuuagcaauauuuuccuuuuuauguucuguuuaagaaaugacugcaugaaagucauggaaaugguccuccucuguaaucuuguagaagcauaauuguuuuaccuuucacauuuagaucuccaguuuaucugaauuucuguguauagugugagauagaguucaaaauuucauuuuuucuauauggauaauugacucugcaccauucucuucuugucccaauaccacauuccuguagcuuuauaauacaucucaauauaugguaauguaaguucuccaucuuuguuauuuauguuugucuuggcuaaucuuggcccuuuguauuuccauaaacauuuuaaagucucaguuuccauauuaaaaaaacagcguagauuuugauugggauuauauugacuuuaaggaugguaaauugacaucuucagucuuccaaucuaggaauauaguauaugucuccacuuauuuagguguuguuuaauuucugucaguauuuaguagguuuuagaauagaggucuuauauaucuuuucuauccuuuuccaauucuugaugguuuuuuaaaaaauaauuuauugagaugagauucacauaauauaaaauaaccauuugugucuguuuugugcugcuauaacaaaauaucuuagacuggguaaucuauaaagaacagaaauuuauuucucaccauucuggaggcugggaaguucaagaucaaaauguaccaauuguuuugguugucugaugagagcugcucccugcuucuaagauggcacguuguugaacccucuaugggaaaggaauguuguguccucaccuggcagaaggcagaaagaaaagcaagagagcaaacuagcacaauguugagugaagccacuuuuaugaggcccuuaaucccauugaugaggaaggagcccuccugcccuuaucuccucuuaaagaacccuucucuuaauaguaucacauuggcaaaaucugaauuuuggaggggacacauucaaaucauagcaccauuuaagugagcaauucaguggcauuuaguacauucaguguugugcaacugccaccucuaucuaguuccaaaacauuucaucauucgaaaguaaaacuccuuaagcaguuucucuauacucaacuauuccccuaugccacaggcacaggcaacuaccaguuugcauucugucucuguauauguaucuguuauggauauuucauaugaaaggaaucauauaguaugugaccuuuugugucugacuucuuucauuugauauauuuuugagguucauccauguuguaguaaguaucagaacuuuguucuuuuuuauggcucaguaguauuccauuguauguauaaaccacaauuuguuuauucauuugcugauugacaugugggcuauuugugccacuuggcuaucgugagcagugcugcuauagauugaguaucccuaauccaaaaaaucugaaauucagaaugcuccaaaauucaaaacuuuugaccgggugugguggcucaugccaguaauccuagcacuuugggaggccaaaguggguggaucacuugaggucaggaguucaagaccagccuggccaacauggagaaaccccaucucuacuaaaaauacaaaaauuagcugggcgugguggcgggcaccuguagucccagcuacucgaaggcugaggcaggagacucacuugaacccaggagguaaaggaugcagugagccgagauugugucacugcacuucagccugggugacagagugagacuuucuccagaaggaaaaacuuuuaagcaccaacaugaugcucaaaggaaaugcuuccagauuucauauguucagauuggggauguucaaccaguaagcauaaugcaaauauuccaaauuugaaaaaaaucugaacaaugaaaugcuucugguccaaagcauuucggauaggggauacuuaaccuuacaaaccugugucaacuuguuugagaaccuguuuucaguuuuuugguauguuuaccuaggaguggaauugcugggucauaugauaauucuguuuaacuuuuuaaggaacugccaaacguuuuuccacagcagcugagcuauuuuacagucucaccaacaguguaugauuguucugauuuuuguacgucuucaccaacacuuauuuuuuucuguaauuuugguguucuauacuguuuuaagugguauaauuuugaguuuaaaauuuuucacuauuucuuauugguauacagaaauacauuuuuucuccauauaaaccuuguaaucaggugacauuaaauucgcuugggggcuauuaauuuuaauagucuauuuauuuacuggauuuuguacuuacaccugaauuuccauuuucuaaaugcuuucauauuauuuguuuccuuuuuuaguaauuauauuauggaugcagcagucuugugaacaacuuagagaauauaggaauuuaaguuuucuuaaaauuuuuccuuaguuuccuuuguaguucuauugcuuuucauuuuggucuuucuuuauuuuguagguauuuuucaaauaucuggugauccgugguuaucuguuuguauuuauaauggaauagggugguugguuuugguagcugauaguggcuuccucuaguuuuuugaggucuguuuucucaaaagagcuuuuccacagaugguaugauugagaacucugcgugaguuuccuuuaagguggggauauccaagcuuuuggcuucccugggccacauuggaagaagaauuaucuugggccacacauaaaauacacugacacuaacaacagcuaaugagcuuaaaaaaaaucacaaaaaagcuaaugauguuuuaagaaaguuuaugaauuuguguugggcugcauucaaagccauccugggccauggguuggacaagcuugcauuaaggccggcagcagaggcugaggacuuaaaauguauucugagcgcuauaaaugcuuuuuucuuuuguuuguuuuuguuugcucucuccugauccacugccuccuccaccuucguuuguggauguuuggagcaaccaucaggcucaauuccaguucucuuuugucccuaguacccaugcuggaugcucuucucaaucagaucuagauacuaagccugggagccaaaguuuaugcagaaaguaagacugucaugaguagcucugcuguucugugagcaaucuuuuaauuaucuugauuuccuuaugauuuaguccagcuuuuggauccugaccuugauguuuucucccagguuccauuuaggagauugguaaaaagagcucuugccucauuauaguccuuuccuguccuuguuuugcuuggguugcuguuucuucugguauggcuauucuaccaauucagucuuaucuguuucuucuagaaauucuucuguuucuuuucuuucuuccuuuuuguuugacuugguuuaauggagcuauuuuuuccagguuguuaugaacauauauuuuuuaauuaugaaaaauuuggacauaaaucacauguaucuacuccccagcuuaaauaaaacauaaauacaauucaagcuccuuauucucucucugguuguauugcacucccucucaugcaucuauuaauauuuuuccaucuguaugcauugcuaaacaauacagagcauuguuuugaauguguuagagcuuuuuguagugacauaauacaugaauucuucugcaccuuguuuuuauuuuuucuuucauuaugguuguuuucuuaauaugucuuuucugcuguuuuagaggaauuuggguagagaagauaagucagcucauguauuucuuacucuaacuuuuuaaaaggggagauuuaagcaccuuuuggauauacugucacuaagagacacguaguagaaagggcucggugucaccucuucuuguuucaauugguguugauacgcgaauaugacaccuccaguguuacacaagcuagguaauugagucuugcugcugaccuguauuugguguuauaaaucccuuuggagucagagaaaccauucauuuguguuuaggguauaacugagguugaaugaagauuugaguucuuauugcuggaaggaauuuuuagacauccuuuaguacaaauuguaccaaagaaacucaaguccagagaacgugagugacuugucugaggugauccaagggaaaaacacaggguuaaaaauaagcuauaguucucauucuucuuuccacuuuacuauaaugaacuugagguuagaguccucucuuguuaauguucuauuuugacuuuugucugcuuuuuaaaauacuuauuugaauaccaagagauuuuuaguaugaaagaaugauggugaauccuuaaacuaaugcuuauuugccauguuuuucuuaggaucaaaaugguuucaaucccagaauacuaugaaggcaagaacguccuccucacaggagcuaccgguuuucuagggaaggugcuucuggaaaaguugcugaggucuuguccuaaggugaauucaguauauguuuuggugaggcagaaagcuggacagacaccacaagagcgaguggaagaaguccuuaguggcaagguaaguauggaaaaugagcacucagaacaaagaaaaaagcgugugcuuguguauauaauuauuguagucgucaauagcuugguauauuucuucaguauucugaaaaaauuaguaaaacaaaaaaacuuaguaaguuccuacaggauggcaagaaacuggauaugacuugugaaucacaaggagaaaaaguuuuccucugugacuggcaaaauuguauaacaagcucuaaauuaccuuuaugguagguauuuaaaguauguuuuuagaacauuugaggcagguuguuuguaacuacuaaauaauuuaaauagccuugauaauaauaguaauuagguagugagacuaccuacuauucuguaagacacuaugcuuugauaaaauuuauaaacaccacuuacucccccacaacaguauuaggagguagagaagucacauauucccauuuaacagaugacagaggggccguauagaauauaauaugucauauauuuugagccuuuggaaaaauauuacuaagaaaaaauggaaaugagcuagaauaaaauuauuucacgaucauaaguuugugaauucucucaaaaugaaugaauuuaucugacauuuacuaauaaauaguaaguugaaucggaaggcuauaagcucaauuuugguacacauaaggaaucugacugcaggcauaucucaaaaaggaauuucaaguagagcauuuauuuuacaauuagaauaacacucauuugaauaucuacauucguauaggccucuuaaaaaauccugaaacuguagcaagccucuucauagcaaccaaccagacuuuugacuuugaaugaacuucauauaccuuuauagauaguucuuuggaauuaauugucauaucacaucagcauuuguuugacaccaugcaacagauauuccucauuauguugguuuuauuuuuuaaugaugggauguaagauucuuucuuagaaguuuaaaaauuauuauuauacuuuuaaauuauucaaauuagucuacauuagucucccuuaaucauuuuuucucucugauucuuugcugaacccuucuggaauccuuugcuucccuuaaaaccuacaaggaaagagucaucaauggggcuguaaaaccacaaggcuuguucuaaguaaaaugucuacauguauguuuuauugcugucucugcccuuuguuuacucaucuuggcauuuuuauuaugaaccacuuguaauugguauguuuuaauuuuucuccugauacuccucuccccccagugagggguuauuuguucuuacucacuuuuuauuuuuuagauaauauuuauugugccugcuuaguccugggcacuugacuuguuguaggggguggaauucagggauaaguaagauacguuccuggcuuuuuagacaguuuuuaagagggaaggaagagggagugauagacgugucaggaguagauaggaacagauauuuaagcugaugugcuggccagaauugagggucugaguaaaacaugaagaagacuugggcaucuucuucggggucuucagagcagugcuucuaaaauuucuuccacacuaagccuaagagaaggaguauuuucuacuuagagccugagguuucauugaacuucagugguuuagccugaacauacagcuauuauuuucaauaaaaaaaaguuuuuuccccaaauauuugacuuaacuugauacuccauaaaauuauguaauuuuaucuuaugccuucaguuaccuccuggcauauccuaccacuuaauccuaaagccauguauucuccauuauguauagcauugcuggugaguccauaaaaaugaguccuuuuuaugucaaauagcagugaguguacacuuaaaguuaguaagaaauuuuagguauggucuacucugauuuugaaauagguauaaagaacauaaggccaaaagcacauaccaccauaugggacauugacuuauagcaggguuucucagcuucagcaccauugacauuuugggcuggcuaguucuuuguucuggaggcuuguucuaugcaugguaggguuaucagcagcauuccuggccucacucacucuugugacaaccaaaaauguuuuuagacaucaccaaaugucuguuggggaccaaaaucaccccuggucaaguaccaugacuuaugggaaugucucagguaacagaaacuccauugggugaugaagauugaauuaaaauaauugaucauggccugucacggugguucaugccuauaaucccagcacuuugggaggccacggcuggugggucacuugaggccaggaguucaagaccagccuggccaauaauggagaaaccccaucucuacuaaaaaauacaaaaauuagccgggcgugguggugcaugccuguggucccagcuacucgggaggcugaggugggaggauugcuggaaccugggaggcagagguugcagugaguugagauugcgccacugcacuccagcaugggugaugaguaagacccuaucucaaaaaaauaaaaaauaaaaugaaguaguugaucaugaaguaaauucaggaaagaaucaaggauauuaaaaaggcauuaguaaacguaguaaaguaggaacuaauuggguacuaguggguugaaagcaccagaaaagaugguauugaguaaagagauguuggccagagaagggaagaguaucacauuuaagaucuagcaaguuuaagagcagcaugaucauguccuggugguagugguauagauaacugauauuaaaggaaauuaaaggucaucagcaauuaggagaaugaagaaguacgaaucaggguguuaaaaaguacuuuuuuagucauuccuuagguuccuuuuccucugcuugccccauaaggauugauauucuucaaguuucaggcuuaggccuuguuuucucacuagguccagugagaugguuacucagccuuccucuguuuuaugugagaugaauggauguccuuuaaauuagauuuggauuuaguuucauauaguuaggaucuuguguccuuauuauugcuguuaccuggauaaacucuuuucuacucccagggcuucaguuacuaccuguaugugguuaguaaaaucuauguugauaguccagcucucucccugaacuuagacccacaaagccagucaccuuuacuagaccugucuucuggggugucaugcaggcacuuuacacuugacauucagaagacugaauuuguaucuccaaaacaguacuucuuucucucccugaguucauuagucuacugaauuuauucacuuaacaaauguuuaaagucuuuaucuugccaggcaagaucugcucucuuggacuuguaugcugagcaaaauagauauggacccuacccuaaugaaguuugcauuccuuaucucucaaauucagucauaagccaaaaugacuacauccugaauguuacauccugaaucucauugccguuauuuugauucagacaaguaaauaucuugauaugggcaacgacaagaguguccuaaaacucauuacugccaaaggauuuuuuaaaaauuaugaacaugcuuguaucaccucucugcuuaaaaucugucaauagcgaccgggcugguggcucacgccuauaaucccagcgcuuugggaggucaagguggggggaucaugaggucaggagaucgacaccauccuggcuaacauggugaaaccccgucucuacuaaaaauacagaaaaauuagcugggcgugguggcgggcaccuguagucccagcuacucuggaggcugaggcaggagaauggugugaacccgugagguggagcuugcagugagccgagaucgcaccacugcacuccagccugggcaacagagcaagacuccgucucaaaaaaaaaaaaaaaucuuuaucaguaguucaccaugacucccagauaaaauucaucuuuuuaauguggcuuaaaaggcacaguuaucuggccuuucuuaucuccauacaacucuagcugcuuuuccugcauacucuauguuccaggcugacugaauuauuuuuaauuucccaagcauauuaaugccuucugauuucuaagggguuauacugcuacuuccucugccuggaaacacuauuauucuacuuuguaauuucagggccuuccucccucacuuuugucccuaacacacacacacauucuguuaaaugucauuuucucugagaagccagcuuguguguggucuuuuaaagcuggguuaguuguuucuccuaugcaggcccguaacacuuaccuguuauugcuuaacacuauauuuuaauuguacauuuacuuggaccaaaggccauuuccuugugucuuuagaaucuagaaggugccugccuggcucauaugaaauacucaguaaguuuuuauuuuuuaaauuaauauaagaaaacauuaauauucaagucaugugcuagcaguggaaguagcaguaggagcuaucaguaggagcgggaagacuguuuauacuaaagucauccaggaauguggaagugagcacugauauguuauauagacuuucuucuuagguuaagaauccugcuuaaacugcaaguuugaacuucaaauggagagucaaagugugauagagcagugaccuagagguggcaucaguguuucucugucaaaucugggauaaaaaguuaaacuugacucacaauugaauaugccuuuaaacuguaaucauuuugugaucugauugucuagcaaaauuuauuccuuuggguacacuuaaagaauguuuaauguucagcuuaaauccuauauauguaauacuucugaaguuuguucaguuucugguuugcguuugcuuaccaacuuuuuccuugaacauauugacuuuguuuuccuuuuuaaaaauuuguucuaagauuuuagguagaauguaaaucguguuuuuuucuaaucuacuaaaagggaauaaaauaaaaaugaagugaagugaaaaauuaagaucuagauuuuagaaaucugaaugaucauuuuaaacauuguccuaaugucuauauugcugaagucuauucugaggggugauacaaucuaaucagccaaggcauggacaguucaaauucaacuuugugaacuaccagcuuuguguacuuagcaaacuccuuaacugcucugagucucagauuccuuaucugcaaaaugaggauaauagcgugggccucauaggguguuuucuauacagaauaauggcaauuaagaauagcaacuuuaggaauuguauaguuuaaguuucuaaaaaaauagucauccuuggugggaaaaaaauggugauaaugaguuuuagaaaguggaaaaauacugcuguaaaauaaauauuuuucccucuugauagcuuuuugacagauugagagaugaaaauccagauuuuagagagaaaauuauagcaaucaacagcgaacucacccaaccuaaacuggcucucagugaagaagauaaagaggugaucauagauucuaccaauauuauauuccacugugcagcuacaguaagguuuaaugaaaauuuaagguaaguacaaguaauuauauaauauuugaacuucaguauaguuauuaaaaaaucucauuuuaauucuacuuuuuagucaauuuguuuugaaugugauuugauacuauuugccuauguuaacuguggcuuucaguguccuacagaguguuaaaagaauucucuucuucuucucaguuuaaaaaucuuggauaacuaauacauguuuauuggaagaaguugccaugaauuuaaacaugcaacagggaagaggcaaaaaguggaguagaagaaaacuuagucuuaacaacuaauaguguuugucuucucuuucuucagaagccuauaccccagcagcuuuauucuucuaaucuacaucauauccaugugaaaauaaacaaaauuaggcucagguuuuacaggauaaggaaaaauugguuauaaauuuaaaucacaccuuuuuauuuucaaacuuuugcaguagugcuaggggcaagguauguuggacauaaauuuaauuuaaaaaauaauuuagacuucuuucaagauuccuguugcaagaaaaaguuaagacucuaaauguccacuauucuuaaaaaaaucuaaugaguaugcauuucaaauaaugguucugaauucagagcauucuuuuugacagugugucaaaaaauacaguuuuuauaauguuaaucuaauuguauagucucaugccaauuaaaaugguguagacuugguauagguuucaaagcuacuugaaauguaaaauguugucuuuaaaauguuuuaaagauaaauaacuaaaaggaggauauugaaugcucuaacaaagaaaugauaaguguuuaagaugauagaugugccagucacccugauuuaauuacuauacauuguacgcaucaaaacaccgcuauguaucucauaaauauguacaguuaugauaugucaauuuaaaaaauaaaauacauuuuuaaaaguuuaaaaaauugaguucugaggcugaggugggaggaucacuugaagccagccucagcaacauaaugagacccugucucuauaagcaaaauauuuuaauuaagaauuaaaaaaauuaaaaauuaaguucugauuacaaaagguuugauauuauucccccuauugucuuuaucuaauauggaaguauaaacgucagucaacauuauauaaggugacaguucagugccaaagcauuacaguguguuuugccuguauuccaggugagggcacuguaauaguuccuuagaucucugcaguaguccuuuauggguuuucaguguauuuucucauuaauuauuuuauuccauagucaccuuaccuacuguaauauuauagggaaauccauuguacgcuugaggaagcugaggcagcauuguaauggaagggcuaugagcuuuggaauuacauacauuaguucuaaucuugaccauaucauucauuuacuggugaguuuguauaaguuauuaaccgccuuaagccucagcuuccugauuuauaaaauugaaguaacauuucucaaaagauuauuuuuuuuuccuucaggaaauuuaagugaugucucaguuugacuguccauggcaggaaaucugaaucuguagcaguugcuuuauuuauuuuuuagcucuuucuaugcagcugacagguaaaauauugugcagccauuauguguuaaugauucaaaggugacaaaaguauguuauuaggacuauaauaugaucuuauuuucauaacauauauguguagauguauuuauguacaugucuuucuauauuugcugauaauacauuuaucuuugaauguugcaguuacagguagguuuuuagucuuaccuguauauuauuuuuucuacuaugaacauguguuaaucuucaaauaaagguguauacaaaugacuuuuaaaaauuauuuuuaaaaguaacaccuauaagaaaucuuaaagggacugauacccucaucaacuaacaaauauccuuauuuuuuacauuuaaaauuuuguuguguguguauauuuuuguauauaggucuaacuauuuguuuuuaacuagcauuuccaagauugugaauguggucucuaauuuuuagugauuuaucuuuuccuaaaauucauuagugugaaauggucaguaaagucgauuuuuucccccauaguucuggcuuuuauuauuuccuucauagacaaaagaaagaguucacauagcuuuaugaagcuuagcauguuuucaugaaaaacauacguagauauuggcuaaugguaguauagucuucauugacuuaacgaggaaaguuauaugcuuugaaagguggacaggaaacauugauuaggguaaaacucauaaagggaagcuuuacaaggaggaccaaaguacagcacuuucagggaacuuucuuucugucccccuaggguaagcaaggcuaccauuaaugaaaaggacaucuucucguuauuauuuucuucuuuuacuagagaugccauagcagaaggcaucuuauguauuacauuguuuuucuuuuccuuugucaaagcaucuauguucacugaccuagcccuugucauuacauugaaauuauuucugggaagcaauuuuaauggauguugacuuccaaguggugauaggacauuagguuugggucagacacucuauaauacuccaggcaggcauauaacaacuucguaugaaagaauuacuguuuguuuuuguuuuuguuuuuguuuuuguuugagauagggucucaccuuuaucgcccaggcugagagugcagugacacaaucauggcucacugcagccucgaccuccuggguucaagugaucgucccaccucagccucccuaguagcugguacuagaggcauaugccaacacaccugucuaauuuuuguguuuuuuguagagacaggguuucacuaacaguuacucuuuauaacuacuuguuaaguuaaccuacaaauaaaaaauggcaugaagcuuuuacuguuggggggaaguuuucagauguuacuacaacauuaagcccaauaccuugggagagaaaccaacauaaauugcacacagaucuuauuugcaaagugcauauggucuagaggcgauaggauaugcaaaauaaccauaauguaggauagaaaauaaggauguauuaaggagcacacaugaaauccuauuagaguuaagagaagguagauagagcucacuuguuuucagauguggugguuccuaaaucuugagacaggagaaaaauagauaggcuuaggauucauaaggaaauacugacaaaaaguguggggagggcugggcgugggggcucacgccuguaauccuagcacuuugggaggcugaggcagguggaucaccugaggucaggaguucaagaccagccuggccaacauggugaaaccucaucucugcuaauaauacaaaaaugagccgggcaugguggcacacgccuguaaucucagcugcuugggagguugaggcagaagaaucacuugaaccugggacguggagguugcagugagccaagaucaugccauugcacuccagccugggcgacaagagcgaaacuccgucucaaaaaaaaaaaaaaaaaaaagugagaggagaagugaagauaauaaauggaguaacuuaaguaguucaucaugggaucuggcauaagggaagguacuagcugguauaagggaagguacuaguaaaggaagugcaaguaagacagggucacuagaguugagaguaauggagaggcaagaaacuggagaaugugaggacaaaaaccaggcugaagggagagauggauggacagauggugugguuugcggaaaauucauaguacaaaauuuuagaaauagagcaauucugagugauaaaacccaagguaugaauaugaaagauuuucagaaaggaauggaaguuaagauugaugcuuagaaaagaucaagaaacuauugaguuuguugggcauugauuaucaaacuuuagaauguauuaagaaucuuaagaauuacuggaaaguguguuaaaaaugcauauuccuagacugcacuugccaaauuuugacuuuuuaauuuuggaaucauacuccagaguucuuuuuagcaagagccuuagguguuagucacuguugcaccuuguuuugccccuuuagaaccauugcugucagaaucagcuuuggagacauuuuuuaaauuacagaugacugagcccccuacccuaagauugcgucauuguucccuaaauaucugugucuauauuuucauuaagauuaaaaaaaauggcaguaguagugauaagaucucaucuagacaguauuuucucaggggcaguaggguggaaaagagacuugugucaaaauggccuggagaacuuauuuaaaauauagucuuucagaccucauuucauguguuaaaaguaucugaugaugagguccaggagucugcauuuuuaauaaacugcuaguuauauguuaugccaaguaugagaacccugguuuaaggucuuuagaaguauuaucaacauagauuucuuugaaaaaccuaagaugccuguagaagaaagacgaacaagaaaauguauuggcacuucaggucguugagcuuuuuuuucuuuuuaaauuuuucuuugaagugauuuccaugucuucauuuagugaaggauucuaauuacaaagacuuucucauuuuguaccccccucccaaaagccugucuuaccgaagauacauuuaugacuccauauaaccaaaacaaugagaacauuauuuuuguuuaguacuaaaugacuucugauauaacaugucagagucucagucugaaggucaauggaguagaaauuggauugagguaaaacacaguuagguuaacuagccuggcagagagauacuagauguuacucacuugggugcagaauggcuucagguuugggcucucagguacagaugcaaagggaaaaaggcaaggcauagaaguguuccucucaaauuaucccuuauuuucggugaccuagaaacucugucaccauccucagggacauguaacagaauauccuuuguguacuuuucccaaaacauggcucuuccugcccccauuguuuugcaaaugcaaaagaaaauagugcauucccuuauagucuaguggacaguauccucuaugugaaaugucuuucuuguuggauuuucacuugaacagauuuucucccucaauuaaggaagaaaaaaaaaugcauccaugauuuuaagaacucaacccaauuauuucauuaaaaaaauuauuucuaguguguuuucauagggucuuggauacuauuaaauuaaaagagaaacuauggcacaggacuuuuuuucucuccuggaguuacuccuuguuccuggugacccaaaacuuguccuguccucaggaaccuguaacagaauauucucuguauuccucucccaaacaguacccucccuauccccauuguuuugcaaaugugauagacaucaaagcacugcuucacuuuacagugaaguagacuggauucuaucuaugacaucuccuggucuuuuaaaacaauaguuggauuuuuuucuuaaauacugaaaauauaagaauuuuagaaaguacugaaaacuuuuuuuaaaaaauuuccuuugaacauuauuuuucauuauuauaaacauagacuuucuaauuuuacuuuuaaaacaauauagaaaauuucuguauuucuaauuuuuuccauaguuauaauuuuagugauuugaugauauuccaucauguugacauaccacaguuuauguauuauucacuuagaauaaacuuuaaggaauuuuaguuucuuuuuauuuggaaaaugaggauuagaacaaguuuuuccucugaguuaauuucaacagguuaacuagauuaauaaauauaccauuucuguaauuccugguacuuuguccuaguuuccuucaaaucauuugugucaguuuguaguaucaacaacaguguauuacuuugccauuuuugucacuaauauugaguauuuaaaucuuuucguuuguuuguuuuuauuuuuuuaauugacaaagguauauauauuuuucauuuacaacauguuuugaaauauguauauauuguaauggucaaaugagcuaauuagcauauucauuaucucacauacuuuuuguggugagaauaccuaaaauccacucuuuuuguaauuuuuaaaaauaacaauauauugauauuaacuauagucuauguuguacaauagaucucuuggucaguuuuuuaaaagcuguaaacagaaguuuaauagaaagcaaaucuauccaccaucucauuaccuuaaggaauauuuguugacugccuguuuggugacuauguuagaaauacugcuaaauguuugcaagcuauuuguuuaauuuuauaccagucuuaguagguagguuucauuauuguucccauuuccagguaagaaaacugaggccugagugcuucaguuuauguccugauaaguaggccaagucaggauuugaacacaggucugauuccagagccuuguuuuuaauccugcuucaaaaaaaucguauguauucuuuugguauuauucauacaaauguuucauauuuuuauagacuucaaauaauuauuuuaguagcuauauucuuucauugugauaaaauacuuacuuuauugagucauuccauauuccauagugaauauuugggcucucuagguuuuuauuaauuacaugaugcuucauugauaacuuuucugcauauauacuuuugcuuuuguggaauuauuuacuucaaguaaauuccaagaagggaauauauagauuauuuuggggucuugcauaugccuuguaacagauguaccaguuuuauuauaauaucccuuugaauuuuguaggguagccuuagaaaaguguuuggauugauugcuacaaagaggaaaauaaacaucuucuuucuugauuauauguuaauauaauuuaauguuucugaguuuucucuggcuguaucacccuuauuagugacucuacguuaacauuuuaaaauuacuuaaccauucuauuuuuuucucccuguggcacauccauauuaugcaagauuauacuuuuaaaaaucaagaugcaaaauaagucuagcaugacuuaaaaauguaugcauaaaagcuaaagacugaaauuaucuguuuguuccuggacaauuauauaauuuuuaaauuucuacuuuaauuuuuaagggcuacaaggcagguuauuuuauaaucaaauuuuuuuaacacagcugauaaacauuuaauauggaaauaaaauacacaaaaucacagcuaaaggauaaguuguaaagaaacaaaaauuucucugucucucuacuucucuaaugaaaaugauauuuuuaacagguaaaauaacauagcuucccaauuuucuauugucacuuuuucuuuuuaaacagagaugcuguucaguuaaaugugauugcaacgcgacagcuuauucuccuugcacaacaaaugaagaaucuggaaguguucaugcauguaucaacagcauaugccuacuguaaucgcaagcauauugaugaaguagucuauccaccaccuguggaucccaagaagcugauugauucuuuagaguauguuuguuugaaauuuauauacauuuacuuugaucccaaaagaggccaaggcgggcggaucaugaggucaggaguucaagagcagccaggccaacauagugaaaccccaucucacuaaaaauacgaaaaaaauuagccaggcaugguggcaggcgccuguagucccagcuacuuaggaggcugaagcaggagaguugcuugaaucccagagguugcagugagccgagauggcgccacugcacuccaaccugggcaacacagugaaacucugucucaaaaaaacaaaaaacaaaaaaaaaaccuuuggauucaagucccucccucuucuccucaccccaccccauauacaugugcgcgcgcgcgcgcacacacacacacacacacacacacacacauacauuuaucucuuuucuucaaaaauuuuugcauauccccugcauucuuauuguauagauuaauaucuaaauaaauguuaaugaagucaauguguaguuuucacuuuugaccaaguauaaugguaauauuuggaggaaggcuccugaacaucuuauuagugauauuaggggcucucuuuuucagggaaucaaucuuagcaaccaagaaguaccaauggagacccaugacugccuguuuaauagcaaggcucuaauuuaucaaaggauuccccucaccaccccccagccauggaguauauauauagaggggccuuuaauuauuagagaaucagaggaaucauagucuuuuaauucauaaccuuacuuuuuaucuuucugaggacugagauccugucagcaauuguuacaugaaaauuauuugugaguauugauagauagggauuaaaugagggaguauauaccaugaccuuauucucauuugcugcagcucaggcuuucucaucaaacagacaagguucagacaagaaaaagagagaucuuuuuuacuuuuacaauuauauaaacauuccaguauccaccauauuuucauguuuguuaauccuuauauaauaucuuugaauuuuuuccuccuuuauucuucccucuuuuagucuucuuucuuuccagagauucuauccacuuugacugcuuaguuaacaucugcugcuuucuccuaaaauaagcacagucuuuucuuuaaggcuuuccugcuaauaugaggaaacagauagauuguaaaaaaaaugagaaauuaccaagacauuuucauuguaauucccuaauuucuauuuucucacucauuuucuuagauggucccaaauaucuacuucauuuucuucauagaucaauaaacagaaauauuuaauaucugcgggaaaaguugagugugaaaguuaauggagcauuuuacuuuuucucuuacuaacaauauauacaaacauuugagaaacugaaaaagaacuuguaagcuaaugcuguaucuccuuuccuugcugcaaagaaaucuagcuaacauaauuuuaagauaacucauggguuuguucuguaaacucguucuaguaauaaggcuuacuagcuaaaguuucuccugaguuuaggcagguuuuuuuuuccucauguaucaacuaucccuuucauuuuucaaaucucaucuccaugguggaauuuuuccuaaguuggguagcaauuucccuucaauuuaauugauguucuuuuccuuucauauacaaaaaguacuuccauauacagaagaaaauuuuaucuugauaaucucuguuuuaugcuuucuuaucaauuaguauggguaucauuagaguaugacaauauacugagucuacuugcauacacagcauuauugacaagaaguaaaaacaaguacauaauguauuagaaucagaaguuuaggaaaaaccauggacaccaccuaguauaucgcccuccuuuuacagaugaacagaguagaccauuucuucaaagagaacuggaggaauuuuuuugacuucauaguagguugcuaauugaauuuuuauagcaugcuucaauuuauuuuuauuguucaucauagcauuuguuaaucucauuagagcauaugauuugcagugcugcaccuuaaauacuaggccuuuuaugccuuuuguguucauuauaaauguauguuaauuauaacuguauauaauuaacauguuacuucauuaggugguuauauacagaucuguauuuccuaaccugcaaacuuccagaagguuucagauauauuuuggaauuuauuuggacuuuagagaggguauauaauuuauguacuguguaauaagaaaaaacuuuaacuugaucuggguuaguaucccugaucaaauacauguaaaauauaugaauguuuaaguuguaucaaaaaaaagaccauaagucaguguagaucagauuuugcuauccacuguaugauuuaugaaagaacucuuaguuuucagaucuuuuuggauacagaaauugcagauaagggauuguggaccuguaguugauguuuaagaaaaauaagacuaaguuccauuuuucaguaaaaguugucaaaugauuugagucagaacagcagauauguuugaaugugcgaaguucaauuaaguagcuuuuuauuuuauaguaaaauaucuggaaauauauuuguaugcaauuucuuuaccagguggauggaugauggccuaguaaaugauaucacgccaaaauugauaggagacagaccuaauacauacauauacacaaaagcauuggcagaauauguuguacaacaagaaggagcaaaacuaaauguggcaauuguaaggccaucgauuguuggugccaguuggaaagaaccuuuuccaguaaguuguuagaaaccuuuauaaauaacuggaguugagaauuuuaaguuguaacucuguauaaaaagagcuggcaguucuuuaagaacagguauuauuuacuaaaggugaauuaccauggcaaagcuguuuuguguucauagaguuaauuuuauugguacuuucauuucuauaaugugacgcuggguauauagaaauguagaucaacauuuaaaaaauccuaagugaaaauuaaaagcugugacauuuucuuaagucagaggagauuugguuuguuucuuaguagcaaaaagaggcagaccuuccaggagguagaccccuuccucuguagaucacaaaguaaaaaagguacaggguguuaggguauuugugaauuccuggaaugagagaaagcagaaauauaaaccaguugggucaauugauuuaggcaaaaccuaggucuguguaaugguaguaagugauagcaucuguuguugcuuugacaauuauucuauuuuucucuguuuuauucauaauuuugaggaggauuuaccauuuucccuaaucucaggcuauugaauuaguaaauagcauaaaaucaaacuugaacaagcuuaauuuuguaaaaauauucaacaauauaaacccucuuuuauaaauuucucuuugcagagaguuaauggaagaguaguagguagcccuuugaaaaugauuuuacucaauuauuuuugaucccagaggaagacugcuucuguuugggacugguagaaauagucuggccugaaucuagucuguuuuuuaguuuuuagaagacagcuaccaaguauauauuugggguuguagaguucaaauaauaaaucucuagcuucauaauguuucuaagcuucucucccuuuuaaaauuuuugguauuagggauggauugauaacuuuaauggaccaaguggucucuuuauugcgguaaguaaaccuuuugauuuauuuaauauucuauacauuuuucugcuuuuuguauaucuuuaaauauauauacacuauggcuuauauaucuuaagguguuguuuuuaauuucaacaaaggcagggaaaggaauucuucgaacaauacgugccuccaacaaugcccuugcagaucuuguuccuguagauguaguugucaacaugagucuugcggcagccugguauuccggaguuaauagguauaugaggugacaaugucgcuuauuaaauauauaguaacugaaaagggaagacauagcuuuugaguaauguuaauuaaucccucuauccagauauugccauaccaauauuuaggcuguaucacugccaacuccaagaguugguauuaucacagacaauagcaagugcucccaucaguaguaaugaagaauuaauguuaaugcucauguauuacuuacaggauagacaaguucacuuaaaaaugaaaaaaaaaaaaauacccuccccuaagcaugauuuuuuaauccaaacuaaaacuuguugaauauauaaagagcugaaauucacagaauaugguuuacauauauuaaacaugguacaccagagcagcuuuaaucagcccaugaacaucuuuccuuuaaaaaauaauaguagcauuuacagguaacacuuaaacuuuaaacuucccaauaacuuuuuuuuucuagguaguaaacuacccuuauuuuugauaaucaguauuuucuguccuaaaaaaagagagauaggauuauaugaauauguuguuucuggcaaaaggaaacuuaguccauaauuuuuuuucagcuagauccucugaaaaugagacaagaagagcugaggucauuuguuguuuuccucguguuuaaaaauagacauuccugcuaauauaaggaggaaaaaugugaaagaaaaaagucuguauuuuuuaaaauaaguuauuauuuuugguaggggaagaagaaaggguaguuguaaauagucauuaaaguaaaaacuaauccuuuaaggauaauuaaaaaaaaauaguauagaaaaggugcccaucauccucaugucuucuugaauacuauguaggacuuagauuggauauguuuggccucuuauuaugauuaauugguuucaucuuugucuuugcagaccaagaaacaucaugguguauaauuguacaacaggcagcacuaauccuuuccacuggggugaaguugguaugauuuuaccuguguuuuugaauguuagaauaaaucuuaaagaaccaaguucccugaaguuuuaauguuagaauaccuaugaggcauuaaggccacugaguuaccaauuuguucuuaauugucgucuuagaaguauuaucuaccaauacuaccuugugguccuuaauaauguuucacaaauuuaaaaauauacugcugucuauucuuacccacccacccuacccuugucuaagccuugcuguuuuucuccugccaucugcaguagcccucguagauaccuauggcaugggaacagugcuuuuuuucucccuugugagcacccucagucuugauguugccuauccauaggcaguaucacuucuuacaagaggugguauaucaagugguacccagaguaauaaaugaaggaguuaggaaguaggauacaguuugccagaauauuuucuauuaaccuguauuaaucuauuuaaauucacagauucacagcagauauacauguuccuaguucuauaggaauagcauaacuuaaauaggaauaguuaaaacccauugaaauugagucaauuuuaaauuguugguugaugaguucaaauuuaaaguaaaauuuuuuuggcauugauuuagugauaggucuuauuuaaccucuaauugauuaauuaccccugcagaacaauuuugauuucaauguagauuuuuuaugacauuuguccuaggauuuuucuguggcauuuuuauuucaguguaaaauugaccauuagagcauauaagaaaaagauaaaaucuaaggugauuuuaacuuuaugauaauuauuuucaguauucuuuuaagaauauuuaaacauuuuuaaugaguuagguuuuuuuguaaucuuuuauuguguuauaaaguuuaguaaaagcugaaauugagcguuauauuuuagugacuaucucaauauacauuucuaguaaaguauuaauauagaugauacuagguuugauuauguugacauuacauagccuauauaaauuacaacagaaguuaauuuuggguuguuuuaagccuguuaauguauguuaauuugagcaucuuaagcaaaggaugauuauuuuccuuuucuuuuuuaaguaaguacaguaauaagagucuggaaagaggaacagaaaggaagaagcuaucgugagaggugaaauauagaaagugacacuguaaacugacauagguaaaacauuaaaaggauuuuaagagugaauuuuagcaaaaauucauucaucuaaaauucauaaauagcggcaguuacaaaaccacuugaguuuagcagucuaauaaccauauucucuuagcuacuagagaguagaaaaguuuguuuuuuaaauguacgaacucugacaucuuugguaaaauauuuugcauuauaaaaacaugauuuuuuuuuuucaaaacuucauuacaugguuauuaucaaagcuguuacacaacuuuucuucuucagaguaccauguaauuuccacuuucaagaggaauccucucgaacaggccuucagacggcccaauguaaaucuaaccuccaaucaucuuuuauaucauuacuggauugcuguaagccauaaggccccagcauuccuguaugauaucuaccucaggaugacuggaagaagcccaagguaauggugacuagcucugucuuaucuguuccucuguuaaacaacccaugcuuacacuaaaaugcauauuaacucuguauuuguuuaugcuuaugauaaggcuuaauagccuuuugugaaugagaagccucuugaauuuaagacuuugucagaaaagcaaagguaguguuguaagucacucuaauuuguuuaaaguuuggauaaguuauugucauguauugaauucuaagucuuacuuuaggcuucuuucugaauaacaauauuuaaauugcuuugacgcuuauuuuuccuacaggauauuauguaagucauuccuucaagaugaauccuuuaaaccaaguauucaggugccccaguuuuaaguuuaauuccaacagccuaucgcaucauuaucggaagggugucagccauagaguaucugcauuauugcucgauugcacucauguugacaggucagaaaccgcgguaagaagaauagcaguaaauacacuauguauugguaaggugguggcagcuugcuggagagaugaaaaaaaucacuagcaugagcuuuaccuuuagauuuacucaccugauuaaucacaaucagaaugcuaggacauuucuuagaauuuggagaucuuuggggacacuaacuauggaucacaucguauugggucguucauccuccaaaauuccauaauauaggaaauguccuacaucaugguugucauuguuauuauaagcugaaauuaagcccuucucucccucuuaaaaaccuagggaugaguuuguauaggggauuaagggcaaaaguuuugcuucaaauggauggugcaguuuuaugugaaaaauauaggaugcuucuagaaaauuacuugaaauaucucagcugcccauucagcuuauaauaugguuauuucaguuuuugacuaauuauccagguugggaauggcauaguuaugaaaaaaaaguuaauaauaaacagaaaacuuuguuuucuuaucguuguuauagcuuuucuuucuuuuuuuuguugaaaucccgcaaacuuaaagaucuccuacugucuuuaccacacaauuacaguggaauauacuauuaaaauacuuaauuuuuuuuaacuacauuggcauuacaguggagucguugauuggagaguucaggauuugaguauuuuuguauaaagaagaugcugaucccagaacuuccaucaacuacucaaaaaauaaaagugagguaacugccaguuacaguguaucaggaucugaguuccucguagguauugucuguggauucacuuuuccaugauguuucuaacccuauauguuagcuaauugaaauaugugagagguguugaacaacuuuagagcagguaaagaaauauuuucagacuuuucuagaaugaucugcaaaaugcaauacuugccauuggaagcauucuucauggcuaaaaugcagauguaaauucaugaaugguggcagugcaugcuuucuuuauauuaauaagguuguuauaauuuaggacagaaaaguaaaaacugggucaaaaaaaaaacagguuaaauacaucacauugccuuacacgaagaaagagggcuuaguaaaauuuuaaaaaaauaagugaauagcugguuuacuaaaugcuucagaggagauguugcugcauaacaaaucaucucaaacuuagaagcuaaaaacagcaacaguuauuuuauuauuucuuucaauuauuucugucaggaucaagaauuugagaaagaauccacugggcaguuuuggcuuggagucuuucauguguuugugaucagaugaaagaggccggugggcagagaggcaauggaacagcaaggggacugauguuacucuuugucgugucauaaggaucucuccauauagcucuuugcaaggauuaaugauagccuuaggggaauuagacuucuuauauagcagcugauggcuucaagggggaagucuuuuagcaaguaagguggaggcugcguugccuuuucugagcuacccauggaagucaugcagcaucacuuuugccucauucuucuaguuacaagugagucacaaaucuucuuaaauuuuuuuucauauguucauaauuuuauuuuggugccugacauagcacauuuuuuaaaaauacuucaaguucuaggguacgugugcacaacgugcagauuuguuacauauguauacuugugccauguuggugugcugcacccauuaacuugucauuuacauuagguauuucuccuaaugguaucccuccccccuccccccaccccacgacaggcccccagugugugauauuccccacccuguguccaaguaaggggauuuagaaaguggucaagaugaaggguauuguugccaucauuuuuggaaaguacaaucugcuauagucaaccuucuggccaaaacaauucauauuucuucuacauggaaaggacaguugcuucuuccccacucauccugccuucccccucgcgccuccccauccccaccaccgccccagaucccuguggcaucagcuggaagccaggguuuugucaucuaaaucuggucaauuggcggaugacgcucuuuaggagugauuuugucagcauagcuccucaaguauaguuccucaauaauugauaugugaacuaaagcaacgaguuacugacugcccauacgcccaucauaaaugaugguaagcauaggauaauggcuuuagacaguuuuauucaaaaagagagaaauugggaggcacccagcaaacacuggucuauaacauuucugaauuccagucagauauguguugaugauuucuugauaaggagcucagucuuauucucugggaguucucugagguucuugccucugcccucugagucauccuuccuuuugcauaaaaacuggccugugggcucugugugcagccaaguagccuucuuauccugcuucgugcccaugaaagguuaggggaucagggcaggaacuggaaagcuuuucuuguaaauuaaggccauauaguaaauauuuuagguuuagcaggacaugcgguuuuuguugaagcuacucaucuuugcuguuaaaaaugaaagcagccauagacaauaggcaaaugaaugaauaugacugugucccaguaaaacuuuauuuacaaaaacagguggugggcuggauuugguauauaggcucugguuugcugacccuugauauagcagucucuucauuuuuuuuuucuugucuaucccuuuacauguaaucugacaugauugcuuaaaaauugugugaguuuccgguguaucuguuuucaaggaauccagccuauuagacgaaagccauacccauaaguuucuuugacacaaacccuucucuaucuuggguccccugugagguuccuaugggacagcacuuuuagaucuuaaauccuugccucuuagauccugccuuuugaacaauaagaguuucuguuacacauuucuuuaagaucuggagagugccuuuugucugucugaaaguucuggaaggcacugccuaggucuuucuaaagucuuagcaaaggauucaucuuccccuacccugcuaugcucagaaacuguuucuuaaagaauuccuggcugacauuuuacauuuccuccaaauuccacucaaauaguucauuuuuuuaagaucaucuuuguccucuuuugcccucuuucagcaaauuucugcuagaucauugaguuuauuaguacacuuucuauauuccauauaaccagaggugacaguuuguuguccucacuucaagcccucaccaacagcuuucuuaaaacccuuuaaggcuuccauuaauaauguuuuccugguccuuucacauuucacuacugaucaccucacaggccuuagagauuuuguuuaccacuugacccugaagccaauaccacauguuuuagguuuuuauuauagcagccccucccaguguugagaucuguguugagauuuguuaaucuguuuuacauaacaagucaccucaaacuuagugucuuaaagcaaucauuuuauuugugugucacaauaucugugggucaggaauucuagaaggguuagcuugaugguaauggcucaggaucuuucaaaugauuguagucagacagggacuggaggaacuuugcuguggagggagugguaaaggggggaaggggacagaguagcugggguggcugggcaucucucucucuccaguagugucauacccucuccauguggccucuccauauggacuaguuugagcuuccucgcaguauggcagccucagggggaguuggacagcauacacagugacugaaggcuucaagggugaguauucagugagcaagacagaaagcucuacaccuuucugaccuagccucggaagucacaucaugucacuuccaccucauucuguugguucuaaguuauuuucaacucucauugagaagacagucaaggugacauuguauuguaggugggcauguaggauggagauaauaucauaggcaccuuuggaaauuaauaucuuuccuaaauaggaaacguuaaggaaacagucuucuuaacugagguuugugcugugugaggcuuucuaaguaucaaagcaggacagauccuugaccuccgggagcuuauaaucugaaugcaacaaggaauauaaagguuuuuuuacuuagacaauuuuguaaauguuaaauacaaagucuuauaauuuauaauauuucauuuguucagaaauuuauugagcacaguaauagacuuuacaccuuauauuggggccuuacuaugaugccuaauucuacauuaaacugaugucagucaugucauucauuucauccaguuuacuuguuuacauaauaauucugaaugugagcuagauaagcaucugaccugacauuuuuuaaaaaauggcuccaugaucuuauguuuugguuaacuagcauaacuuuaucuagcuuaacuucucuaaaccagguaucuauuuuuaaucuguguacuucucagcuggagacauuugacaacauuugcagguauuuuuaguuaucacaacagggggagggcugcuaccagcaccuagaggccagggauggugacaagcaucuuauagcaugcaagauagcccuccacacgaaagaaugaucagacccacaauauuuauagugccaagguugagaaacccuggacuagauaaucauuaagaucuugccuuacucuaaaggauugugauuauuuuuuuaaguugccauaauaaagaauaaauacauauucagaacauaccuggcaauguagucauaaacaucuguucuaagguauguuuaaccaaggagugauggugcaaaguuuuacauuucuuauuccccaauaguuuucaauccaguauuuuuguugcaugauaaauauucuauaaauuucacacacaaauauauggccuuucaaauuucuucccccuccccgauuuuuuauugcaauuauuuuuugaauggcugaauuacugauugauguuagggugauugugucacuugaaugaaucugaagauaagauuaggugagagaauuaucagugaacaagaguuaagaaaaacuuuuuaauaagguauauauaggaaaaccguguuagcugugugugugugugagauuuaaguaugcuaaacuggcgugauaguauauauugauguagugacaaacuuguuguaucuuuuuguuuagaaaaaaauaaucaccuaaucuuuucuaagagcagcauguguuuuucccccagaugcuuuuuaucuacagaacuaucccuguccagaaauugccuuagaugcuugauaauucguuuuguguuugagauuuuauuuugaaguuacuuuauuggaugaaauauaguuuuuuuuuacauaguuuauauugcuucauuuucuuccaguauucuggauucagaguuuauuucuaaauguauugaauuguguuaucagaagugcuuagcuaaugauacuuuuuugauuuuuuucuccuuauuucuaauguaauuucccuccaugccccucccauuucuaaaaccccuaauuuugagacugucuaaacuacaugauacauauaauccuaaucguuauuauaauauaaaugaaaucuuuaaaaaguacuucuccaaaaauucuuuuucuguucacagaaguggggauuuuuuugguguuuguuuuguuucagaaaguucuuucuucccuuucccuacuuauaauaaauauuauuguauagauguuacugcucaaguuaguguuaugauaucaaugacuuacagugagccaugauauauaaaaugacagauuuaaagauuaaagcuccuuguacuuuuaaaaacaaagaaucacagucuuucuuuaaagacacacuuuaaaaagagugucacacuccuuuauuucuguaaggaugaguauuggugggguauggagaggugaguggauaucuauuucagauaguuuucagcaugagucauugauuucacagcacauccagaugaucaagaguggugccaaucauuguuaaagaaaaguuguuuuguuuuuuuaaaugaauagaguugacuauguggcaaacgaauauuucuguauuguuugcuucagcagugcugaagaguuggaauuauaaauauaacacaguauguuauuaauucacaggaaaucuuagcaaaugcagcugugaauuaaaauguaguuuaaggaauagaaagcaaggaaauauuaauugaauccauucauuugcuuaguauuuuauguagaaaauuuaagaguauuguauacccuuugagaauuaauucuguauaucagcagaacucuguuuaggugguauuaaaugcauuugcugcugcuuucaaaaaaaauuuguuuuccuuuuggauuuauaaauuguucauccaagaugcagaaauagucuuauucccugcugauuugguacacuuaaugauuaaauguuauaauuuuaauacuaaugucuauauuauagggggaaacuugcacccuggguggugauaggauuuuuccuaaucuauacaaaauaugaaucuguccauuuuucuuacaauacaggaugaugaaaacaauaacucgucuucacaaagcuaugguguuucuugaauauuucacaaguaauucuuggguuuggaauacugagaaugucaauauguuaaugaaucaacuaaacccugaagauaaaaaggcaagcaaguauuuucuguuuuauauuagaaaauaaguagcauacuaauuacagaacuauuagcaaccugagaaauauuuuccacagcuauuaugcaacaaguaagccauuauuuauagucucucauaaagcuuuagucauaauuguuaguggugaaauaaaauugcuguaucuuaacauuucuaguguaaguauuuuagaguggcaaagguauuuucaaagcaugauugaaauguugauucuuuuuuucccuuaauguugguuucagagagaauuuuaucuuuauguguuuuucuuucaaacacuuuguuuucucuugaguuuugagaaaaagcuucucuaagaaauuguuuuuuauaaacucuuuuacuuuuuguuauuccacauuuugcccuuuguuacuuuggaacuuaaauucuuuguguauguucuuuuugagcuuacucuagauguuuuaacauguauaucuaacacagacuaaguuaagcaauauuuauagccuccuucuuaauaauaauaauauuuagaaccuuaaaauguuuuaguugugauuaccacucccacucacuuaaaaugguuguauuaauacauuacuucaguucucuaauuuuuuuuuucuuuuucuuuuuuuuugagauagaguuucguucugugcccaggcuggagugcaauggcacaaucuuggcucacugcaaccucugccucccggguucaagcgauucuccugccucagccucccaaguagcugggauuacaggcacauaccaccacacccagcuaauuuuuguauuuuuaguagagacgggguuucaccauguuagccaagcugcuggucuggaacuccugaccucaggugaucugcccaccucagccuccccaagugcugggauuacaggcgugagccaucacacccggcacaguucucuauuuaaaccccauguugagauacucuuuuguucauuuaguuuuuauuuagauuucucccucucucucucucucuauauauauauauauauauaaaauauguauauauguauaccaauaucugugcuuucagauuuucuccuuaugaucuucuuucugccugaaauauauucagcauaccuagaauauguuuuacuugggaaucuguuuuguagugaauucugaguuuuugauugucugauauguguguuguuucacccuugguuuuggaacaugauuucagcacguuaaagaacuuuuuugcuggucauaguagcucaugccuguaucccaauacuuuggaggcugagguggaagaauggcucgaggccaggaguucaagaccagccugggcaauguagcgagacccaucuccacaaaaauaagaaaaaaucagacaggcauggugacaugugccuguaguccuagcuacucaggaggcugaggugggaggaucaguugagcccgggaggucaaggcugcagugagaugugaucacgucauugcacuccagcuugaacaauagagugagagucucucaaaaaaaaaaaaaaaaaaaaaccccaaaaaaaaacuuuuuuauuuauauucugucuuacauuuuugcuguugaaaagucgguaguuggcucuuccuuuauaggugauauguuauuccuggcucgucuuccauuuucucuuuauguuugccgcuuggcaguaucacuaugauaguggguguaauuuugaaaaauuuaccuagauugcauugggcuuucugaaucugagguuuggugucuuuaagcaauucagagaaauacuuagccaguguuucuucaaauauugccucuucacuauucuuauaucgucuuccaaaauuccuaguguauguuagauuauucuguucuccaaaucuuuuaacguuaauuucauauuuuguaucucaguguuucugggcuaaacucuagauaauuuaagauucugugacagucugccagcugugucuaaacuauccaauugaauuuagaguuuuauuguuuuauuuucaguuuuagaaaguauaauuuuucagaucuuauaaauguuucuuaaacagucucuagaauuuuuucuugaaacauauuaaauauaauuguuuuucauucugcuucugauaauuuaaacuugcagaugauuugcagcaucugauucugccaucuauuacuugagcuaggucucacccauggcaccuaauuuuuuuaaaaaauauuuguuugacuauaaauuuauauucuuugaggauuucugugagaauuuuuuugaagccgggauugaaauugcaguuuucugauaaggauuugccuuugcuucuaccaguagccuaguuaauuagcuagcuggcauuuauaagccagggccccuuuaaaauaucugauuagguuuuuagcacaacucagauuaauguaggccuuaaauagacaguaggggccgggcgugguggcucacaccuguaaucccagcacuuugggaggccagugcugggauaacuugagcucaggaguucgagaccagccugggcaacaaagugagacccucucucuacagaaaaaaaaaagaaaaauuagccaggcgugguggcgcaugccuguagucccaacuacuugggaggcugaggugggaggauggauugagccuaggaggcagagguugcagggagccgagauugugucacugcacuccagccugggugacagaacgagacuccgccucaaaaaaaaaaaaaaaaaaaagacuguagauuugggucauuacaguuucucaagaguuucuuuuuucauccagugccagcuuccuuucucuucccacuuacuuuuuuuauuuucauaauguuuuauuuaaccuaacauauaaucaaaaauauuguuugaacauaucaaaaaccuaaaaauuauuuaaaggauauuacuuucuguuuuuucauacugagccuucaaaacccagagugcauuuuauacuccacugcaugucucaguuuggacuagccauauuaaaagugcccaagaggcacagguggguacagaaacagaagccuguacugccugcagaaccaugagccaguuaaaccuuuuuaucuuuacaaauuacccauucucagguaguucuuuguaggguugcgagaauggacuaaugcaccuaaucacuaccuccucugucuucccagagggaacaacucuugaauucuagcacucaauauuaguuuuaccuauuuuugacuuuauauaaaugguauuauacaguauuuuuucauucuucuguugauagacauuugaguuauuuccaguuucuggcuauuaggaauaauuauccuaugaacauucuuuaugucuauauguacacauuuguguaggguauauaccuagaaauaggauagcauagggcauucauauguucaguuuagcagguaauggcaguuuuccaaagugguuguaucaguuuacauuccagagggcaguguaugagaguuccuguuaauccacauccuccauaacacuuggccuuuuaauuuugauuuucaauuuuagccacuuaggugauauauagugguauaacaaaaugauuuuaguauacauuaccuaguacauaaaauguuuauuuaaaaauaguaaaaaaaaaaaaaaaaguaauccuauuggaaaauagauuagagagaugaacaguuuacagaaaaugauucccaaguauuugaaaagauacucagcuuuacucaguggaaaugcagacuaaaguuagacugggauauuauuuacuauuuaucaaauuuacaaaaaugcagacuuggacaauguacucuagugaguuccuggacaaaucagcauccuuacacauugcugguagaacuauaugguguauguuucuccauucuuuuauuuucagucauuuuguaucuuaucuuuuagauaugucuuuuguaagcagcauauaguuaguuguaagcagcauauagcuguuaguuuuuauuuucagucugacaauuuuugaccuuuaauuggagaacuuaaccccuauguaauuccuaucauuuuagauuuagucugacuaguagugcuuuguauuugucacucugguuuuaaguucuuuuuucuuuuuuuuuuggccgcccuuuagauuauguuuugaauaauuuaauauuuucccaucuauauguguuacauagaauuauguuccuuuuugguuuaguagguuacucuagagauuacaauguccuuuaauuuagcaaggucuaauauaaauugauacuuuuauccuucucugauagugaaggaucagcauguaucuguuauuguuguuauuagguuggugcaaaaguaauugugguuuuggccauaaugcauguuuuaauucuauauauauauuaagccacacaagccaguauuuuuauugcagcuuaugcaauaaauauucauacagauuuaccagcguaacuguccuuuuauugcucuuuauuucuuccuccauccccagacauaaaucuagaaucauucuccugccuaaagaauauccuuaaguuuacuuucucuaacauggguuuucugcugaugucagauugucucagguuuuauucucuggaaauaucuuuauuucaccuuuauuuuucaaggauauuuacacuggcauagaguuuuauuuaggacuuauuuucauugcguacuuagaaaacaucucugucuuuuggcuuucauugcuucuguugagaagucaacuuacagucuaauaguuguucuuuuggagguaaucuauaggaccuuuuucugacucucauaugccuagaugugugugggggcagggaugggggcagugggaguuguauuuguguuuugaauuggugacuugguuucuuauuuuuggaaaauuuccaggcauugucuucucagauacugcuucucuuccuuuuuuuuuuuuuuaaauaacuguucuuaugggauucccaauaacauacacauauaccuucucaaaauguuuccuaagucuucauuuuaaugcagaguuacugcauuuuuauauuuuacugaauuuuuuauaguagcuuucccuuccuagaauuggcuauuuuuagauaagugaugguauauacugaauaauaucuuuguaacuccaaaaaauuaucuuauuauaugcuaaggagcacugagcaaugcauagcccucuuacuuugccauaacauuucugaaggcuuucuuuucuggauuuaccuauccuucucaucaaauaaucuaauuacuguuauccaaacuccuuagccagcuuucauaacauaucuugaugucagagauguuguuuucauaacgcaucuugaugucagaaguauucuccaggaaaauuagucuguucaguaggcaugaacuggaaauguaucaguacgugcauaaaguagugaggaauacauagaucuauguggacaauauaauuuugucuuuuuuuuucuuuguuuagcaaaaugguacaggcuuuuuucuucuuauauuuaaccuacuucucuuuaaaugcugacauuaguuuccagauuaucuucucaaauguuuccauguuuaauggaugguaugaacuaggaauacaaacuuuucagugacuagcgguaagauuucagaaguuaauucuguauuuaagaauuuuguaauuaugucacuuggaacuggccuuuagaaaaagugugaauuucugacugguugugagaaaaauuagucaagaaaauaaucaguaauuuuuuuguuaacguagaccuucaauauugauguacggcaguuacauugggcagaauauauagagaacuacugcuugggaacuaagaaguacguauugaaugaagaaaugucuggccucccugcagccagaaaacaucugaacaagugaguuugaugcauggauuugauugcuucuugucuuccuuaugaaauauuccacaauuuuuuugguaaacugguauauuugcuauaucugucauucaaagaugcagauaauuuuuaaugguaaucucuuauauuuguagugcuuuuuaaugugauuuuuaugacacuuuuuaagacuuucacauuauuaucccucucaugccucauaacucugugcgacuuugcagggcagccaguucuauagaugaggaaauugaggcuuaggaaaguuauauuugccuaagccauauuguauugaguggcaaagcaaacuagaauauugaucuuugacuccauauucgaaccucuuuucucuacaucauuuuucuuacauugccguccuaucuugcacugccugcugaggucaguauaauuuauguaacauuauuacaucucuaaagguuuguauuucuuucaaacaccaucagaaacaucaaaauuuuuugaaacaugagcugaaacaugagaguaacauauuguuacucuuugagaaaagggaggauccuccuuuaucaaguuaaugccauguuuuaugcuuggauaagggcuuauccacuuggccuuugaucuugugacugucaccuguaacugaaagaguaaguuacuugucugacaacuuguaagcaacuaaagaugucaaaaaaaaaguuugcucuauuuugucuguacugugauguauguaaugaaugaaccuuuuuagauuagaugggaagcucuagaaauucaagguacauaucuguuuuaccuacaguauacuuaaugccuaucauaaguuucaaauuaauauggauuugagcuuugauuaaaaacucaguauuaauuagcugccaucuaacaauauuuuuuucuagaaaauacugucuaacauaucucuugauuugcuuuccagguugcggaauauacguuaugguuuuaauacuauccuugugauccucaucuggcgcauuuuuauugcaagaucacaaauggcaagaaauaucugguacuuugugguuagucuguguuacaaguuuuugucauacuuccgagcauccagcacuaugagauacugaagaccaaggauucagcauuagaacaucuauacauauggugaucuaaauguacaaaauguaaaauguauaagucaucucacuuuuugucaagacauuaaaccaucuuagaucggagugugaaguaaauuaugguauauuuuauguaacauuuuaauguuuaugcucauaaaacuuagugaacacacuguguuaugccagcucaaaucuacaguagccaccaaaaccaugacuuaauauuuugagcccuagaagaaaggggugugcugaggacaagaguggggaaauaggaacacugaccaguauaacugugcaauucuggaacauauuaauuaaaauaauaugccuuaacauauagugaauuucuaauucuaauguucagugcaauggaagacauuuauuuggacaguaauacuagcaaaguugguagauauuugauucuucauuuuuuguuuuuuucauuaguugaaguggguuuuaguuuuguuuaaaauuauaaccagcguauuuucacaucauucuguaaguuaaaugauaucaaacaugaaagagauguucucauuuuucuuuuucugauuaaacgucugaugcauaucauuuuucuauaaguaaucaguugcuuuuaaaaucagaaggcuauauuauucuaaugacccuauucgaucuaaauggguuugagaauccauaucagcaacauacguguuuuuugacagaaagugaaaacaaauuccguaaaacuguuaguaucaaaaagaauaggaauacaguuuucuuuuccacauuaugaucaaauaaaaaucuugugagauuguuuauguuuugaagcaggaggauuucuugagauuugauggaagugggaguugggaaggauucaccauacuuguguucuccucccuuuauaaauuuuauucauaggacuuuuaaaaggcuugugcuaucuuuccagugaaaacugaaagugcauuauuauggaagaauguauuugcagguaguaauagcauuaaaaaauauacucguguguaaacacauacuaauuuugaccuugaaagaugaauuccuucaagaaaaauaaaauaaugcuuaagauaauguguacgaaauuaaauaaaggacuuuauuuacauacuacauaagguagcaaacuguugaaugaguuugaagguaucacuuauuuuuuaugcaugugauuuuagcuuuagaaagaaaugcguuauagaaacaaguaauagcaagaaaauugauguauauuuuaaugauacauuaaaauucccuuuuaaucauaauaguuaacucuacuuacuguuuuaacauacauuugauuuaacaaauuguucagcauaacacuucuaauuaaguuuaucaaguuguacuguauuagauaaucagcaguguaucuggaguauguuuaaagagaacaguucgcaauacaaaaaguuacauggagcuuuacaucuuaacuuucuuugucaauuuaaaugcaauguauaaaaaguuuauuuugcuauugugaaaaacuaaauguaaaggaaaucaccuacuuucaugcagguguauaaucuugaaaaggaaaaaugcuuccauguugaagccagauuuucuguaguaaaacuuuuaaauauuauuuuaaaagaaauauguauauaaauaucucuauauucuuuggaaugauacuaaagucucuggucuaggaccauaccuuauauaaagguauaagagaccaugacaaugucugaaaauggaauagauaaugaugccuuuuauuuaaaguggcccacauaauauacauugaguacuccaucucuccaaauguauuuccauaauguguugaaaacaugcuaacauuuguaugauuuuuauacuucugccgaauagacuuagaaucagaugaauugucugugugucuugcaaaagaguuggggacaacuugggcaggccuaugaagugcauagggaguguaugucuucugaaugguuuuauuguucuuguaaucuagcuuaaagaaauguuaacugggagggugcugaggccacucacugcauuaauuuuguguguuuagaguucuguugucaaaagaaaacuaaugaauaaauuaguuugucauucuagaauuuaaaguucuaagauuaguauaaagaguauauagauuguuaauccccaccagcuagacuuugaacuuaagucagacuuaaagauuugagaaauuauuugugucauuuacuagacgugauuuuuaguucuguuugauuauauuuccuacacaaacuucuuauuuaacaggauagccuacuaaauuaaauguuucuuauuucacuuaacucauuugauuaaacuguauucuaaaacauuugggguuuuucccccuauucaguuuuaaucuuggaauaugcauuuguaaauugugaugucauugagacuauauuuauauuugacuuggcaacauuaacauguccuaagacuuagugcagagaagcuuggcaguacguucuuugacuuaaggauggcauaaaauaaucauuuuugaaccuguguaauaaagcuugaaagcagggaaaagaauuuccuuuucccccuuuuuuguguugucuauaggaauuaacuugggauuguuuuguggguuuuuguuuguuuuaaauguaaauugagaaucuuuuauaagaaauaaaagcauuauugggugccuuuguuuguaaaccaaaaaguaauaaaugaaucccuauauuuccauuauaguauuuauuguauuuuuauguucugaaaauuacccauggaacaauaugcuuaggauuacaggaagcaguccuuacuuacacuucuugucuguuuuagguguacuuguuaauucuuauguccuaauuuuauuuaauucugaguuccuuacacagcauuuuagggaaagaauacaggcaggaugacacuuuguguuaaaguguuauuuuuauguauuaccuggaaugaggcagguuuuuuucuguuuucuaaaaagaguaaccaagauaccuccagggugucauuggguuccagcugcucuccuccacauugaaugauaucuuguuaauuuauaggcacauuugugguaauuuauaugucuauagaguaaguauaagagauaauucauuaguaauaggaauuaacugaccccuuuuggaugggggagagcaucaggcuggggucagguaaguguaaauggccuucugagcaugcucuucuaggcugacucccagcccugacuugaaaccauuagcgcuaacuugcucuguuuugagaaaaacuuuccaaacuuuugcaugagaaacuagaaaaaggaauguaugccacguaacuggauuacagaaaugaguuaauugucucugugauaaaaaaaaaaaaugaaauauuuucuuauugaauuaauauuuuugucuugaagcauuuucuagugauagaauguauuugucuuuuuuccuggugguacccucuuagcauauaucuuugcuauccuuaagauccuaaacaaaucaucuuugucaguuaaguauaguugcgcaaaaauuguuaaauccuuugucuuuauuaaagaaaaauuugaguaacauuaag

SEQ ID NO: 15361 - RNA, 39591 nt, Homo sapiens
uuuaaaaaaaacucuuuuaaaaaguugaagaugagaggaucuugucuuuaauuauccagaaguuucuaaaauuaaugaaacaacaugauuagccuuccauuaauauuagggcauuuauuaagagaauacaaucauguuacaaaagugcagguuuauauugagugggguguuaccuuagaaguucucugugauucuccauuuguggucauuucaggcucuuuuggcccaugagaccugcguguucuuuugcaaaugaggaaacagguucagaguaguagcuuuaucuuaggaucucauagcugcuaaauugcagaguuuggacuugaacuccuagcaaguaaauauaucuuaaguagcuuuguauuauguuucucuuagugcauuuauaaaugcaaauaugugauaauuuuuuuuacagccacuaggaaaacccacuuuguaaguaagccuaagugaauuccuugaaaauaauggugauacaugguacucagcauuuugcugaucuucagaaagauugcuucuuuaacuugagucaaaagauaagguguguuuugaacaaaauagcuagcuacgacugcuaggugcuauuuccuaaagcagcucaagaacagugaaaauaaauguaaauuaccuuucacaguccugucguccccuuccccaagugugugggaaugcuaaugcugcagcuuuucucauauugcaguggugcagcuacuuuucaacagaugacaggcgcuuguagauaucuugcuguguagcaggaaucugaacagcaugcucuggaaggauugucagcauuccuuucauggcuuuugcuuuucuaguugcuucuggccacucuggcaggacuguggaagauaggacaagucugaacuucccuuaaaagaacucucauuuuuauuggcuuugccaauaaguuuguagggugaaguguauugguugaauggggaagccaagaauacauuucuuuucaaauuagugcggcuuuccuuugagccagaggcagaguuuaaaaauauuuagugcuugucauauacaccauggaauacuaugcagccauaaaaaaugaugaguucauguccuuuguagggacauggaugaagcuggaaaccaucauucucagcaaacuaucgcaaggacaaaaaaccaaacaccgcaugcucucauaggugggaauugaacaaugagaacacauggacacaggaaggggaacaucacacaccggggacuguugugggguggggggaggggggagggauagcauuaggagauauaccuaauccuaaaugacgaguuaaugggugcagcacaccaacauggcacauguauacauauguaacaaaccugcacauugugcacauauacccuaaaacuuaaaguauaauaauaauaaaauuaaaaaaauuugaaaauaaauaucaaaaugcacaauaagaaaauaaaaugagucucuuguuggcagcaaaaaaaaauauauauuuagugcuugugaaguuuuugguggcauuaugcuaaguugugggaauuguuuuuuuuuccccuaggaggaaaauuguguaagucauuauaguaguauaaaaucacuuguuaauagcuuugaaagaagccgcuucauucuacaacucucuuagcaagcaaucuuuauucuguuaggcuugaggagaauuaagccuaacagaauauuuauuuucugcuauuugguggugacagauuagcuguuuaggcuuugguagggcagaugucuugauaacugaaggaaguacaucauucuggguuuuuuuuaggguugaacucaucccaggcucuaauuucucaauuguuagagggaaaacugcuuaauaucuuucccugucuuacaugcauauguacaccuauggaaaacuuucuggugccugguaccuaguaggcccuuaauaaauauuuguugaauaaauuuuuacauaagaaaaaaauaaagcucaaagaauuagcugaucuagguauguucucaguauacuauuuaauauauauugaguauguaauugucauuaauaccuacuuguuaggaaguauauugaugcagaauuauucuucauaucucccauaugagguuauugacaucaaaccguuuuauuuauuuauuuuuuuuaagagauggggucuucuguguugcccaggcugaccuugaacuccugggcucaagugaucccucugucucagccuucaagaguagcugggaccauucauuugaacuucaaugcucuguaguuuuaauuaggcuuuuugucacugaaaucuugaaauagucucaaaccugaaguagauuauaaugaaaguaaccauauaauuuauugugcaaacugagacacuucugagaaaucaaucaaaauuaaguuggagcagcauguauaaaccaggcuuguucuaggcaaacuaggacauaugaucccuguuuguuuuuauuuuucaaaguaaauguuuuaucgaaauauaauaaauucagaaaguccauauauucgaaguggacagcuugaugaauuuuuaaaaaaugagccucccagaucaagaaauagaaauagaacaucaccagaaucccagaagucuccuucauguuaccuucuggucacucccucuucuucccugcaagacuuuuggccguagauguuuugccuaguuugaacuuuauauaaauggcaucauauaguaguacacacuuuuuuaccuggccuuacuagcucaacgcucccuuugugagaucccuccacauguguuuuagcgaucguuccuucauuuuuauuguuuuuaaauauuucaucauaugcauauaccacacuguauauguuauauuguugaugaacacuuggguuuuauuuugggccaacaaaaauggugcuguuauaaccauacuugcuuguucuuuugaugaacauauguacuuauuucuauuggguauauaaucaagaguggaauugcuagguccuaugauaugugaauguucagcuuuaguggguaguaccaucuccuaaguaucauaucaaccuguacuuccuccagcaguaagaugagaguuccaguuauugugcacccuuauucugagggucaguguagugggaucacauagggguuuuaacuugauaacuaaugaaguugagccccuuuucaugugcugucauuucgaucuuuuuuuuuuuuuuuuuuuugaguuagagucuugcucugucggccaggcuggagugcaguggcacggucuuggcucacugcaaccuccguaucccgggcucaagcaauucuccugccucagccucccaagucgcugggauuaaaggcgugugccaccacgcccgacuaauuuuuguauuuuuaguagagacgggguuucaccauguuggccaggcuggucucugaacuccugaccucagguaaucugcccgccucagccucccaaagugcugggauuacaggugugaaccaccgcgccuggcccaauccuuuuuuguaaugcccauuuguauacuuucuuuucuuguuuguucaagccuuucccauuuuucuauugguuuaucucucauugauuuggaauuuacauauuuauguauucuagauauuaauguuuucauuauauauauauuacaaauaucuuuuacucugguuugccuuuucucuuuauuguuaaugucuugggauaaacuucauuuuaguuuuguccaguuuagcaauauuuuccuuuuuauguucuguuuaagaaaugacugcaugaaagucauggaaaugguccuccucuguaaucuuguagaagcauaauuguuuuaccuuucacauuuagaucuccaguuuaucugaauuucuguguauagugugagauagaguucaaaauuucauuuuuucuauauggauaauugacucugcaccauucucuucuugucccaauaccacauuccuguagcuuuauaauacaucucaauauaugguaauguaaguucuccaucuuuguuauuuauguuugucuuggcuaaucuuggcccuuuguauuuccauaaacauuuuaaagucucaguuuccauauuaaaaaaacagcguagauuuugauugggauuauauugacuuuaaggaugguaaauugacaucuucagucuuccaaucuaggaauauaguauaugucuccacuuauuuagguguuguuuaauuucugucaguauuuaguagguuuuagaauagaggucuuauauaucuuuucuauccuuuuccaauucuugaugguuuuuuaaaaaauaauuuauugagaugagauucacauaauauaaaauaaccauuugugucuguuuugugcugcuauaacaaaauaucuuagacuggguaaucuauaaagaacagaaauuuauuucucaccauucuggaggcugggaaguucaagaucaaaauguaccaauuguuuugguugucugaugagagcugcucccugcuucuaagauggcacguuguugaacccucuaugggaaaggaauguuguguccucaccuggcagaaggcagaaagaaaagcaagagagcaaacuagcacaauguugagugaagccacuuuuaugaggcccuuaaucccauugaugaggaaggagcccuccugcccuuaucuccucuuaaagaacccuucucuuaauaguaucacauuggcaaaaucugaauuuuggaggggacacauucaaaucauagcaccauuuaagugagcaauucaguggcauuuaguacauucaguguugugcaacugccaccucuaucuaguuccaaaacauuucaucauucgaaaguaaaacuccuuaagcaguuucucuauacucaacuauuccccuaugccacaggcacaggcaacuaccaguuugcauucugucucuguauauguaucuguuauggauauuucauaugaaaggaaucauauaguaugugaccuuuugugucugacuucuuucauuugauauauuuuugagguucauccauguuguaguaaguaucagaacuuuguucuuuuuuauggcucaguaguauuccauuguauguauaaaccacaauuuguuuauucauuugcugauugacaugugggcuauuugugccacuuggcuaucgugagcagugcugcuauagauugaguaucccuaauccaaaaaaucugaaauucagaaugcuccaaaauucaaaacuuuugaccgggugugguggcucaugccaguaauccuagcacuuugggaggccaaaguggguggaucacuugaggucaggaguucaagaccagccuggccaacauggagaaaccccaucucuacuaaaaauacaaaaauuagcugggcgugguggcgggcaccuguagucccagcuacucgaaggcugaggcaggagacucacuugaacccaggagguaaaggaugcagugagccgagauugugucacugcacuucagccugggugacagagugagacuuucuccagaaggaaaaacuuuuaagcaccaacaugaugcucaaaggaaaugcuuccagauuucauauguucagauuggggauguucaaccaguaagcauaaugcaaauauuccaaauuugaaaaaaaucugaacaaugaaaugcuucugguccaaagcauuucggauaggggauacuuaaccuuacaaaccugugucaacuuguuugagaaccuguuuucaguuuuuugguauguuuaccuaggaguggaauugcugggucauaugauaauucuguuuaacuuuuuaaggaacugccaaacguuuuuccacagcagcugagcuauuuuacagucucaccaacaguguaugauuguucugauuuuuguacgucuucaccaacacuuauuuuuuucuguaauuuugguguucuauacuguuuuaagugguauaauuuugaguuuaaaauuuuucacuauuucuuauugguauacagaaauacauuuuuucuccauauaaaccuuguaaucaggugacauuaaauucgcuugggggcuauuaauuuuaauagucuauuuauuuacuggauuuuguacuuacaccugaauuuccauuuucuaaaugcuuucauauuauuuguuuccuuuuuuaguaauuauauuauggaugcagcagucuugugaacaacuuagagaauauaggaauuuaaguuuucuuaaaauuuuuccuuaguuuccuuuguaguucuauugcuuuucauuuuggucuuucuuuauuuuguagguauuuuucaaauaucuggugauccgugguuaucuguuuguauuuauaauggaauagggugguugguuuugguagcugauaguggcuuccucuaguuuuuugaggucuguuuucucaaaagagcuuuuccacagaugguaugauugagaacucugcgugaguuuccuuuaagguggggauauccaagcuuuuggcuucccugggccacauuggaagaagaauuaucuugggccacacauaaaauacacugacacuaacaacagcuaaugagcuuaaaaaaaaucacaaaaaagcuaaugauguuuuaagaaaguuuaugaauuuguguugggcugcauucaaagccauccugggccauggguuggacaagcuugcauuaaggccggcagcagaggcugaggacuuaaaauguauucugagcgcuauaaaugcuuuuuucuuuuguuuguuuuuguuugcucucuccugauccacugccuccuccaccuucguuuguggauguuuggagcaaccaucaggcucaauuccaguucucuuuugucccuaguacccaugcuggaugcucuucucaaucagaucuagauacuaagccugggagccaaaguuuaugcagaaaguaagacugucaugaguagcucugcuguucugugagcaaucuuuuaauuaucuugauuuccuuaugauuuaguccagcuuuuggauccugaccuugauguuuucucccagguuccauuuaggagauugguaaaaagagcucuugccucauuauaguccuuuccuguccuuguuuugcuuggguugcuguuucuucugguauggcuauucuaccaauucagucuuaucuguuucuucuagaaauucuucuguuucuuuucuuucuuccuuuuuguuugacuugguuuaauggagcuauuuuuuccagguuguuaugaacauauauuuuuuaauuaugaaaaauuuggacauaaaucacauguaucuacuccccagcuuaaauaaaacauaaauacaauucaagcuccuuauucucucucugguuguauugcacucccucucaugcaucuauuaauauuuuuccaucuguaugcauugcuaaacaauacagagcauuguuuugaauguguuagagcuuuuuguagugacauaauacaugaauucuucugcaccuuguuuuuauuuuuucuuucauuaugguuguuuucuuaauaugucuuuucugcuguuuuagaggaauuuggguagagaagauaagucagcucauguauuucuuacucuaacuuuuuaaaaggggagauuuaagcaccuuuuggauauacugucacuaagagacacguaguagaaagggcucggugucaccucuucuuguuucaauugguguugauacgcgaauaugacaccuccaguguuacacaagcuagguaauugagucuugcugcugaccuguauuugguguuauaaaucccuuuggagucagagaaaccauucauuuguguuuaggguauaacugagguugaaugaagauuugaguucuuauugcuggaaggaauuuuuagacauccuuuaguacaaauuguaccaaagaaacucaaguccagagaacgugagugacuugucugaggugauccaagggaaaaacacaggguuaaaaauaagcuauaguucucauucuucuuuccacuuuacuauaaugaacuugagguuagaguccucucuuguuaauguucuauuuugacuuuugucugcuuuuuaaaauacuuauuugaauaccaagagauuuuuaguaugaaagaaugauggugaauccuuaaacuaaugcuuauuugccauguuuuucuuaggaucaaaaugguuucaaucccagaauacuaugaaggcaagaacguccuccucacaggagcuaccgguuuucuagggaaggugcuucuggaaaaguugcugaggucuuguccuaaggugaauucaguauauguuuuggugaggcagaaagcuggacagacaccacaagagcgaguggaagaaguccuuaguggcaagguaaguauggaaaaugagcacucagaacaaagaaaaaagcgugugcuuguguauauaauuauuguagucgucaauagcuugguauauuucuucaguauucugaaaaaauuaguaaaacaaaaaaacuuaguaaguuccuacaggauggcaagaaacuggauaugacuugugaaucacaaggagaaaaaguuuuccucugugacuggcaaaauuguauaacaagcucuaaauuaccuuuaugguagguauuuaaaguauguuuuuagaacauuugaggcagguuguuuguaacuacuaaauaauuuaaauagccuugauaauaauaguaauuagguagugagacuaccuacuauucuguaagacacuaugcuuugauaaaauuuauaaacaccacuuacucccccacaacaguauuaggagguagagaagucacauauucccauuuaacagaugacagaggggccguauagaauauaauaugucauauauuuugagccuuuggaaaaauauuacuaagaaaaaauggaaaugagcuagaauaaaauuauuucacgaucauaaguuugugaauucucucaaaaugaaugaauuuaucugacauuuacuaauaaauaguaaguugaaucggaaggcuauaagcucaauuuugguacacauaaggaaucugacugcaggcauaucucaaaaaggaauuucaaguagagcauuuauuuuacaauuagaauaacacucauuugaauaucuacauucguauaggccucuuaaaaaauccugaaacuguagcaagccucuucauagcaaccaaccagacuuuugacuuugaaugaacuucauauaccuuuauagauaguucuuuggaauuaauugucauaucacaucagcauuuguuugacaccaugcaacagauauuccucauuauguugguuuuauuuuuuaaugaugggauguaagauucuuucuuagaaguuuaaaaauuauuauuauacuuuuaaauuauucaaauuagucuacauuagucucccuuaaucauuuuuucucucugauucuuugcugaacccuucuggaauccuuugcuucccuuaaaaccuacaaggaaagagucaucaauggggcuguaaaaccacaaggcuuguucuaaguaaaaugucuacauguauguuuuauugcugucucugcccuuuguuuacucaucuuggcauuuuuauuaugaaccacuuguaauugguauguuuuaauuuuucuccugauacuccucuccccccagugagggguuauuuguucuuacucacuuuuuauuuuuuagauaauauuuauugugccugcuuaguccugggcacuugacuuguuguaggggguggaauucagggauaaguaagauacguuccuggcuuuuuagacaguuuuuaagagggaaggaagagggagugauagacgugucaggaguagauaggaacagauauuuaagcugaugugcuggccagaauugagggucugaguaaaacaugaagaagacuugggcaucuucuucggggucuucagagcagugcuucuaaaauuucuuccacacuaagccuaagagaaggaguauuuucuacuuagagccugagguuucauugaacuucagugguuuagccugaacauacagcuauuauuuucaauaaaaaaaaguuuuuuccccaaauauuugacuuaacuugauacuccauaaaauuauguaauuuuaucuuaugccuucaguuaccuccuggcauauccuaccacuuaauccuaaagccauguauucuccauuauguauagcauugcuggugaguccauaaaaaugaguccuuuuuaugucaaauagcagugaguguacacuuaaaguuaguaagaaauuuuagguauggucuacucugauuuugaaauagguauaaagaacauaaggccaaaagcacauaccaccauaugggacauugacuuauagcaggguuucucagcuucagcaccauugacauuuugggcuggcuaguucuuuguucuggaggcuuguucuaugcaugguaggguuaucagcagcauuccuggccucacucacucuugugacaaccaaaaauguuuuuagacaucaccaaaugucuguuggggaccaaaaucaccccuggucaaguaccaugacuuaugggaaugucucagguaacagaaacuccauugggugaugaagauugaauuaaaauaauugaucauggccugucacggugguucaugccuauaaucccagcacuuugggaggccacggcuggugggucacuugaggccaggaguucaagaccagccuggccaauaauggagaaaccccaucucuacuaaaaaauacaaaaauuagccgggcgugguggugcaugccuguggucccagcuacucgggaggcugaggugggaggauugcuggaaccugggaggcagagguugcagugaguugagauugcgccacugcacuccagcaugggugaugaguaagacccuaucucaaaaaaauaaaaaauaaaaugaaguaguugaucaugaaguaaauucaggaaagaaucaaggauauuaaaaaggcauuaguaaacguaguaaaguaggaacuaauuggguacuaguggguugaaagcaccagaaaagaugguauugaguaaagagauguuggccagagaagggaagaguaucacauuuaagaucuagcaaguuuaagagcagcaugaucauguccuggugguagugguauagauaacugauauuaaaggaaauuaaaggucaucagcaauuaggagaaugaagaaguacgaaucaggguguuaaaaaguacuuuuuuagucauuccuuagguuccuuuuccucugcuugccccauaaggauugauauucuucaaguuucaggcuuaggccuuguuuucucacuagguccagugagaugguuacucagccuuccucuguuuuaugugagaugaauggauguccuuuaaauuagauuuggauuuaguuucauauaguuaggaucuuguguccuuauuauugcuguuaccuggauaaacucuuuucuacucccagggcuucaguuacuaccuguaugugguuaguaaaaucuauguugauaguccagcucucucccugaacuuagacccacaaagccagucaccuuuacuagaccugucuucuggggugucaugcaggcacuuuacacuugacauucagaagacugaauuuguaucuccaaaacaguacuucuuucucucccugaguucauuagucuacugaauuuauucacuuaacaaauguuuaaagucuuuaucuugccaggcaagaucugcucucuuggacuuguaugcugagcaaaauagauauggacccuacccuaaugaaguuugcauuccuuaucucucaaauucagucauaagccaaaaugacuacauccugaauguuacauccugaaucucauugccguuauuuugauucagacaaguaaauaucuugauaugggcaacgacaagaguguccuaaaacucauuacugccaaaggauuuuuuaaaaauuaugaacaugcuuguaucaccucucugcuuaaaaucugucaauagcgaccgggcugguggcucacgccuauaaucccagcgcuuugggaggucaagguggggggaucaugaggucaggagaucgacaccauccuggcuaacauggugaaaccccgucucuacuaaaaauacagaaaaauuagcugggcgugguggcgggcaccuguagucccagcuacucuggaggcugaggcaggagaauggugugaacccgugagguggagcuugcagugagccgagaucgcaccacugcacuccagccugggcaacagagcaagacuccgucucaaaaaaaaaaaaaaaucuuuaucaguaguucaccaugacucccagauaaaauucaucuuuuuaauguggcuuaaaaggcacaguuaucuggccuuucuuaucuccauacaacucuagcugcuuuuccugcauacucuauguuccaggcugacugaauuauuuuuaauuucccaagcauauuaaugccuucugauuucuaagggguuauacugcuacuuccucugccuggaaacacuauuauucuacuuuguaauuucagggccuuccucccucacuuuugucccuaacacacacacacauucuguuaaaugucauuuucucugagaagccagcuuguguguggucuuuuaaagcuggguuaguuguuucuccuaugcaggcccguaacacuuaccuguuauugcuuaacacuauauuuuaauuguacauuuacuuggaccaaaggccauuuccuugugucuuuagaaucuagaaggugccugccuggcucauaugaaauacucaguaaguuuuuauuuuuuaaauuaauauaagaaaacauuaauauucaagucaugugcuagcaguggaaguagcaguaggagcuaucaguaggagcgggaagacuguuuauacuaaagucauccaggaauguggaagugagcacugauauguuauauagacuuucuucuuagguuaagaauccugcuuaaacugcaaguuugaacuucaaauggagagucaaagugugauagagcagugaccuagagguggcaucaguguuucucugucaaaucugggauaaaaaguuaaacuugacucacaauugaauaugccuuuaaacuguaaucauuuugugaucugauugucuagcaaaauuuauuccuuuggguacacuuaaagaauguuuaauguucagcuuaaauccuauauauguaauacuucugaaguuuguucaguuucugguuugcguuugcuuaccaacuuuuuccuugaacauauugacuuuguuuuccuuuuuaaaaauuuguucuaagauuuuagguagaauguaaaucguguuuuuuucuaaucuacuaaaagggaauaaaauaaaaaugaagugaagugaaaaauuaagaucuagauuuuagaaaucugaaugaucauuuuaaacauuguccuaaugucuauauugcugaagucuauucugaggggugauacaaucuaaucagccaaggcauggacaguucaaauucaacuuugugaacuaccagcuuuguguacuuagcaaacuccuuaacugcucugagucucagauuccuuaucugcaaaaugaggauaauagcgugggccucauaggguguuuucuauacagaauaauggcaauuaagaauagcaacuuuaggaauuguauaguuuaaguuucuaaaaaaauagucauccuuggugggaaaaaaauggugauaaugaguuuuagaaaguggaaaaauacugcuguaaaauaaauauuuuucccucuugauagcuuuuugacagauugagagaugaaaauccagauuuuagagagaaaauuauagcaaucaacagcgaacucacccaaccuaaacuggcucucagugaagaagauaaagaggugaucauagauucuaccaauauuauauuccacugugcagcuacaguaagguuuaaugaaaauuuaagguaaguacaaguaauuauauaauauuugaacuucaguauaguuauuaaaaaaucucauuuuaauucuacuuuuuagucaauuuguuuugaaugugauuugauacuauuugccuauguuaacuguggcuuucaguguccuacagaguguuaaaagaauucucuucuucuucucaguuuaaaaaucuuggauaacuaauacauguuuauuggaagaaguugccaugaauuuaaacaugcaacagggaagaggcaaaaaguggaguagaagaaaacuuagucuuaacaacuaauaguguuugucuucucuuucuucagaagccuauaccccagcagcuuuauucuucuaaucuacaucauauccaugugaaaauaaacaaaauuaggcucagguuuuacaggauaaggaaaaauugguuauaaauuuaaaucacaccuuuuuauuuucaaacuuuugcaguagugcuaggggcaagguauguuggacauaaauuuaauuuaaaaaauaauuuagacuucuuucaagauuccuguugcaagaaaaaguuaagacucuaaauguccacuauucuuaaaaaaaucuaaugaguaugcauuucaaauaaugguucugaauucagagcauucuuuuugacagugugucaaaaaauacaguuuuuauaauguuaaucuaauuguauagucucaugccaauuaaaaugguguagacuugguauagguuucaaagcuacuugaaauguaaaauguugucuuuaaaauguuuuaaagauaaauaacuaaaaggaggauauugaaugcucuaacaaagaaaugauaaguguuuaagaugauagaugugccagucacccugauuuaauuacuauacauuguacgcaucaaaacaccgcuauguaucucauaaauauguacaguuaugauaugucaauuuaaaaaauaaaauacauuuuuaaaaguuuaaaaaauugaguucugaggcugaggugggaggaucacuugaagccagccucagcaacauaaugagacccugucucuauaagcaaaauauuuuaauuaagaauuaaaaaaauuaaaaauuaaguucugauuacaaaagguuugauauuauucccccuauugucuuuaucuaauauggaaguauaaacgucagucaacauuauauaaggugacaguucagugccaaagcauuacaguguguuuugccuguauuccaggugagggcacuguaauaguuccuuagaucucugcaguaguccuuuauggguuuucaguguauuuucucauuaauuauuuuauuccauagucaccuuaccuacuguaauauuauagggaaauccauuguacgcuugaggaagcugaggcagcauuguaauggaagggcuaugagcuuuggaauuacauacauuaguucuaaucuugaccauaucauucauuuacuggugaguuuguauaaguuauuaaccgccuuaagccucagcuuccugauuuauaaaauugaaguaacauuucucaaaagauuauuuuuuuuuccuucaggaaauuuaagugaugucucaguuugacuguccauggcaggaaaucugaaucuguagcaguugcuuuauuuauuuuuuagcucuuucuaugcagcugacagguaaaauauugugcagccauuauguguuaaugauucaaaggugacaaaaguauguuauuaggacuauaauaugaucuuauuuucauaacauauauguguagauguauuuauguacaugucuuucuauauuugcugauaauacauuuaucuuugaauguugcaguuacagguagguuuuuagucuuaccuguauauuauuuuuucuacuaugaacauguguuaaucuucaaauaaagguguauacaaaugacuuuuaaaaauuauuuuuaaaaguaacaccuauaagaaaucuuaaagggacugauacccucaucaacuaacaaauauccuuauuuuuuacauuuaaaauuuuguuguguguguauauuuuuguauauaggucuaacuauuuguuuuuaacuagcauuuccaagauugugaauguggucucuaauuuuuagugauuuaucuuuuccuaaaauucauuagugugaaauggucaguaaagucgauuuuuucccccauaguucuggcuuuuauuauuuccuucauagacaaaagaaagaguucacauagcuuuaugaagcuuagcauguuuucaugaaaaacauacguagauauuggcuaaugguaguauagucuucauugacuuaacgaggaaaguuauaugcuuugaaagguggacaggaaacauugauuaggguaaaacucauaaagggaagcuuuacaaggaggaccaaaguacagcacuuucagggaacuuucuuucugucccccuaggguaagcaaggcuaccauuaaugaaaaggacaucuucucguuauuauuuucuucuuuuacuagagaugccauagcagaaggcaucuuauguauuacauuguuuuucuuuuccuuugucaaagcaucuauguucacugaccuagcccuugucauuacauugaaauuauuucugggaagcaauuuuaauggauguugacuuccaaguggugauaggacauuagguuugggucagacacucuauaauacuccaggcaggcauauaacaacuucguaugaaagaauuacuguuuguuuuuguuuuuguuuuuguuuuuguuugagauagggucucaccuuuaucgcccaggcugagagugcagugacacaaucauggcucacugcagccucgaccuccuggguucaagugaucgucccaccucagccucccuaguagcugguacuagaggcauaugccaacacaccugucuaauuuuuguguuuuuuguagagacaggguuucacuaacaguuacucuuuauaacuacuuguuaaguuaaccuacaaauaaaaaauggcaugaagcuuuuacuguuggggggaaguuuucagauguuacuacaacauuaagcccaauaccuugggagagaaaccaacauaaauugcacacagaucuuauuugcaaagugcauauggucuagaggcgauaggauaugcaaaauaaccauaauguaggauagaaaauaaggauguauuaaggagcacacaugaaauccuauuagaguuaagagaagguagauagagcucacuuguuuucagauguggugguuccuaaaucuugagacaggagaaaaauagauaggcuuaggauucauaaggaaauacugacaaaaaguguggggagggcugggcgugggggcucacgccuguaauccuagcacuuugggaggcugaggcagguggaucaccugaggucaggaguucaagaccagccuggccaacauggugaaaccucaucucugcuaauaauacaaaaaugagccgggcaugguggcacacgccuguaaucucagcugcuugggagguugaggcagaagaaucacuugaaccugggacguggagguugcagugagccaagaucaugccauugcacuccagccugggcgacaagagcgaaacuccgucucaaaaaaaaaaaaaaaaaaaagugagaggagaagugaagauaauaaauggaguaacuuaaguaguucaucaugggaucuggcauaagggaagguacuagcugguauaagggaagguacuaguaaaggaagugcaaguaagacagggucacuagaguugagaguaauggagaggcaagaaacuggagaaugugaggacaaaaaccaggcugaagggagagauggauggacagauggugugguuugcggaaaauucauaguacaaaauuuuagaaauagagcaauucugagugauaaaacccaagguaugaauaugaaagauuuucagaaaggaauggaaguuaagauugaugcuuagaaaagaucaagaaacuauugaguuuguugggcauugauuaucaaacuuuagaauguauuaagaaucuuaagaauuacuggaaaguguguuaaaaaugcauauuccuagacugcacuugccaaauuuugacuuuuuaauuuuggaaucauacuccagaguucuuuuuagcaagagccuuagguguuagucacuguugcaccuuguuuugccccuuuagaaccauugcugucagaaucagcuuuggagacauuuuuuaaauuacagaugacugagcccccuacccuaagauugcgucauuguucccuaaauaucugugucuauauuuucauuaagauuaaaaaaaauggcaguaguagugauaagaucucaucuagacaguauuuucucaggggcaguaggguggaaaagagacuugugucaaaauggccuggagaacuuauuuaaaauauagucuuucagaccucauuucauguguuaaaaguaucugaugaugagguccaggagucugcauuuuuaauaaacugcuaguuauauguuaugccaaguaugagaacccugguuuaaggucuuuagaaguauuaucaacauagauuucuuugaaaaaccuaagaugccuguagaagaaagacgaacaagaaaauguauuggcacuucaggucguugagcuuuuuuuucuuuuuaaauuuuucuuugaagugauuuccaugucuucauuuagugaaggauucuaauuacaaagacuuucucauuuuguaccccccucccaaaagccugucuuaccgaagauacauuuaugacuccauauaaccaaaacaaugagaacauuauuuuuguuuaguacuaaaugacuucugauauaacaugucagagucucagucugaaggucaauggaguagaaauuggauugagguaaaacacaguuagguuaacuagccuggcagagagauacuagauguuacucacuugggugcagaauggcuucagguuugggcucucagguacagaugcaaagggaaaaaggcaaggcauagaaguguuccucucaaauuaucccuuauuuucggugaccuagaaacucugucaccauccucagggacauguaacagaauauccuuuguguacuuuucccaaaacauggcucuuccugcccccauuguuuugcaaaugcaaaagaaaauagugcauucccuuauagucuaguggacaguauccucuaugugaaaugucuuucuuguuggauuuucacuugaacagauuuucucccucaauuaaggaagaaaaaaaaaugcauccaugauuuuaagaacucaacccaauuauuucauuaaaaaaauuauuucuaguguguuuucauagggucuuggauacuauuaaauuaaaagagaaacuauggcacaggacuuuuuuucucuccuggaguuacuccuuguuccuggugacccaaaacuuguccuguccucaggaaccuguaacagaauauucucuguauuccucucccaaacaguacccucccuauccccauuguuuugcaaaugugauagacaucaaagcacugcuucacuuuacagugaaguagacuggauucuaucuaugacaucuccuggucuuuuaaaacaauaguuggauuuuuuucuuaaauacugaaaauauaagaauuuuagaaaguacugaaaacuuuuuuuaaaaaauuuccuuugaacauuauuuuucauuauuauaaacauagacuuucuaauuuuacuuuuaaaacaauauagaaaauuucuguauuucuaauuuuuuccauaguuauaauuuuagugauuugaugauauuccaucauguugacauaccacaguuuauguauuauucacuuagaauaaacuuuaaggaauuuuaguuucuuuuuauuuggaaaaugaggauuagaacaaguuuuuccucugaguuaauuucaacagguuaacuagauuaauaaauauaccauuucuguaauuccugguacuuuguccuaguuuccuucaaaucauuugugucaguuuguaguaucaacaacaguguauuacuuugccauuuuugucacuaauauugaguauuuaaaucuuuucguuuguuuguuuuuauuuuuuuaauugacaaagguauauauauuuuucauuuacaacauguuuugaaauauguauauauuguaauggucaaaugagcuaauuagcauauucauuaucucacauacuuuuuguggugagaauaccuaaaauccacucuuuuuguaauuuuuaaaaauaacaauauauugauauuaacuauagucuauguuguacaauagaucucuuggucaguuuuuuaaaagcuguaaacagaaguuuaauagaaagcaaaucuauccaccaucucauuaccuuaaggaauauuuguugacugccuguuuggugacuauguuagaaauacugcuaaauguuugcaagcuauuuguuuaauuuuauaccagucuuaguagguagguuucauuauuguucccauuuccagguaagaaaacugaggccugagugcuucaguuuauguccugauaaguaggccaagucaggauuugaacacaggucugauuccagagccuuguuuuuaauccugcuucaaaaaaaucguauguauucuuuugguauuauucauacaaauguuucauauuuuuauagacuucaaauaauuauuuuaguagcuauauucuuucauugugauaaaauacuuacuuuauugagucauuccauauuccauagugaauauuugggcucucuagguuuuuauuaauuacaugaugcuucauugauaacuuuucugcauauauacuuuugcuuuuguggaauuauuuacuucaaguaaauuccaagaagggaauauauagauuauuuuggggucuugcauaugccuuguaacagauguaccaguuuuauuauaauaucccuuugaauuuuguaggguagccuuagaaaaguguuuggauugauugcuacaaagaggaaaauaaacaucuucuuucuugauuauauguuaauauaauuuaauguuucugaguuuucucuggcuguaucacccuuauuagugacucuacguuaacauuuuaaaauuacuuaaccauucuauuuuuuucucccuguggcacauccauauuaugcaagauuauacuuuuaaaaaucaagaugcaaaauaagucuagcaugacuuaaaaauguaugcauaaaagcuaaagacugaaauuaucuguuuguuccuggacaauuauauaauuuuuaaauuucuacuuuaauuuuuaagggcuacaaggcagguuauuuuauaaucaaauuuuuuuaacacagcugauaaacauuuaauauggaaauaaaauacacaaaaucacagcuaaaggauaaguuguaaagaaacaaaaauuucucugucucucuacuucucuaaugaaaaugauauuuuuaacagguaaaauaacauagcuucccaauuuucuauugucacuuuuucuuuuuaaacagagaugcuguucaguuaaaugugauugcaacgcgacagcuuauucuccuugcacaacaaaugaagaaucuggaaguguucaugcauguaucaacagcauaugccuacuguaaucgcaagcauauugaugaaguagucuauccaccaccuguggaucccaagaagcugauugauucuuuagaguauguuuguuugaaauuuauauacauuuacuuugaucccaaaagaggccaaggcgggcggaucaugaggucaggaguucaagagcagccaggccaacauagugaaaccccaucucacuaaaaauacgaaaaaaauuagccaggcaugguggcaggcgccuguagucccagcuacuuaggaggcugaagcaggagaguugcuugaaucccagagguugcagugagccgagauggcgccacugcacuccaaccugggcaacacagugaaacucugucucaaaaaaacaaaaaacaaaaaaaaaaccuuuggauucaagucccucccucuucuccucaccccaccccauauacaugugcgcgcgcgcgcgcacacacacacacacacacacacacacacauacauuuaucucuuuucuucaaaaauuuuugcauauccccugcauucuuauuguauagauuaauaucuaaauaaauguuaaugaagucaauguguaguuuucacuuuugaccaaguauaaugguaauauuuggaggaaggcuccugaacaucuuauuagugauauuaggggcucucuuuuucagggaaucaaucuuagcaaccaagaaguaccaauggagacccaugacugccuguuuaauagcaaggcucuaauuuaucaaaggauuccccucaccaccccccagccauggaguauauauauagaggggccuuuaauuauuagagaaucagaggaaucauagucuuuuaauucauaaccuuacuuuuuaucuuucugaggacugagauccugucagcaauuguuacaugaaaauuauuugugaguauugauagauagggauuaaaugagggaguauauaccaugaccuuauucucauuugcugcagcucaggcuuucucaucaaacagacaagguucagacaagaaaaagagagaucuuuuuuacuuuuacaauuauauaaacauuccaguauccaccauauuuucauguuuguuaauccuuauauaauaucuuugaauuuuuuccuccuuuauucuucccucuuuuagucuucuuucuuuccagagauucuauccacuuugacugcuuaguuaacaucugcugcuuucuccuaaaauaagcacagucuuuucuuuaaggcuuuccugcuaauaugaggaaacagauagauuguaaaaaaaaugagaaauuaccaagacauuuucauuguaauucccuaauuucuauuuucucacucauuuucuuagauggucccaaauaucuacuucauuuucuucauagaucaauaaacagaaauauuuaauaucugcgggaaaaguugagugugaaaguuaauggagcauuuuacuuuuucucuuacuaacaauauauacaaacauuugagaaacugaaaaagaacuuguaagcuaaugcuguaucuccuuuccuugcugcaaagaaaucuagcuaacauaauuuuaagauaacucauggguuuguucuguaaacucguucuaguaauaaggcuuacuagcuaaaguuucuccugaguuuaggcagguuuuuuuuuccucauguaucaacuaucccuuucauuuuucaaaucucaucuccaugguggaauuuuuccuaaguuggguagcaauuucccuucaauuuaauugauguucuuuuccuuucauauacaaaaaguacuuccauauacagaagaaaauuuuaucuugauaaucucuguuuuaugcuuucuuaucaauuaguauggguaucauuagaguaugacaauauacugagucuacuugcauacacagcauuauugacaagaaguaaaaacaaguacauaauguauuagaaucagaaguuuaggaaaaaccauggacaccaccuaguauaucgcccuccuuuuacagaugaacagaguagaccauuucuucaaagagaacuggaggaauuuuuuugacuucauaguagguugcuaauugaauuuuuauagcaugcuucaauuuauuuuuauuguucaucauagcauuuguuaaucucauuagagcauaugauuugcagugcugcaccuuaaauacuaggccuuuuaugccuuuuguguucauuauaaauguauguuaauuauaacuguauauaauuaacauguuacuucauuaggugguuauauacagaucuguauuuccuaaccugcaaacuuccagaagguuucagauauauuuuggaauuuauuuggacuuuagagaggguauauaauuuauguacuguguaauaagaaaaaacuuuaacuugaucuggguuaguaucccugaucaaauacauguaaaauauaugaauguuuaaguuguaucaaaaaaaagaccauaagucaguguagaucagauuuugcuauccacuguaugauuuaugaaagaacucuuaguuuucagaucuuuuuggauacagaaauugcagauaagggauuguggaccuguaguugauguuuaagaaaaauaagacuaaguuccauuuuucaguaaaaguugucaaaugauuugagucagaacagcagauauguuugaaugugcgaaguucaauuaaguagcuuuuuauuuuauaguaaaauaucuggaaauauauuuguaugcaauuucuuuaccagguggauggaugauggccuaguaaaugauaucacgccaaaauugauaggagacagaccuaauacauacauauacacaaaagcauuggcagaauauguuguacaacaagaaggagcaaaacuaaauguggcaauuguaaggccaucgauuguuggugccaguuggaaagaaccuuuuccaguaaguuguuagaaaccuuuauaaauaacuggaguugagaauuuuaaguuguaacucuguauaaaaagagcuggcaguucuuuaagaacagguauuauuuacuaaaggugaauuaccauggcaaagcuguuuuguguucauagaguuaauuuuauugguacuuucauuucuauaaugugacgcuggguauauagaaauguagaucaacauuuaaaaaauccuaagugaaaauuaaaagcugugacauuuucuuaagucagaggagauuugguuuguuucuuaguagcaaaaagaggcagaccuuccaggagguagaccccuuccucuguagaucacaaaguaaaaaagguacaggguguuaggguauuugugaauuccuggaaugagagaaagcagaaauauaaaccaguugggucaauugauuuaggcaaaaccuaggucuguguaaugguaguaagugauagcaucuguuguugcuuugacaauuauucuauuuuucucuguuuuauucauaauuuugaggaggauuuaccauuuucccuaaucucaggcuauugaauuaguaaauagcauaaaaucaaacuugaacaagcuuaauuuuguaaaaauauucaacaauauaaacccucuuuuauaaauuucucuuugcagagaguuaauggaagaguaguagguagcccuuugaaaaugauuuuacucaauuauuuuugaucccagaggaagacugcuucuguuugggacugguagaaauagucuggccugaaucuagucuguuuuuuaguuuuuagaagacagcuaccaaguauauauuugggguuguagaguucaaauaauaaaucucuagcuucauaauguuucuaagcuucucucccuuuuaaaauuuuugguauuagggauggauugauaacuuuaauggaccaaguggucucuuuauugcgguaaguaaaccuuuugauuuauuuaauauucuauacauuuuucugcuuuuuguauaucuuuaaauauauauacacuauggcuuauauaucuuaagguguuguuuuuaauuucaacaaaggcagggaaaggaauucuucgaacaauacgugccuccaacaaugcccuugcagaucuuguuccuguagauguaguugucaacaugagucuugcggcagccugguauuccggaguuaauagguauaugaggugacaaugucgcuuauuaaauauauaguaacugaaaagggaagacauagcuuuugaguaauguuaauuaaucccucuauccagauauugccauaccaauauuuaggcuguaucacugccaacuccaagaguugguauuaucacagacaauagcaagugcucccaucaguaguaaugaagaauuaauguuaaugcucauguauuacuuacaggauagacaaguucacuuaaaaaugaaaaaaaaaaaaauacccuccccuaagcaugauuuuuuaauccaaacuaaaacuuguugaauauauaaagagcugaaauucacagaauaugguuuacauauauuaaacaugguacaccagagcagcuuuaaucagcccaugaacaucuuuccuuuaaaaaauaauaguagcauuuacagguaacacuuaaacuuuaaacuucccaauaacuuuuuuuuucuagguaguaaacuacccuuauuuuugauaaucaguauuuucuguccuaaaaaaagagagauaggauuauaugaauauguuguuucuggcaaaaggaaacuuaguccauaauuuuuuuucagcuagauccucugaaaaugagacaagaagagcugaggucauuuguuguuuuccucguguuuaaaaauagacauuccugcuaauauaaggaggaaaaaugugaaagaaaaaagucuguauuuuuuaaaauaaguuauuauuuuugguaggggaagaagaaaggguaguuguaaauagucauuaaaguaaaaacuaauccuuuaaggauaauuaaaaaaaaauaguauagaaaaggugcccaucauccucaugucuucuugaauacuauguaggacuuagauuggauauguuuggccucuuauuaugauuaauugguuucaucuuugucuuugcagaccaagaaacaucaugguguauaauuguacaacaggcagcacuaauccuuuccacuggggugaaguugguaugauuuuaccuguguuuuugaauguuagaauaaaucuuaaagaaccaaguucccugaaguuuuaauguuagaauaccuaugaggcauuaaggccacugaguuaccaauuuguucuuaauugucgucuuagaaguauuaucuaccaauacuaccuugugguccuuaauaauguuucacaaauuuaaaaauauacugcugucuauucuuacccacccacccuacccuugucuaagccuugcuguuuuucuccugccaucugcaguagcccucguagauaccuauggcaugggaacagugcuuuuuuucucccuugugagcacccucagucuugauguugccuauccauaggcaguaucacuucuuacaagaggugguauaucaagugguacccagaguaauaaaugaaggaguuaggaaguaggauacaguuugccagaauauuuucuauuaaccuguauuaaucuauuuaaauucacagauucacagcagauauacauguuccuaguucuauaggaauagcauaacuuaaauaggaauaguuaaaacccauugaaauugagucaauuuuaaauuguugguugaugaguucaaauuuaaaguaaaauuuuuuuggcauugauuuagugauaggucuuauuuaaccucuaauugauuaauuaccccugcagaacaauuuugauuucaauguagauuuuuuaugacauuuguccuaggauuuuucuguggcauuuuuauuucaguguaaaauugaccauuagagcauauaagaaaaagauaaaaucuaaggugauuuuaacuuuaugauaauuauuuucaguauucuuuuaagaauauuuaaacauuuuuaaugaguuagguuuuuuuguaaucuuuuauuguguuauaaaguuuaguaaaagcugaaauugagcguuauauuuuagugacuaucucaauauacauuucuaguaaaguauuaauauagaugauacuagguuugauuauguugacauuacauagccuauauaaauuacaacagaaguuaauuuuggguuguuuuaagccuguuaauguauguuaauuugagcaucuuaagcaaaggaugauuauuuuccuuuucuuuuuuaaguaaguacaguaauaagagucuggaaagaggaacagaaaggaagaagcuaucgugagaggugaaauauagaaagugacacuguaaacugacauagguaaaacauuaaaaggauuuuaagagugaauuuuagcaaaaauucauucaucuaaaauucauaaauagcggcaguuacaaaaccacuugaguuuagcagucuaauaaccauauucucuuagcuacuagagaguagaaaaguuuguuuuuuaaauguacgaacucugacaucuuugguaaaauauuuugcauuauaaaaacaugauuuuuuuuuuucaaaacuucauuacaugguuauuaucaaagcuguuacacaacuuuucuucuucagaguaccauguaauuuccacuuucaagaggaauccucucgaacaggccuucagacggcccaauguaaaucuaaccuccaaucaucuuuuauaucauuacuggauugcuguaagccauaaggccccagcauuccuguaugauaucuaccucaggaugacuggaagaagcccaagguaauggugacuagcucugucuuaucuguuccucuguuaaacaacccaugcuuacacuaaaaugcauauuaacucuguauuuguuuaugcuuaugauaaggcuuaauagccuuuugugaaugagaagccucuugaauuuaagacuuugucagaaaagcaaagguaguguuguaagucacucuaauuuguuuaaaguuuggauaaguuauugucauguauugaauucuaagucuuacuuuaggcuucuuucugaauaacaauauuuaaauugcuuugacgcuuauuuuuccuacaggauauuauguaagucauuccuucaagaugaauccuuuaaaccaaguauucaggugccccaguuuuaaguuuaauuccaacagccuaucgcaucauuaucggaagggugucagccauagaguaucugcauuauugcucgauugcacucauguugacaggucagaaaccgcgguaagaagaauagcaguaaauacacuauguauugguaaggugguggcagcuugcuggagagaugaaaaaaaucacuagcaugagcuuuaccuuuagauuuacucaccugauuaaucacaaucagaaugcuaggacauuucuuagaauuuggagaucuuuggggacacuaacuauggaucacaucguauugggucguucauccuccaaaauuccauaauauaggaaauguccuacaucaugguugucauuguuauuauaagcugaaauuaagcccuucucucccucuuaaaaaccuagggaugaguuuguauaggggauuaagggcaaaaguuuugcuucaaauggauggugcaguuuuaugugaaaaauauaggaugcuucuagaaaauuacuugaaauaucucagcugcccauucagcuuauaauaugguuauuucaguuuuugacuaauuauccagguugggaauggcauaguuaugaaaaaaaaguuaauaauaaacagaaaacuuuguuuucuuaucguuguuauagcuuuucuuucuuuuuuuuguugaaaucccgcaaacuuaaagaucuccuacugucuuuaccacacaauuacaguggaauauacuauuaaaauacuuaauuuuuuuuaacuacauuggcauuacaguggagucguugauuggagaguucaggauuugaguauuuuuguauaaagaagaugcugaucccagaacuuccaucaacuacucaaaaaauaaaagugagguaacugccaguuacaguguaucaggaucugaguuccucguagguauugucuguggauucacuuuuccaugauguuucuaacccuauauguuagcuaauugaaauaugugagagguguugaacaacuuuagagcagguaaagaaauauuuucagacuuuucuagaaugaucugcaaaaugcaauacuugccauuggaagcauucuucauggcuaaaaugcagauguaaauucaugaaugguggcagugcaugcuuucuuuauauuaauaagguuguuauaauuuaggacagaaaaguaaaaacugggucaaaaaaaaaacagguuaaauacaucacauugccuuacacgaagaaagagggcuuaguaaaauuuuaaaaaaauaagugaauagcugguuuacuaaaugcuucagaggagauguugcugcauaacaaaucaucucaaacuuagaagcuaaaaacagcaacaguuauuuuauuauuucuuucaauuauuucugucaggaucaagaauuugagaaagaauccacugggcaguuuuggcuuggagucuuucauguguuugugaucagaugaaagaggccggugggcagagaggcaauggaacagcaaggggacugauguuacucuuugucgugucauaaggaucucuccauauagcucuuugcaaggauuaaugauagccuuaggggaauuagacuucuuauauagcagcugauggcuucaagggggaagucuuuuagcaaguaagguggaggcugcguugccuuuucugagcuacccauggaagucaugcagcaucacuuuugccucauucuucuaguuacaagugagucacaaaucuucuuaaauuuuuuuucauauguucauaauuuuauuuuggugccugacauagcacauuuuuuaaaaauacuucaaguucuaggguacgugugcacaacgugcagauuuguuacauauguauacuugugccauguuggugugcugcacccauuaacuugucauuuacauuagguauuucuccuaaugguaucccuccccccuccccccaccccacgacaggcccccagugugugauauuccccacccuguguccaaguaaggggauuuagaaaguggucaagaugaaggguauuguugccaucauuuuuggaaaguacaaucugcuauagucaaccuucuggccaaaacaauucauauuucuucuacauggaaaggacaguugcuucuuccccacucauccugccuucccccucgcgccuccccauccccaccaccgccccagaucccuguggcaucagcuggaagccaggguuuugucaucuaaaucuggucaauuggcggaugacgcucuuuaggagugauuuugucagcauagcuccucaaguauaguuccucaauaauugauaugugaacuaaagcaacgaguuacugacugcccauacgcccaucauaaaugaugguaagcauaggauaauggcuuuagacaguuuuauucaaaaagagagaaauugggaggcacccagcaaacacuggucuauaacauuucugaauuccagucagauauguguugaugauuucuugauaaggagcucagucuuauucucugggaguucucugagguucuugccucugcccucugagucauccuuccuuuugcauaaaaacuggccugugggcucugugugcagccaaguagccuucuuauccugcuucgugcccaugaaagguuaggggaucagggcaggaacuggaaagcuuuucuuguaaauuaaggccauauaguaaauauuuuagguuuagcaggacaugcgguuuuuguugaagcuacucaucuuugcuguuaaaaaugaaagcagccauagacaauaggcaaaugaaugaauaugacugugucccaguaaaacuuuauuuacaaaaacagguggugggcuggauuugguauauaggcucugguuugcugacccuugauauagcagucucuucauuuuuuuuuucuugucuaucccuuuacauguaaucugacaugauugcuuaaaaauugugugaguuuccgguguaucuguuuucaaggaauccagccuauuagacgaaagccauacccauaaguuucuuugacacaaacccuucucuaucuuggguccccugugagguuccuaugggacagcacuuuuagaucuuaaauccuugccucuuagauccugccuuuugaacaauaagaguuucuguuacacauuucuuuaagaucuggagagugccuuuugucugucugaaaguucuggaaggcacugccuaggucuuucuaaagucuuagcaaaggauucaucuuccccuacccugcuaugcucagaaacuguuucuuaaagaauuccuggcugacauuuuacauuuccuccaaauuccacucaaauaguucauuuuuuuaagaucaucuuuguccucuuuugcccucuuucagcaaauuucugcuagaucauugaguuuauuaguacacuuucuauauuccauauaaccagaggugacaguuuguuguccucacuucaagcccucaccaacagcuuucuuaaaacccuuuaaggcuuccauuaauaauguuuuccugguccuuucacauuucacuacugaucaccucacaggccuuagagauuuuguuuaccacuugacccugaagccaauaccacauguuuuagguuuuuauuauagcagccccucccaguguugagaucuguguugagauuuguuaaucuguuuuacauaacaagucaccucaaacuuagugucuuaaagcaaucauuuuauuugugugucacaauaucugugggucaggaauucuagaaggguuagcuugaugguaauggcucaggaucuuucaaaugauuguagucagacagggacuggaggaacuuugcuguggagggagugguaaaggggggaaggggacagaguagcugggguggcugggcaucucucucucuccaguagugucauacccucuccauguggccucuccauauggacuaguuugagcuuccucgcaguauggcagccucagggggaguuggacagcauacacagugacugaaggcuucaagggugaguauucagugagcaagacagaaagcucuacaccuuucugaccuagccucggaagucacaucaugucacuuccaccucauucuguugguucuaaguuauuuucaacucucauugagaagacagucaaggugacauuguauuguaggugggcauguaggauggagauaauaucauaggcaccuuuggaaauuaauaucuuuccuaaauaggaaacguuaaggaaacagucuucuuaacugagguuugugcugugugaggcuuucuaaguaucaaagcaggacagauccuugaccuccgggagcuuauaaucugaaugcaacaaggaauauaaagguuuuuuuacuuagacaauuuuguaaauguuaaauacaaagucuuauaauuuauaauauuucauuuguucagaaauuuauugagcacaguaauagacuuuacaccuuauauuggggccuuacuaugaugccuaauucuacauuaaacugaugucagucaugucauucauuucauccaguuuacuuguuuacauaauaauucugaaugugagcuagauaagcaucugaccugacauuuuuuaaaaaauggcuccaugaucuuauguuuugguuaacuagcauaacuuuaucuagcuuaacuucucuaaaccagguaucuauuuuuaaucuguguacuucucagcuggagacauuugacaacauuugcagguauuuuuaguuaucacaacagggggagggcugcuaccagcaccuagaggccagggauggugacaagcaucuuauagcaugcaagauagcccuccacacgaaagaaugaucagacccacaauauuuauagugccaagguugagaaacccuggacuagauaaucauuaagaucuugccuuacucuaaaggauugugauuauuuuuuuaaguugccauaauaaagaauaaauacauauucagaacauaccuggcaauguagucauaaacaucuguucuaagguauguuuaaccaaggagugauggugcaaaguuuuacauuucuuauuccccaauaguuuucaauccaguauuuuuguugcaugauaaauauucuauaaauuucacacacaaauauauggccuuucaaauuucuucccccuccccgauuuuuuauugcaauuauuuuuugaauggcugaauuacugauugauguuagggugauugugucacuugaaugaaucugaagauaagauuaggugagagaauuaucagugaacaagaguuaagaaaaacuuuuuaauaagguauauauaggaaaaccguguuagcugugugugugugugagauuuaaguaugcuaaacuggcgugauaguauauauugauguagugacaaacuuguuguaucuuuuuguuuagaaaaaaauaaucaccuaaucuuuucuaagagcagcauguguuuuucccccagaugcuuuuuaucuacagaacuaucccuguccagaaauugccuuagaugcuugauaauucguuuuguguuugagauuuuauuuugaaguuacuuuauuggaugaaauauaguuuuuuuuuacauaguuuauauugcuucauuuucuuccaguauucuggauucagaguuuauuucuaaauguauugaauuguguuaucagaagugcuuagcuaaugauacuuuuuugauuuuuuucuccuuauuucuaauguaauuucccuccaugccccucccauuucuaaaaccccuaauuuugagacugucuaaacuacaugauacauauaauccuaaucguuauuauaauauaaaugaaaucuuuaaaaaguacuucuccaaaaauucuuuuucuguucacagaaguggggauuuuuuugguguuuguuuuguuucagaaaguucuuucuucccuuucccuacuuauaauaaauauuauuguauagauguuacugcucaaguuaguguuaugauaucaaugacuuacagugagccaugauauauaaaaugacagauuuaaagauuaaagcuccuuguacuuuuaaaaacaaagaaucacagucuuucuuuaaagacacacuuuaaaaagagugucacacuccuuuauuucuguaaggaugaguauuggugggguauggagaggugaguggauaucuauuucagauaguuuucagcaugagucauugauuucacagcacauccagaugaucaagaguggugccaaucauuguuaaagaaaaguuguuuuguuuuuuuaaaugaauagaguugacuauguggcaaacgaauauuucuguauuguuugcuucagcagugcugaagaguuggaauuauaaauauaacacaguauguuauuaauucacaggaaaucuuagcaaaugcagcugugaauuaaaauguaguuuaaggaauagaaagcaaggaaauauuaauugaauccauucauuugcuuaguauuuuauguagaaaauuuaagaguauuguauacccuuugagaauuaauucuguauaucagcagaacucuguuuaggugguauuaaaugcauuugcugcugcuuucaaaaaaaauuuguuuuccuuuuggauuuauaaauuguucauccaagaugcagaaauagucuuauucccugcugauuugguacacuuaaugauuaaauguuauaauuuuaauacuaaugucuauauuauagggggaaacuugcacccuggguggugauaggauuuuuccuaaucuauacaaaauaugaaucuguccauuuuucuuacaauacaggaugaugaaaacaauaacucgucuucacaaagcuaugguguuucuugaauauuucacaaguaauucuuggguuuggaauacugagaaugucaauauguuaaugaaucaacuaaacccugaagauaaaaaggcaagcaaguauuuucuguuuuauauuagaaaauaaguagcauacuaauuacagaacuauuagcaaccugagaaauauuuuccacagcuauuaugcaacaaguaagccauuauuuauagucucucauaaagcuuuagucauaauuguuaguggugaaauaaaauugcuguaucuuaacauuucuaguguaaguauuuuagaguggcaaagguauuuucaaagcaugauugaaauguugauucuuuuuuucccuuaauguugguuucagagagaauuuuaucuuuauguguuuuucuuucaaacacuuuguuuucucuugaguuuugagaaaaagcuucucuaagaaauuguuuuuuauaaacucuuuuacuuuuuguuauuccacauuuugcccuuuguuacuuuggaacuuaaauucuuuguguauguucuuuuugagcuuacucuagauguuuuaacauguauaucuaacacagacuaaguuaagcaauauuuauagccuccuucuuaauaauaauaauauuuagaaccuuaaaauguuuuaguugugauuaccacucccacucacuuaaaaugguuguauuaauacauuacuucaguucucuaauuuuuuuuuucuuuuucuuuuuuuuugagauagaguuucguucugugcccaggcuggagugcaauggcacaaucuuggcucacugcaaccucugccucccggguucaagcgauucuccugccucagccucccaaguagcugggauuacaggcacauaccaccacacccagcuaauuuuuguauuuuuaguagagacgggguuucaccauguuagccaagcugcuggucuggaacuccugaccucaggugaucugcccaccucagccuccccaagugcugggauuacaggcgugagccaucacacccggcacaguucucuauuuaaaccccauguugagauacucuuuuguucauuuaguuuuuauuuagauuucucccucucucucucucucuauauauauauauauauauaaaauauguauauauguauaccaauaucugugcuuucagauuuucuccuuaugaucuucuuucugccugaaauauauucagcauaccuagaauauguuuuacuugggaaucuguuuuguagugaauucugaguuuuugauugucugauauguguguuguuucacccuugguuuuggaacaugauuucagcacguuaaagaacuuuuuugcuggucauaguagcucaugccuguaucccaauacuuuggaggcugagguggaagaauggcucgaggccaggaguucaagaccagccugggcaauguagcgagacccaucuccacaaaaauaagaaaaaaucagacaggcauggugacaugugccuguaguccuagcuacucaggaggcugaggugggaggaucaguugagcccgggaggucaaggcugcagugagaugugaucacgucauugcacuccagcuugaacaauagagugagagucucucaaaaaaaaaaaaaaaaaaaaaccccaaaaaaaaacuuuuuuauuuauauucugucuuacauuuuugcuguugaaaagucgguaguuggcucuuccuuuauaggugauauguuauuccuggcucgucuuccauuuucucuuuauguuugccgcuuggcaguaucacuaugauaguggguguaauuuugaaaaauuuaccuagauugcauugggcuuucugaaucugagguuuggugucuuuaagcaauucagagaaauacuuagccaguguuucuucaaauauugccucuucacuauucuuauaucgucuuccaaaauuccuaguguauguuagauuauucuguucuccaaaucuuuuaacguuaauuucauauuuuguaucucaguguuucugggcuaaacucuagauaauuuaagauucugugacagucugccagcugugucuaaacuauccaauugaauuuagaguuuuauuguuuuauuuucaguuuuagaaaguauaauuuuucagaucuuauaaauguuucuuaaacagucucuagaauuuuuucuugaaacauauuaaauauaauuguuuuucauucugcuucugauaauuuaaacuugcagaugauuugcagcaucugauucugccaucuauuacuugagcuaggucucacccauggcaccuaauuuuuuuaaaaaauauuuguuugacuauaaauuuauauucuuugaggauuucugugagaauuuuuuugaagccgggauugaaauugcaguuuucugauaaggauuugccuuugcuucuaccaguagccuaguuaauuagcuagcuggcauuuauaagccagggccccuuuaaaauaucugauuagguuuuuagcacaacucagauuaauguaggccuuaaauagacaguaggggccgggcgugguggcucacaccuguaaucccagcacuuugggaggccagugcugggauaacuugagcucaggaguucgagaccagccugggcaacaaagugagacccucucucuacagaaaaaaaaaagaaaaauuagccaggcgugguggcgcaugccuguagucccaacuacuugggaggcugaggugggaggauggauugagccuaggaggcagagguugcagggagccgagauugugucacugcacuccagccugggugacagaacgagacuccgccucaaaaaaaaaaaaaaaaaaaagacuguagauuugggucauuacaguuucucaagaguuucuuuuuucauccagugccagcuuccuuucucuucccacuuacuuuuuuuauuuucauaauguuuuauuuaaccuaacauauaaucaaaaauauuguuugaacauaucaaaaaccuaaaaauuauuuaaaggauauuacuuucuguuuuuucauacugagccuucaaaacccagagugcauuuuauacuccacugcaugucucaguuuggacuagccauauuaaaagugcccaagaggcacagguggguacagaaacagaagccuguacugccugcagaaccaugagccaguuaaaccuuuuuaucuuuacaaauuacccauucucagguaguucuuuguaggguugcgagaauggacuaaugcaccuaaucacuaccuccucugucuucccagagggaacaacucuugaauucuagcacucaauauuaguuuuaccuauuuuugacuuuauauaaaugguauuauacaguauuuuuucauucuucuguugauagacauuugaguuauuuccaguuucuggcuauuaggaauaauuauccuaugaacauucuuuaugucuauauguacacauuuguguaggguauauaccuagaaauaggauagcauagggcauucauauguucaguuuagcagguaauggcaguuuuccaaagugguuguaucaguuuacauuccagagggcaguguaugagaguuccuguuaauccacauccuccauaacacuuggccuuuuaauuuugauuuucaauuuuagccacuuaggugauauauagugguauaacaaaaugauuuuaguauacauuaccuaguacauaaaauguuuauuuaaaaauaguaaaaaaaaaaaaaaaaguaauccuauuggaaaauagauuagagagaugaacaguuuacagaaaaugauucccaaguauuugaaaagauacucagcuuuacucaguggaaaugcagacuaaaguuagacugggauauuauuuacuauuuaucaaauuuacaaaaaugcagacuuggacaauguacucuagugaguuccuggacaaaucagcauccuuacacauugcugguagaacuauaugguguauguuucuccauucuuuuauuuucagucauuuuguaucuuaucuuuuagauaugucuuuuguaagcagcauauaguuaguuguaagcagcauauagcuguuaguuuuuauuuucagucugacaauuuuugaccuuuaauuggagaacuuaaccccuauguaauuccuaucauuuuagauuuagucugacuaguagugcuuuguauuugucacucugguuuuaaguucuuuuuucuuuuuuuuuuggccgcccuuuagauuauguuuugaauaauuuaauauuuucccaucuauauguguuacauagaauuauguuccuuuuugguuuaguagguuacucuagagauuacaauguccuuuaauuuagcaaggucuaauauaaauugauacuuuuauccuucucugauagugaaggaucagcauguaucuguuauuguuguuauuagguuggugcaaaaguaauugugguuuuggccauaaugcauguuuuaauucuauauauauauuaagccacacaagccaguauuuuuauugcagcuuaugcaauaaauauucauacagauuuaccagcguaacuguccuuuuauugcucuuuauuucuuccuccauccccagacau

SEQ ID NO: 15362 - RNA, 1287 nt, Homo sapiens
aauaaauguauugccccugcuuucucuagauucauggaguaacauguccagauuuucucaaauccaucuccccauacaccuccgucaauccugacauuuggcaauaaugccaagcaggaaaagaagcuuuucccaagguaugugaguaaaaccuguacuacaauaaaaauuauauuaacuauucagguucccucugucuuuuuuuuuuuuuuuuuuuuuuuugagacggagucucgcucugucgcccaggccggacugcggacugcaguggcgcaaucucggcucagugcaagcuccacuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucagccucccaaagugcugggauuacaggcgugagccaccgcgcccggccgguucccucugucuucuaagagcacagauaacugcaaguuuaccauacaugauggagaauuucugcuacuuccccuguaaaauauuuucaaaauaucuuacucacucaacugauaaaaggugauaaaccuaccuaaaagacuuuuggugaagagaaguaaguaucaguuguauuuuucagagcgcagaaaaguugugugaucaaaacaacaaaaauaagauuauaauuccaguuuacugauggacucgaaaaacauauacguuauaaaacaacuaaacaacucaacuguagcuauguuacauguuuaaaaugaacuaaucauuguaaaaauguuuaaagaaugggaaugauagcagaagaaaaaugucaccaugagagaguauaaagauggguuaaagguuuucuuccugcaaaacucaauuuguuuauuaaguuguagcacugcccacccaccgcaccccacaaaaaaagccacauucauuugaggucacuuuaccuccugcuauuuccuuugcagugagucugcaaaguucuaaugcacggugcugauuuuauucauugaacagaaagcaauugagugaaacauacaagcaacuaaaccuuuggcauccugugaaaccacaagagagcaagauauuuuuucccagguucuaacaucuuuuuaaagcuguuuuuucaaauagcaguaugccuagaaugacugcaugcuugucuagagucaugugcucaguaccaaaagccagaucaauugacucugagacgggaaaguaaucaaga

SEQ ID NO: 15363 - RNA, 2742 nt, Homo sapiens
cagugcuuacuugugccaggguauaacugugagugcuuuuuccaugacauuuacaguguucacaaugauccucuaaggcaaauacuguuaauaccaucauuuaaggaugacgauuacagucuuacaacagguuaagucacuuauucaagguuuaauaguaagagacaaacucagauauaaagccagguaucugacacuaaagcccuuguaacuagucacacauugccaccacagccuaauaaauuguaccucaguuuccucauuuguaaggugcuuuuaagguguauuucacagaggugauaugaacaugaaaugauacuuauuaugaauauuuaacacacaguagaugcucaucaguauguauucauuccauuuuuucccacauugaccuuccuuaccuuucagaggagacugaacccuguucccauuaucuuuauacuucccucagaauuuaggucuucauuuuacacuguaaaauguacguuuuacacaguaacuuacuuaaaagaaucuucaugucuugagaauuauucaauugagguaucauuggcccuugacucuguaacuauuuguuguguaguuuuuuuuguuuuuguuuuguuuuguuuuguuuuguuuuuugagacggaguuucacucuguugcccaggcuggagugcaauggcacgaucucagcucaccgcaaccuccgccucguggguucaagcgauucuccuaccucagccucccgaguagcuggaagaacagaugccugccaccauaccuagcuaauuuuugcauuuuuaguagagaugggguuucuccacauuggucaggcuggucucgaacuccugaccugaggugauccaccaccucagccucccaaagugcuggguuuacaggugugagccaccgcacccagccuguuguguaguuuuuuuaauaagcucuuggcacuuuugccuaucaacuauuguuagcuaaacguaauugucauaacccauguuccucaugugauagaucaucuauggugaacauacuggcuuuguuugcuuucagaaugacaaucagaugacugguucuuuaaaauugagcccagagauaugugcagccagguuacaauaacagugugauguuuagggguugcucacugugaucaaaagucacuucuaauaaucugaccacuuccucuuuuauuuucuccaucuagcaauggcagaaucucugagaagucagucaugcagugacaaaagaaugcaagugggauuugugucuuuuaucugggcucuguauauaauuauaggauucugagaaaacuuugcguuguauguauuuuggaauaauuguauguggaauaauuguauuaguuaggguccucuagagggacagacuaauaggauauauauauaaaggggaguuuauaaaguauuaacucacacgauuacaaggucccacaauaggcugucugcaagcugaggagcaaggaaagccagucugagucccaaaacugaagaacuugggagucugauguucgaaggcaggaagagucuagcacuggagaaagauauaggcugggaggcuaggccaguccaguccagucuuuucuuuucuuuuuuugagauggaguuuugcucuuguugcccaggcuggcgugccauugcaugaucucggcucacugcaaccuuugccucccagguucaaaugauucucuugccucagccucuggaguagcugagauuacaggcgccugccaccaagcccagcuaauuuuuuuguauuuccaguagagaugggguuucaccauguuggccaggcuggucucgaacuccugacaucaggugauccaccugccucagccucccaaagugcugagauuacaggcgugagccaccgcgccuggccucagucuagucuuuucacguucuucugacugcuuuauauucuagccacacuggcaucugauuagauggugcccacccagauuaagagugggucugccuuucccagcccacuaacucaaauguuaaucuccuuuggcaacacccucacagacacacccaggaucaauacuuugcauccuucaaucaaauugacacucaauauuaaccaucacaauuguaaaaccaacaaaauaaacaaaugaaaugcagcauguuggacugaaagaguccugaaugaauuuuucuaaaucuauucucaauucacuaaguagcuuugugaaaacagacagaugucacugggccuauguucuuaucuguaaaaugaaacaauucagcuagcugacuuucuggguuucuggcuuaaaaaucuauacuaaaaagccuuauguuuuauuuuuguuuuuuauguuuuuaaaaauauccuuauuuuauuuuauuguuuauuuuauccauaaacaaggagcaggaaagccuuguguuuuuauagcuaccucuucaacaagcucuguaaaucaacugggauaucucuaccuggauguuaccaaugggcacaucaaaaugaaauggaauuuaucuuguuccccuaacuugcuccucuacuguguucucugguaauuuaugcuagaaacccaguagucaucuuuaacucuacccucacaccuauaucucaucagacaccaagacucauuuuuuucccuuccucaauauuuuucuaaucuucuuuccccacuccacugccauuguccugguuuagacucucgucguccuuaacguggucuccuacaguagccuaaccauaaacuucacauauaauuuuaaaauua

SEQ ID NO: 15364 - RNA, 15689 nt, Homo sapiens
cgcuacccugcgccgccgccgucaaacucccgcagacuucucuguagaucgcugagcgauacuuucggcagcaccuccuugauucucaguuuugcuggaggccgcaaccaggcccgcgccgccaccaugguacguugaaucccgaucucuggaagguuuagggcagagcucuggugacugggggaugacgagccaccucuccugucauccuuagcgucgcccggugccacgagguaugagagccucggcagacggccgggcuccggcagugauucagcaucuccggccuggccgggcuagggguuaucgguagccagugcggccuuuccaccgcuuucgcuucccggggagccuccgacacuuccuccucggucagcuagaugaguucgccccucagguuccuucaguggaguagauucugagcgguccagaauagcuccuagugcuguguaugggagaggagaagacagagacuugacuuggaggccuaccuguaccaccagugcggacuugacccccagguuuguguuccuggacagcguccguuuuccugguggguccgucuauuuaucucucgccuagacuucgauuagaagaggcccuuuucaaucauuuuguccagucaccuaguugcggaugaguaagccgaggcugagaggggaagugauggaaucaggguuacaauauaggguucuggguuuccaguucugucugccauucuagcacucaaucucacucccaugacuauuauuauaauagucguaauagccguaaugguucuaucgcugcagcuauuuguguccaccucuaacuuugugaggacauuuuuguucauucaaugugaauauacagacagcacuuguacaggcauaacuacagugaacauuaaaaaauaagucauacaugucccuaaucauaaaaacagaaagggacguuuagauaaagagcugugggaguauauguuagggggauuugggaagaaaaggagaagacuucaagaaaucgacauuuaagcuaccuuaaagaaaaggaagacuuuuaaccauuuauuagggcccaauaaaagggagcagcauaagcaaaaauaggcaagaaaguugauugugaacuuuaguaauugagccuaaagggguugauauggaggguguuagaauaagaguuuggaaaaauaggacccauuuagaucugcuucucccucucccacgaguuuaugguaaauguagaauuggcuuacaucugaguacaguaguaaucuuccaguaagacugcaugaacagagugccuuaacauugaauggaaauacaagcauauuucuuaaugaauguuaagaguugggauuugaaauguucuucuauuaacagguauuuuuuucuuuuacuuuuaguuucgaaaucaguaugacaaugaugucacuguuuggagcccccagguaaaauaauguuuuuaaaccuuuucugugaaguggcuuuuuguggcugcaauauauuuagaaacuugugagagcguaggcuuggggaaaauggaauauaauuauuuuagacguucuuggaaguugcauuuauaauuaaaauagguuuccugauggaccuagaggacauuauguuaagugaaauaagccagaaacagaaagaaaaauguuucaugcucucacuuauauguggaaucuuuuguuuaaaagggcaaauauauauauagagagaguaaaacagugguuaccaggguaggggguggcaguggggaggaaaaaagaggagauacaaaguagcaaauauguagguugagcaaguggaaagaucuaauguacaacaugaagacuacaguuaauaaugcagguaguguuuuguauucaagauuuuuguuaaaugaguaguuuauagcccuugccacagcagaggaaaauggguaacuaugugagacaacggauguguucauucugcgauagugacccuacuauauauguguaucuuauaacaucauguugcauacguuaaauauacacaagaaaauuuauuuuaaaagaagcuuucagccgggugcaguggcucaugccuguaaucccagcacuuugggaggccaaggaagguagauugcuugagucuuggaguucaagaccacccugaacaacaugaaacccggacucuacaagaaauacaaaaauuagcugggcgugguggugcuugccuauagucccagcuacuguggacagugaggugagaggacugcuugagccuaggaggcagagguuguacugagcugaagauugugccacugcacuccagccugggugacagagugagaaccugucucaaaaaaaaaaaaaggucucuugauuaaaaaaaaaaucaguugagauuuaacugugcucaccugauauuugaaaacccuaauuuuuaauuuauaaaagaucuucuaagauguguguuuuuuguuuuuuuuuucuuuagggcaggauucaucaaauugaauaugcaauggaagcuguuaaacaagguucagccacaguuggucugaaaucaaaaacucaugcaguuuugguugcauugaaaguaaguacaguaauaaauaugucuuccucuguagaaaacaauguaaauuucaccauagaaaauaagguuguaaacuuauuuuuacauuugucucuuuuuuuuuuuuuuuuacaucuuauaaugucucuauuuagagggcgcaaucagagcuugcagcucaucagaaaaaaauucuccauguugacaaccauauugguaucucaauugcggggcuuacugcugaugcuagacuguuaugguaaguauaaucaugaaaaauaaacauccuuuuuguuucauaauugauuaguuuucucaaaaagauccagauaagguauuuuaggaaguugucugccaaaguucuuguaaauuaagauuaugaauaccuuggugguuuugaguuuguuauuaaauuuuccauuuuuugaucccuguaggaguaacuaauaagauuaaacauuagcacuuuucagaagucacugaguaaugugauguuuguuaauacaauguauaucguuugagacccuguuaugucuaagaagaacgugauacuuuugucugguuucuaaggacaagcugaaccacacuuguuuucuuugugcuuguuuucuucaauacaucaguauuuauuagacauuuauuuuuugcaaugcucaauacuggauacugcaggguauacauaagugacucagacauggaucuugucuuaagggaacuugaaggcaaguuuaucuauaaacucaaauguaguuuaucuauaauauaacagaaaaauuucugugagagucuagaagagacagauuauuuaugguuaaaaggcaauacauaaaugaagagauagggcuuugaaauugcacauauugaguucucaccuucaccacuuaguaucugagauuuggcuaaauaccuaaacacugaauuuuuuccaguguuuucuuuaucaaggcuauuuuuaaauguuauuuauuuauuuuuuugagauggagucucacucucacccaggcuggagugcaguggugugaucucagcucacugcaaccucuaccucccagguucaagcgauucuccugccucagccucccgaguagcugggauuacaggcacccgccaccacgccuggcuaauuuuuguauuuuuaguagagacgggguuucgccauguuggccaggcuagucuugaacuccugaccucagguaaucugcccaccucagccucccaaagugcugggauuauaggugugagccacugcacccagccuauuuuuaaauauuuuaaauugccuacuguaaaccacuaacacagagccuuucagguauuaugugaguauguguguuguggauggcagguaguuagcuaaaacuaaucuuguaaauuugugauuugauuaggaaagaaagaauauaaauuauaagggugggccuggcacaguggcuccuaccuauaauucuagcucuuugagaagcuuaaggucaagaauuugagaccagggcaacauagugaauccccaucucuacaaaaaauuuuaaaacuuagcugggugugguggcacacaccuguuguccuagcuacucaaaaggcugaggugggaggauugcuugagccuaggauuucaagguugcagugagcuaugauagugccacuguacucuagcguaggcaacagagugagacccuauucuuuuuuuuuuuuuugagacggagucucgcgcugucgcccaggcuagagugcagugguaugaucucggcucacugcaaccuccgccuccagaguucaaggaauucuucugccucagccucccgaguagcugggacuacaagcaugugccaccacacccggcuaauuuuugcauuuuuaguagagacgagguuucaccauauuggccaggcuggucuagagcuccugaccucgugauccaccugccucggccucccaaagugcugggauuacaggcgugagccacagcaccuagccgagugagacccuauucuuaaaacaacagcagcagcaaaaacaguguaaauaguaaugcuaugguuuaagaauuucaggcugagcauggugucucaugccuguaaucccagcacucugggaggcugaagcggguggaucaccugagguccggaguucaagaccagccuggccaacauggugaaacccugucucuacuaaaaauaaaaaaauuagcugaacgugguggcaggcaccuguaaucccagcuacuugggaggcugaggcaagagaaucgcuugaacccaggaggcagagguugcagugagcugagaucaugccauugcacuccagccugggcaacaagagcgaaacucaguauuaaaaaaaaaaaaaaagaauuucaauuuacucagccagucccuugcucuaagucagcaauauaaugacagccuuaaggguuuccaccuacucuucaaaauggaaaauguauuauauuaucaaacauuuuauuuaacccaaucuauaaaauauugccaugccaacacauaaucaauauaaaaacuuuauuaaugaguuauugcacguuuuuagguacuaagucuuugaaauuugguauguuauuuuguacuugguguacaucucaauucagucuagcuacuuuucaagagcuccauagccacaugugauuauugccugccauauugggcaguauacuuuuaggcagcauugggaaauggacuuaaauauaaguacugaacaaauagcuugguuccuguagucaaccaugugaugaucagaugugacauacgcauauacuggacaaagcaacauugagaaaaaggagcauauccauuucuuguuuaucuuauuuauaggcauaaauucucuucuccccaauguuaaccuugcuugaauuucaucagauuuaacagugagacucagcggcuaguguccaguaucuccucuagagugcuucuuaugaauagaaguaacaguggcagaaacacguaaagauccccccugcuguguuuuccauuucuuauauuugcucuuuuggagaaauguuagucugcuuucaagaaaaaaggacagaguagauaaucuuuuugcugguucgagaucuagaauuacgacaagcuugcugacagugggaaggauaagagaagagagguugcuguuuuucuuuuguucagccuucucuucucuguuccauaagugcucugauacaaagauuuucuagagcuaaaaaauguuucagucuuuuuuaaaaaccuuauguggcuccagaguuuagcacaaaaacgcacccuugcaggcaugucuuucuuaccuucuguuuuucuuauauggauguuauccauguaaacgcuuggaagaauuugaagugaaaucaaacaauuuagauuggaauaguugucuauaauuugaaauuacuaaacuuuuuuuguuucuuuuuuaguaauuuuaugcgucaggaguguuuggauuccagauuuguauucgauagaccacugccugugucucgucuuguaucucuaauuggaagcaguauccuuuuuauguuagcauuuauggauaugaacuuugaaggguuuugauacuuguguuaauuauuaggaauauaauaauaauaugacauagguaagauugugaaaacuuuaaaacaacaaauuggauugcucuuucauuagccuuuauaagcaauuuauauuugcuagacacaaauaagcccaacuucaggaaaaucaucuaagcaucuuuuuagaggggauuuaaaguuucuuaaugguucuagaugucccaagaaauccuagaccccuuguauccaaaacaaaucagguuuuagaugggaagaaauuauuuugcuggcacucuuucuuagguucgguagaaagucaaacauuuuauauuaggccaaagaaauaguguccuauugcauuauuucucugguggauuaugcaacaauuaaagaauaagccagagaccuuuguuaauaauguauaauuugaaaauaaagacaguacuucauuccuuguuaaaacaagcucguuaaccagucuaagagacccagauaccaacacaacgauauggccggagaccauaugguguuggucuccuuauugcugguuaugauguaaguucauugaauauuguuauauguuaaugauuuuuuuuaauuaacuagaaauuuuuauaauuuuuaguucaaccaaaguaaauaauuaugugguguauuuauuucuauuuguaggauaugggcccucacauuuuccaaaccuguccaucugcuaacuauuuugacugcagagccauguccauuggagcccguucccaaucagcucguacuuacuuggagagacauaugucugaauuuauggaguguaagugacagccuugcuuuuuuuuuuuuuuuuuuuugccuuuuccagucuauauaguaaauaaacauaguauccuaaaugcauaaaacuguaagucuuauagaaagaauuuuuuuaaaaaaaauuaugcccaugaagaguuuauuguuucugucacauauacuaaucuuaacuucugguuaccacaguaguuucaagcacgaguagaacuuuuucaaaauauaaauguguucccaaccuugaaaauucuugauucauuuggucagaagugugcccuguggaguggagaguggagaaccacuguacuaccugccaguuguaagcucuguucacuuuuaguuuucugugagucuuuuguuauuuuaagccacacagacauuucugcauuaguaguccauaaacaagaaauaaaaaggcaguguaguugagggagaagaagguaaaagagguaagauguuaugacaggacagguuuucaagugcuuugcuuugcauuggaaggaggguaucggguuuuacauuucucuuugucaucuuaucuguuuucuggugacaaagcauucuuuggaggaaauauuugggguuuagugaaugcagagaaaaauaguuuaauugacauuacucaaagcaaacuugugggaugacaauagguuuaacuuugggaaaagaggauuccuuggacaaauaagcuugguaaaugcuggcuuaaaguuuaacauuguaaauuaugguaaaugguuugggguccccaagguuaccccuaaauuuggagauaugcuaggacuuaaagcgcacagcauauaguuguacucccagguaagacuuuuaacaauaaaauaacaguacauagguggaucauuaaggaaaaauacaguccagaggaaucuaugugcaggcuuccuuaugcucuuuccuucccauaaggagucacagaguacacuugcagcaauauguaugugauguuucugcccagagaagcucauuagaaacucaguguccaaaguuugguucagaacugcucauaucagcacccucugccuagcacauuucaaccuggauaggaaauuccuaaagauugcaauaaaucuauagauaauuuuggggaguacugcuacuuugaugauacaaagcaucugauccaugaacauggaauaucuucauuuauuuagguauuuaauucuuuuuuuuuuuuuccugagacgggguuucacuguuuuugcccaggcuggagugcaauggcgcgaucucggcuuauugcaaccucugccucccagguucaagcaauucuccugccucagccuccugaguagcugggauugcaggcaugcgccaccacgccuggcuaauuuuguauuuuuaguagagacgggguuucuccauguuggucaggcuggucucaaacucccgaccucaggcgauccgcccaacugggccucccaaagugcugggauuacaggcgugagccaccacacccaaccagguauuuaauucuuucacugauguuuuguaguuuucaguguacaaaucauauuugucuuaaaguauuuuauuauuuuuggugcuguugugaacagaauuguuuucuuaauuucauugcauauuauucauugcaacuauauagaaauacaguugauuuuuauauaucaaucuuauauccugcaaucuugcugaacuuguuuauuaguucuagucauuuuuuuauagauuccuaagaucauguugucugggaauagagauaguuuuacuuucuccuuucuaacugccguggcuggaaccucugguacaaugaugaauauaaguugcaugaacaaaccuucuuuuuuuuguuccuaaacuuaagggaaaagguuuuagucauucacugcuaagauugauguuaccugucagcuuuuuguagaugcccucuaucagacugaagagguuccuuucaauuacuaguuuguuuuguguuuuuauuaugcaaacauuuuagguuuuaucacgugcuuuuuaugcaucucuuggggugguuaugcagguuuucucccuuccuucaguguaacugaaaauuacacugacuuucaguuguuaaacuaacuuauucuugggauaaaucucacuuguauaugguauauaauuuuuuuaauguguugccagguuccguuuguaguuuuuguugaggguuuuguuuuguuuuguuuuguuuuugcaucuauauugggucuguaguuuuauuuucuugugauguuuuuauucuuguuaucgguaauacuggccacauagaauaaguuggagauuccuuuuuacaaugagcaaauauaaggacuaggauucuacagaacacauucuacaaaacuuggaguuguauaauuuauagucgggauuuugauuugaccuagcaaaagagaagaucaaaaucguaacaaaaaucaugaguccucucauuaaauaaaauaagaaucagcaaugucauagaaugcuauuaaaagauuauaugacuagcauuaaacuuggcuguuuuuacugugauaaauuuaguguguaacuaaaaaccacaauuugagacuguagauuugauaaauaacagaagccuagcauaacaaugaaauuaagaaauaauuguuaauuuauuacauauagguaauuuaaaugaacuaguuaaacauggucugcgugccuuaagagagacgcuuccugcagaacaggaccugacuacaaagguaaguauugucuuuuccaauuguagauauuaacguuacaguuuaaaccuuuauugcauaaauguaauggaguauauaugcaacauucuguaauuugggauaugauugucuuggcagauucuuuuccuuuaagcuauuugcuaaguaauccaauuuuauuuuuuaaacauuucuuuuugguacaaagcaguaaaaccaguaaauuucaugcaaaauguccuucauuauuuucagcagauuggcauaucuugguauuauuuaguuaacaaaaauauauauauauugagcaccuaccaugugcaggcacuuucuaagcauugaaaauacaguaaacacaacaaauaacuuuuucuucauggaacguacauccuaguagggaaagauagacaguauauacauaaguacauuauauaguauauuagaagaagauaaaugcuauguaaaaaauaaaaaagcguuaaaaggagaaagaaugaccaauuggauguagguagguguaauuuaaaauaggugguugaggauauucucaccaagaaaaugaaauuugaggaaaagauauaaaggagguaagugaguaugagcuaugcagaucuagagcaaaauuauucuaggaaauacaaaugcaaaggcccuaguauuuaaggcaaggaggccaguaguguugaggucaaucaucgagaggaagaggaaaagggaagaaaucagagagguaauggaggucccauaagccauugugguuacucugcauuuuacucugggugggcuguuaagaguuugagcagaggaauaccaugauuugguuuagguuuuaaaacagucacucuguuuggcauuuuaacgacagauugaggcugggcgcgguggcucacgccuguaaucccagcacuuugggagaccaaggcagguggaucacgaggucaggagaucaagacuauccuggcuaacacggugaaaccccaucucuacuaaaaauacaaaaaauuagccgggcuugguggcaggcgccuguagucccagcuacucgggaggcugaggcaggagaauggcgugaaccugggagguggagcuugcagugagcugagauugcgccacugcacuccagccuguccagccugggcgacagagcgagacuccgucucaaaaaaaaaaaaaaaaaaacaaccgguuugugggccagccgcaguggcucacgccuguaaucccaacacuuugggaggcugaggugaguggaucacuugagaucaggaguucgagaccagccuggccaacacgaugaaacccugucucuauuaaaaauacaaaaaucagccgggcguggcggugcaugcacuccagccugggugacaaagcaaaacuccaucucaaaaaaaaaaaaaacagauuguagggguagauagauaguggggcuauggguagaaauaguuuuaaggcuauucagguaauuaugugagagaugauagugauugcagcagagugacagaguuaaagaugaagaguagugguucaauuuuggauaucuuuugaaauuacagccaaaaaaguuugcuaauagauuuguuauagggugugaggggggaaugucuccaagguuuugggccuaauuaauuggaaugaaagauuuaugauuuacugaggugaagaagauagugggaggaacagguuuuagaguaggcguuggggaggaaggucaggcagucaguugcggacauguaaaauuugaaaugccuuuuugucuaauugacgguacagaguaagcaguuauaagcaacacguggaguuccauggagagugguccaaccuacauuucaaauuuuugaagucuuuauauagaaauggcauuuagagucuggacuggaagagauuccuaaaggaauugaauaguuagacaagcauugugaggacuggaccaagaacacuaaccuuuagcaacugggagaugaguuagguguuggcaaaaaagacugagagagguggucaaagaaguaggaggaaaacuuggaaaaugaggcaucuuuggaggcaaacgaauaaacuuucaaggaggaggggcaaugaaguugucacugaggaccugacaaaacaggcuuaauggaauaauaaggcaaaaaccugauaguggaaucaggagagaaugggagacgaggaauugcagauagcuuuuuggaggauauuucuguugacggucacucugucacucugcuccaaucgcuaucaucucucacaugaauuaccugaauagccuuaaaacuauuucuacccauagccccacuaucuauuuaccccuacaaucuggguuuuuuuuuuuuuuuugagauggaguggugacuggaagaggagagaaauaaauuguuuuguuuuuuaagauggaagaaauuacaucacauuugcugcaugauugugagaguaauccaaguaaauuuagggaagcauuuaugaggaaaaauaaugagaaaauuguuagaacaauguccuuuaauaguacauagguggaaggguuggccuuaggaaguuuuaaugggaaaggagagaaucuagggacauagguacaggaaagaguggauacagugggaacuugugaaaguucucuucuaauugcuucuguuuucgcaguaauauaggaacaagguuuucagcuucaaagagcuuggagaauguuagaagugucuaaaagaaggggagcaugaaugauguagaaauggguauagugggauccaggaaccacuaaggccuacuugaaguuaaugaucauuaauaaagugagauuagucaguuuuauaaagccauuuuguuauggugauuggauaauuauuguuuaauaucaaugugaagacuuuauagccugcauuaucuuuuuaaaaaaauguuucuagauaacauagaucuuuggaguuacucaugauaaucaaaaguuaguauuaauauuaaaucugcaaaugacaaggguccacuaguuuccuucuuuuuucuccuacacauaagugguuuuuaagguuuuauucaaaugcuauauaaauucuuauucugcuuuuuucacccaauauuuuaucguauguauuuuuucauccaaauucucuuauuuuacuuuuaccauauuuuacccuucagaauguuuccauuggaauuguugguaaagacuuggaguuuacaaucuaugaugaugaugaugugucuccauuccuggaaggucuugaagaaagaccacagagaaaggcacagguauauaaucauaacacaagaggcuuuaguucuauuguaagcugcuguucuuaccacaacugugucuguaaauuuuccauuuugucuuaaauauugaaaugggcccauaauucaaauggcaacaggaaaauuaagaacugaguaaaguuaaauauugaaagggcagugaucuccauaaacacaaaaagggggccgggugcgguggcucaugccuguaaucccagcacuuugggaggccgaggcgggugaaucacgaggucaacagauggagaccauccuggccaacauggugaaaccccgucucuacuaaaaauacaaaaauuagcugggcgucauggcaugcaccuguagucccagcuacucaggaggugaggcaggagaaucgcuugaacccgggaggcggagguugcagugagcugagauccuaccacugcccuccagccugggcgacagagagagacucugucucaaaaaaaaaaaacaaacacaaaaagggagaaguguugauuauuugguuaucuauugcuagguaauaagcuaccccaaaacuuaggggcuagaacaacaaacacuacuucucacaauuuugcggcugacuggggcucaccuacaugguucuuugcuggucucaccugggaucucucaaacauugcagucauuuguggggugcaacuggaacacccaagauaacuucagucacaugucuucuuuacucacaccuuuuaggugucuuagaggagcaucuagaaggcagagaccucugcuaggaugacugagccucuguccacguaguuucagggccgcuucuucagcagggucucucuagcauauuggcaacucagggcuugcaaaagucagaagugaaagccgccaggcauucuuaaggcugagaugcaggacuggcacaacaucacuuguacacauucuguugguuaaagugagucacuggccuggcccagauucuguuugagcagagacugggagaaaugcucauugggggccagcuuuggacacuaagauggcucuucauaaagagaaaagcaucaagaagugaaucucaggugaaauaugggucuuuuugcuagauguuuagaauauacauuugcuauuuauagaugcuuauuugauagcaguguaauugaaaguaaaaaagaaucuaguauggaaauuucuacagcaugaguuuuuuuaacuuggaaaggauauuguugguacuauuugggggaucaagauuugcaauauuuaaacuguuuuugguaaaaacuagcacuguugggaagaaugcuguggaauaccacaaacuaguuuggcaaaggggaaaagaaugucuaaaaagugcugauuguauuuuaaacauaguagugauaauacaaggaaagcuuuuauuccugagcaaugcaaaguacgauaaaaugguggaauuguucaaugauauuuagguuuucagaaaugugaaauuauauauacaguuauccucgaacagugugggguuuaguggugccaaaccccagcaugguugaaaauccacauauaacuuuugacuccuaaaaaucuucugauagccugcuguugacuggaagccuuacugauaacauaaacugacaauuaacacauaaauagacuaguuucuuuuuuguuguuuuuugagacaaggucuugcccucuuguccaggcuggcgugcaguggugccaucauagcucacugcaagguugaacuccugggcucaagcgauucuccuaccuucccccgcgccaccaaguagcugaaacuacaggugugugccaccaugcccagcacauuuuuuuucuuuuuaguagagaugggaucucacuguguugcccaggccaguuucaaacuccugggcuuaagcaauccucaugccucagccucccagaguguugggauuacaggugugaacugcugcacccgaccaaauagacuauuuucuacauauauuuuaugcauucggcauaccuaacuuuuucuuacucuuuuuuuuuauauuucuaggcuacacaguuggucugcuaguuuauauuuauuggaaaacaaacaaacaaaaaaaagcuucacccuaaacaauguuagaguaaaagcaaacaaaaaagaaaaagaaaaagaaaaagaaaucugcauauaaguggacccucacuguuuaaaccuuuguuguucgagccaacuguauuuuuuuuaaauaaaaaaucuuuauucccucaaaucaugagcacucaaggagaaaaaaaauacugcucagaaauguuaacaggacagugaacuaaaacugaguauucagaauaucucuuuaccccuuuuucucaauuuuuaauaacguaauauuugugauuagauguguauauugaucaaguguucauuuuacauauuuucuuuuuuucuuucccuguuaagccugcucaaccugcugaugaaccugcagaaaaggcugaugaaccaauggaacauuaagugauaagccagucuauauauguauuaucaaauauguaagaauacaggcaccacauacugaugacaauaaucuauacuuugaaccaaaaguugcagagugguggaaugcuauguuuuaggaaucaguccagaugugaguuuuuuccaagcaaccucacugaaaccuauauaauggaauacauuuuucuuugaaagggucuguauaaucauuuucuagaaaguauggguaucuauacuaauguuuuuauaugaagaacauaggugucuuugugguuuuaaagacaacugugaaauaaaauuguuucaccgccugguauauuggguuuuuguuuuuuuaaguagcuucaacucuauauaguagucugggauuacaacuggucauuugccuaauuaaauugccuuauuuuuagugauggagaaaaauaauaccucuuaucugucauagccuuauaaca

SEQ ID NO: 15365 - RNA, 5731 nt, Homo sapiens
gaaggguauagaaaauacauuuuuaauuuugauagaguucacaaaugacagcauugacauuucuuuaaacaaauacuucugucaaggcacagcauuaccauguguccccagaugcccaagaggcagugauuucaugucccccugagguuuagcagagccaccaaugucaauaggguggcugacggggccuagauuugcuaccagauaagccaaugagacaugcugucagauuuaugguuacauaaucaaguauuuaaaaagaugcacaauagguaacugcaaugagcuuguucugcauuuagcaauaguuccuuucaaacaaagaagauaguuuucaguaucaagaaggaugccuauauguaugucuuccauggagccuuuccuacaaauugcuuucauuacacauuaaaaggaguucagcuuuauugugaccuaggaggaagaaaauaacagcuagaauuuaguuacugguuaauugucagacuuaacaucuauuaccucacuugcucuuuauaguaaugcuuggagguagguacuauuguagcccucaauuuacagauggagaaacugaggcuuggagagaguuaaguaaccuguucauggucauauagcugguaaagggcaaauacaguucuugaacucaagucuguacacuuaauucagagguacacaacauaguaauguauacucuaaaaugauagugucauuaucuuucaaacucaaaggcuagaauaaucaaaauuauaaaugucaaacagcaguguucuaaauaaacaggaucuguauuucuuggucugaugaucucaggguuacaaggagagacugaaaaaacagagaugaauccaaauucuagggucuuagcuacuggaacucagauacugguguggguaccuucccuuauggauuuuuuaaaaccacauggucucagagaggcucagagugguuuuacaccccuguaaaaaccagucauucaucuucccaucccaucauacaagggcagucaccuucuugagucauucagcugcucaggcuugaaggucccugcggcgccugccaaaggcuuuggaacccacauuggugggcacaaaguuguucuucaccacacccccugaucugcucagcaagccugccagccgaugagucacacagguggcagugucacaggcucucuucugggcaaugauucugauuugcaggauggagaaagaagagaagaucugugagugagaggcugggagagaggucagccccaugggaccuucaugguaaaguugcugugcugaaaggcaccaauuaacuuuaaguguuucuccuaaacacaauuaucagagcagaaaaucacaaggccauuagggaaaaugccaugaucacuccccauagauauucccaggggugucagaaaacccaaggugacucuggaugacuggcuauggaauguggagcaguaacagccaaucuuuccuguauaaauuaacuaaaaaucaaagcggagguuuaugacacuggagugaauuauggucccacacccagccccauucacaaaggacuauaaaaucuacaccccagucacgggcaccaaauacccuuucuuaggaaaauaaaaaauuccucagucuuaccuggaagaggagcggaguuugcagcaucaaguccuagaggugcuuaccugcuccuuaggaccccuguucuuccugcuugagcuuggucaaagggaccacccaccauauccucuguccagcuagccuaggguuaaggcuauuucuaagcauaggucuuagacacuaugaagccugggacauagaucagagcaaugaccaccacagcucagaucuuuggggaaaaauaauuuuauuccucaaaugaucagcacauucagaagcaggacagaggagcucugaugacaucucugggggacucaaagcggcccucauuuucugguauuuucccaggugauucucuuccaaccugugaguccugcucucuuuccucccaucugaaguuugagacauccucugccacaaggaaagccaccaauaccagcccaaagagccaccagagaggaaccaaaccacaugcaucaaguuauaggaaggaugcaagaagggaaauuaggaaggaaagggaggaguuuaguuggcauucuggggcaugcuaacaugagggcgauggucucucuccaagucgcuggacauaucccuuuucuuuccaggugcuccaaccccaauugcaguuugggggaacgugugaaacuuguugaaguccugcguguaugugcccagcaugcaaguacucagauuaccgcaccgcuuagaucuggggcuguccaggcugcagggaaaacacauaccagacaguaccaugcaccagaaucuguccccaugggcagucacuuagaagguuagaccaggcaggggacccugggagcaggaggggcaggcaggagggcagcucacuuaucuauccuucauuaggagagcucagaggugcagugggcuagggcaaugcagggaagggcuggauggggaaggaugaucuuuucuggcauuccacaugcuguucaguccuucaugcuugacagagggguucucagggcagaugcaggggcaacacaugccucugccugagcagugcuggggccaggccaggggcuggucucugcucaggcucaagguacacagggauguggaucuggggaagggugcucucccuggccuccugacaacaugcacaucuccacagaugccacacauuuaaaggcucaaaccuaccucagacacugcucuacccauccccauccccugcaagggccucaccuucaccuugcaaaugugaaaugaaagcuccuugcaggugugaaagaaugucguaugcagauuaacaagguggauccaaauuucuaaaacuuccugagauguacuauguguaucccugacuucacccuuacuagucuuaacucauccagugcugggaggucucccaguacugcaagaacaauucccacagugagcgauuccacaccuccccauuucauuuccuaagaacuuucagaaacggagccuuuuguuaugucuaaccacgguaccuccagcugcagugggaccucugucucccuuggaggcugagaacagcugggccccaggucccggugaacaacacagccuguuggauuccuggccaguguguucucuccuaccucucgggauccaccuuccuguguaugcugcggggagaggaggcccugugcugagcgcuuggggagccucaccuggagcccucucucucuugcuccugcuccagcucacuggccuucaucugcacauaguucugcaccagugcagccagcaggaggcgcgcuucguccucacugagcguggccgggucugcugggcugcucuccagggcagaccuguggaggggaagcaaacucagugcaggcugugagccccugccugccccuccccaggauaagcagccaggcuuccuggucuuugcuucuuccccugaggauguggccagcgggaguccuaggggacagggcacaaggccaguguccuccucaggacccaggcacugguguggccucuaaacaguggugugcuggagccaguuuguauaggcuugugaaagcuaaugguuaaauuuucaagaauuuugcaagcugagugcagccauuauuaaaaauuaaaugcaaaaacuuacaguuagugcugaaccugaaaauaguuucaguuuaauagauuuauaugugggugagaaauagaucaacagguaaaauaccagauuuaacaauaacaaauuuaguggcaaacuauuuaacagaauaggaugcaauucauuuuucaaaucauggcugaauaggauaaauaggauggcuacacauacaaaaguuuggcuaaaagcaacaaaagcauuuugugagacucagugggcuauauaaaauuuauaauaggccgggcgcgguggcucacggcuguaaucucagcacuuugggaggcugaggcagguggaucaccugaggucaggaguuugagaccagccuggccaacauggugaaacccuaucucuacuaaaaauacaaaaauuagccgggcaugguggugggcgccuguaaucccggcuacuugggaggcugaggcaggagaauugcuugaacccaggagauggaaguugcagugagccgacacggugccauugcacuccagcauggaugacagagugagacucugucucaaaaaaauuauaaugaagaauauugucuaaauauuuaucacuacuuauaaauuguguaccacacauuuuuauaucaaaaaauuauauaugugcaugaguacauaccuuaccccggcccccugucgguuuuuaagcauucaguacaccacacuuaagaggcauggaauugucugauaccagugugguucuggcuucaggcugucuuaccugaauggugcugcauggaggcugccugccugcaacaggaccaagaugcugagagccaggaagggggagaacuuuuggaagcccaugacaccucucugcaagggaagaaugagauaaaccaccugcgccaguucgaaguucuaggagcccacagaccuuggcuccuauccugguuuucugucuugcuucuaacgcucuggcuuuguggcuucagacuggucauuauauuucucuucuuuuuuguuuccucaucagcacaguggacuucugggagguucagugggccuguagcaugcacagucugauagagcuggaggagcgauccuagagggagagcugagugggggaggucucaguccuacccuucuccccaaagccacacagauacauauaaaccuguuagccaggucucuguggaggacaugcucccaggccccugucacagaagcugaucccauaaggaaacccagagcuguccuccucuucuggggcuuuugcauacaccuuggugggaggggugggaucuauccacagagauuaucucugcaauuggaaucugagaaauaaaagaaucaauuuuagugcucagccuaagcuccgccugcuggcaccucaguccccugcaggaaccaaguuuuacucuuaaauugggacccaagacuuucucucuuugcucccagagccugugacuggggcuugcaguuuagggcugcuugucccucagucgucgugccuauuugccacccauccgcucuguuccagguucugaaccaauuucccugggacugcugggcuccagacgccgucccugaucgcaccgucugcggaaaguuucucuugccucaggcucugugcgcggucccuggggagccugagugucccgagacuggccuaagccugugugcagugcgagagaguaagacuggaguccgcagccgagcaggaagagcgagccgggggauugagacuguccgauccaaccuagggcacgagccugguauaaaucgcggacuaacagagacuaucugaugaagagacuaacggagagagagggagaggaggaaagggagugagaaaaugacgaauggagggagagggagggagagacauauaccugagccaggaucucggggcucaccuggcgggagguggcuuggaucagaggcgguggcagcggcggcggcggcguccagccagagcccuguggaagcggcggcgacacuugggcugggcagugucucugaugccucccagcgccagcgacugcucuuauucccgccgcugugggucggga

SEQ ID NO: 15366 - RNA, 5731 nt, Homo sapiens
ucccgacccacagcggcgggaauaagagcagucgcuggcgcugggaggcaucagagacacugcccagcccaagugucgccgccgcuuccacagggcucuggcuggacgccgccgccgccgcugccaccgccucugauccaagccaccucccgccaggugagccccgagauccuggcucagguauaugucucucccucccucucccuccauucgucauuuucucacucccuuuccuccucucccucucucuccguuagucucuucaucagauagucucuguuaguccgcgauuuauaccaggcucgugcccuagguuggaucggacagucucaaucccccggcucgcucuuccugcucggcugcggacuccagucuuacucucucgcacugcacacaggcuuaggccagucucgggacacucaggcuccccagggaccgcgcacagagccugaggcaagagaaacuuuccgcagacggugcgaucagggacggcgucuggagcccagcagucccagggaaauugguucagaaccuggaacagagcggauggguggcaaauaggcacgacgacugagggacaagcagcccuaaacugcaagccccagucacaggcucugggagcaaagagagaaagucuugggucccaauuuaagaguaaaacuugguuccugcaggggacugaggugccagcaggcggagcuuaggcugagcacuaaaauugauucuuuuauuucucagauuccaauugcagagauaaucucuguggauagaucccaccccucccaccaagguguaugcaaaagccccagaagaggaggacagcucuggguuuccuuaugggaucagcuucugugacaggggccugggagcauguccuccacagagaccuggcuaacagguuuauauguaucuguguggcuuuggggagaaggguaggacugagaccucccccacucagcucucccucuaggaucgcuccuccagcucuaucagacugugcaugcuacaggcccacugaaccucccagaaguccacugugcugaugaggaaacaaaaaagaagagaaauauaaugaccagucugaagccacaaagccagagcguuagaagcaagacagaaaaccaggauaggagccaaggucugugggcuccuagaacuucgaacuggcgcaggugguuuaucucauucuucccuugcagagaggugucaugggcuuccaaaaguucucccccuuccuggcucucagcaucuugguccuguugcaggcaggcagccuccaugcagcaccauucagguaagacagccugaagccagaaccacacugguaucagacaauuccaugccucuuaagugugguguacugaaugcuuaaaaaccgacagggggccgggguaagguauguacucaugcacauauauaauuuuuugauauaaaaaugugugguacacaauuuauaaguagugauaaauauuuagacaauauucuucauuauaauuuuuuugagacagagucucacucugucauccaugcuggagugcaauggcaccgugucggcucacugcaacuuccaucuccuggguucaagcaauucuccugccucagccucccaaguagccgggauuacaggcgcccaccaccaugcccggcuaauuuuuguauuuuuaguagagauaggguuucaccauguuggccaggcuggucucaaacuccugaccucaggugauccaccugccucagccucccaaagugcugagauuacagccgugagccaccgcgcccggccuauuauaaauuuuauauagcccacugagucucacaaaaugcuuuuguugcuuuuagccaaacuuuuguauguguagccauccuauuuauccuauucagccaugauuugaaaaaugaauugcauccuauucuguuaaauaguuugccacuaaauuuguuauuguuaaaucugguauuuuaccuguugaucuauuucucacccacauauaaaucuauuaaacugaaacuauuuucagguucagcacuaacuguaaguuuuugcauuuaauuuuuaauaauggcugcacucagcuugcaaaauucuugaaaauuuaaccauuagcuuucacaagccuauacaaacuggcuccagcacaccacuguuuagaggccacaccagugccuggguccugaggaggacacuggccuugugcccuguccccuaggacucccgcuggccacauccucaggggaagaagcaaagaccaggaagccuggcugcuuauccuggggaggggcaggcaggggcucacagccugcacugaguuugcuuccccuccacaggucugcccuggagagcagcccagcagacccggccacgcucagugaggacgaagcgcgccuccugcuggcugcacuggugcagaacuaugugcagaugaaggccagugagcuggagcaggagcaagagagagagggcuccaggugaggcuccccaagcgcucagcacagggccuccucuccccgcagcauacacaggaagguggaucccgagagguaggagagaacacacuggccaggaauccaacaggcuguguuguucaccgggaccuggggcccagcuguucucagccuccaagggagacagaggucccacugcagcuggagguaccgugguuagacauaacaaaaggcuccguuucugaaaguucuuaggaaaugaaauggggagguguggaaucgcucacugugggaauuguucuugcaguacugggagaccucccagcacuggaugaguuaagacuaguaagggugaagucagggauacacauaguacaucucaggaaguuuuagaaauuuggauccaccuuguuaaucugcauacgacauucuuucacaccugcaaggagcuuucauuucacauuugcaaggugaaggugaggcccuugcaggggauggggauggguagagcagugucugagguagguuugagccuuuaaauguguggcaucuguggagaugugcauguugucaggaggccagggagagcacccuuccccagauccacaucccuguguaccuugagccugagcagagaccagccccuggccuggccccagcacugcucaggcagaggcauguguugccccugcaucugcccugagaaccccucugucaagcaugaaggacugaacagcauguggaaugccagaaaagaucauccuuccccauccagcccuucccugcauugcccuagcccacugcaccucugagcucuccuaaugaaggauagauaagugagcugcccuccugccugccccuccugcucccaggguccccugccuggucuaaccuucuaagugacugcccauggggacagauucuggugcaugguacugucugguauguguuuucccugcagccuggacagccccagaucuaagcggugcgguaaucugaguacuugcaugcugggcacauacacgcaggacuucaacaaguuucacacguucccccaaacugcaauugggguuggagcaccuggaaagaaaagggauauguccagcgacuuggagagagaccaucgcccucauguuagcaugccccagaaugccaacuaaacuccucccuuuccuuccuaauuucccuucuugcauccuuccuauaacuugaugcaugugguuugguuccucucugguggcucuuugggcugguauugguggcuuuccuuguggcagaggaugucucaaacuucagaugggaggaaagagagcaggacucacagguuggaagagaaucaccugggaaaauaccagaaaaugagggccgcuuugagucccccagagaugucaucagagcuccucuguccugcuucugaaugugcugaucauuugaggaauaaaauuauuuuuccccaaagaucugagcugugguggucauugcucugaucuaugucccaggcuucauagugucuaagaccuaugcuuagaaauagccuuaacccuaggcuagcuggacagaggauaugguggguggucccuuugaccaagcucaagcaggaagaacagggguccuaaggagcagguaagcaccucuaggacuugaugcugcaaacuccgcuccucuuccagguaagacugaggaauuuuuuauuuuccuaagaaaggguauuuggugcccgugacugggguguagauuuuauaguccuuugugaauggggcugggugugggaccauaauucacuccagugucauaaaccuccgcuuugauuuuuaguuaauuuauacaggaaagauuggcuguuacugcuccacauuccauagccagucauccagagucaccuuggguuuucugacaccccugggaauaucuauggggagugaucauggcauuuucccuaauggccuugugauuuucugcucugauaauuguguuuaggagaaacacuuaaaguuaauuggugccuuucagcacagcaacuuuaccaugaaggucccauggggcugaccucucucccagccucucacucacagaucuucucuucuuucuccauccugcaaaucagaaucauugcccagaagagagccugugacacugccaccugugugacucaucggcuggcaggcuugcugagcagaucaggggguguggugaagaacaacuuugugcccaccaauguggguuccaaagccuuuggcaggcgccgcagggaccuucaagccugagcagcugaaugacucaagaaggugacugcccuuguaugaugggaugggaagaugaaugacugguuuuuacagggguguaaaaccacucugagccucucugagaccaugugguuuuaaaaaauccauaagggaagguacccacaccaguaucugaguuccaguagcuaagacccuagaauuuggauucaucucuguuuuuucagucucuccuuguaacccugagaucaucagaccaagaaauacagauccuguuuauuuagaacacugcuguuugacauuuauaauuuugauuauucuagccuuugaguuugaaagauaaugacacuaucauuuuagaguauacauuacuauguuguguaccucugaauuaaguguacagacuugaguucaagaacuguauuugcccuuuaccagcuauaugaccaugaacagguuacuuaacucucuccaagccucaguuucuccaucuguaaauugagggcuacaauaguaccuaccuccaagcauuacuauaaagagcaagugagguaauagauguuaagucugacaauuaaccaguaacuaaauucuagcuguuauuuucuuccuccuaggucacaauaaagcugaacuccuuuuaauguguaaugaaagcaauuuguaggaaaggcuccauggaagacauacauauaggcauccuucuugauacugaaaacuaucuucuuuguuugaaaggaacuauugcuaaaugcagaacaagcucauugcaguuaccuauugugcaucuuuuuaaauacuugauuauguaaccauaaaucugacagcaugucucauuggcuuaucugguagcaaaucuaggccccgucagccacccuauugacauugguggcucugcuaaaccucagggggacaugaaaucacugccucuugggcaucuggggacacaugguaaugcugugccuugacagaaguauuuguuuaaagaaaugucaaugcugucauuugugaacucuaucaaaauuaaaaauguauuuucuauacccuuc

SEQ ID NO: 15367 - RNA, 871 nt, Homo sapiens
caugacuugugaucccaagaagcaucugaaguggguagcagcuccaaagcauuggaugcuggauaaguugaccaguguguuugauccucguccauccaccggucccacaaguugagagugugucucucccucaucaucuuccuaaggaacagacuuaaguaugcccugacaggagaugaaguaaagaagauuugcauucagcaguucauuaagaucgauggcaagguccaaacugauauaaccuacccugcuggguucauggaugucaucagcauugacaagacgggagagaauuuccaucugaucugugacaccaagggucgcuuugcuguacaucauauuacaccugaggaggccaaguacaaguugugcaaagugagaaaaaucuuugugggcacaaaaggaaucucucgucuugugacucaugaugcucgcaccauccacuauccugauccccuuaucaaggugaaugauaucauucagauugauuuggagacuggcaagauuacugauuucaccaaguuugacacugguaaccuguguauggugacuggaagugcuaaccugggaagaauuggugugaucaccacagagagaggcaccguggaucuuuugacgugguucacaugaaagaugccaacagcaacagguuugccacucgucuuuccaacauuuuuguuauuggcaagggcaacaaacugugaauuucuuuuuccugaggaaaggguacccaccucaccauuguugaagagagagacaaaagacuggcggccaaacagagcagugggugaaauggucccugggcgacauguuagaucuuuguauguaauuaaaaauaauguggcaugauuaaaaaaaaagagaaagaaac

SEQ ID NO: 15368 - RNA, 237139 nt, Homo sapiens
cgcggcggcuccgcgcucggcgaacauggcggcggcgacggucgggcgggacacuuuaccugagcauugguccuacggggugugccgggauggccgcgucuucuucaucaagugcggcgcgaggacccggggacgcggggacgcgggugggggcgcgggggcgggggccgggcgggcacccggcgggcuguggcggcgcuaacaggugcaccucucugcccgcagugaccagcuccgcugcacgaccuggcugcauccgcgcaccggggagcccgucaacucgggccacaugauccgcucaggugggcgccgggccggcggguggggggcgcgcgcagcggcggcccaaguuugacccgacuuuucuggcguuuccgcagaccugccccgcggcugggaggagggcuucacggaggagggcgccagcuacuucaucgagugagugaguggggccgccgcgcucgcaccugugccgcggggggggggucccuccccguucccgccgggcgccccgcccuuccucugcucccgccggcccgggcucguuggcgcgcgcugcgccgcggccacacucaacguuuugugugcccaaguuguuuggcggccuccgagaggaaggcggugggggccgcaccuacgcuggggaccugggccgggggggaagaggccgcagacucugcgcccuggaccuugcaauccggcuggauucgggugcuggugugcgggcugggcacgccuccccucuagggucuggggcugcgccccgccgggagaggcgagugccgggaccuggaugggcucgggugggaggaguagaacgagaaguucuguccuggugugggccugcgggguuggaguggggagagggagagacuaggggaaucucgcuuaggaggacgcccccucucccgccgcaggcucugggauggucuuggagagucggaaccucgcccccggccuccauccacugcgcgggccugcggggagggaggggguggggaagggaacuggucaaccaaugacuuuccucgagcgcuccgcgucucuucggccggagcugaaccgggggauugcuggugcuuccguuaguccacgggcgacuuuuccgcaaaagccccggaguguuggcgcaccagccagguuacccugggucuguaggaucaguccaugucagauuggggcgcaguaagugaaggcgcgggucaggcuccuaugccaguacaggcuuugcuuucccacuccggcgggagucuguguugcagcguguuucccucugccugcugagcuccgggaggccagacacugccuuugaccccuugccccagugccggacagcaaguaggcacucgguaaauguuuguucacugaaugaaucagcucgccaaaggucuggacgguggucugacuaguacugacuggguguaccucggcgacugugagucagaacuacuacuguuaggaauaaagcagccuauuucaagaaaaccccggaaccuccuuuucugguuuggguucuugcauaauaguugaaaauacugaugggugagauuuacagaccuaaggacuagggccuugcugcgguucuauugcccugccucauauguguguaugugaaguuggggaguuggcuggggccaucagagucuugcugucagugggccucucuggcucauaacugcaucaguugauguuauuacaauuuuccugugugccacacguucacacguuguucuaggcauugggaacaaaaaacagaaaaguucuaggugcucauggagcuugcaaucuaauaggagagggaagggaguagaaaauaaguaaaaaacacaaauaauaauaucagaucgugguuacuacugugcagaaaguuaaaauaaggugaugugacauggagugacuggguggcuugguuguacugggagaucgggaugguguuucugaauaggcaacauuuaaaguaaaauuugaaugacaagaaggagacaucaugugaugaugaguuggcaaagcauuucgggaagagcgaacagccagggcaagggcuuaaggcagaaaagagcuuggaguuuaaggagcaggaaggcuggaauguggugcacaagggagaaaguggcaugaggagaggucacagguaggagaaagguaaaugccgcaaagcuuugugagccggggugaggaauuuucauacuuuauucuaagcccagugaaacgucauuggaggguuuuaagcagggaaauggcaugauuugguguguguuuuuagaacgaucacugugaggagauuggauuguagguggccacugcagggggaggcaggagagcagcugaggcuguugcccucuuccaggcaggaguuagaaguggcuugccugagggugguagcacaguagacagggaguaguggucacauucaggcuguguuuaggaaauaggcucuucacaccuucaugauggacugaauagucugugggagaaagagaagaggcaaagaugacuccucagggcuugggcaccugaguggauagcauucauaucguugagaugggaagagccgguuugggguggaggagaaucaugagaucuuguuuugccaucuuacauuugagauaugaguaugucagauagugugaucugaagcuugguggggagagaggacagaagagacccauuggguauaauagauguuauucaaggccaugggauuagaugaaauccccuaggaagagaguacagacagaagagagauguucugaggcuuuggauggucaaagcaguguuuagaggggugagaggugaagccagcaaggagacugagaaggacugagaagguaggagaaaccccaggagaaugcauggucacagaagccuuaaaggacaaaaucugacuggaguagguggaagauaaaacacggggugaagacagggagucaguuaggcaaaucuuccagguaguuuuguugcaaaguggaguugagacauuagccgguaauuggagaggauguggguuugagggaggguucuuuuuuuuggugggagauuguacagcauguuuguuuugaugggaaugaucccacugagaggaagaagucgaugcugcaguaaagagacggggcaguugcuggagcaguguuucuaagaaggugagagggaugggauccauggccugcaucucacuagcgucacccaggggcagggcccaucauucauuuggcgggaggaagggcugcaagugucccaaaguaccaggugcagccuugggcugggugugugaggccgcgugugggacucuggaggcuggagcacagccuuccacaccuuugcugacucuuccaugguaacuugucugugaggucccuaaugauuuuccuacagugagcuccugugcccccagggccuuggcugacuccucccaggccuagaaaaagcaaugugugacaguguucccuacccucaaaggcagggcccuguggcaggugauuguacuucugacguccuucugugacaauuuuuugagagacuuaaggguuuugggaguaauuguucucucccucaucccccgccccccacaugaaaaauguuuuacuguugucugauuucuuagcuuugccgugagcauuucugaauguuugauuuuuguguugagggcaggagccuccucuaaucuggcucauaaagugagagcgacaaagcauugacauggcugauuuuauuuuuccuaauggcuccuugcacaggaaaguugugugagguuuuacaggauguauucaguugcuccucauauuuagcagauuaaaacauuuuaauuuuugaaaaaauuuuaagaaacagaaucuuccucugucuccuagucuggagugcaguggugcaaucauagcucacugcagccuugaacuccuggggccaagugauccucucacuucagccucccaaguagcuggaacuacaaaugcaggccaccaugccuggccagcaaauguuuuaauacucuccagaguccauuucuuuucuuucuuuucuuuuucuuucuuuuuuuuuuuaaagacagcuuugcucugucgcccaggcuggagugcaguggcacgaucucagcucacugcaaccucugccucuuggguucaagugauucucaugccucggccacccccuaaguagcugggacuacaggugugcacaaccaugacuggcuaauuuuugcauuuuuaguagagacaggguuucaccauguuggccaggcuggucucaaacuccugaccugaagugauccgccugccucagccucccaaagugcucggauuacaggcaugagccacugugccuggccucggaguccauuucuugaagcagaaaagcuugagguuaggcaggugaauuuuuguuuugauuucugcacuuuuuguucaauuuugcauuaaugagggacaaaauguauaagaaaucuacuguugguucucccaguucuagacuaagugauguugauaaccccuuuaaaaagauuuuuuggcuggguauaguggcucaugccugcaauuccacacuuugggaggcggaggcgaggggaucacuugaggccaggaguucaagaucagccugggcaacacggagaggccucaucuguacaaaaaaugaaaaaauuaauggugguaugcuccuguaauccuagcaacuugagaggcuuaagugugaggauugcuugagcccaggagucugaguuuaccaugagcuaugauugugauacuguacuccagccuggaugacagagugagacccugucuguaaauaaauaaauaaauaaauaaauaaaacgaagacuuuuuguacucuagcacuucucuacuaugaaucccuuagcuggguagcaagguauaauaguaauugugauaauagugucauuaacagaaguagcaauaauaguaguaauaauuauauaacagccuaaucuuuuugggucuuugaaaaaugcuaggaacuguucuguaacugucauugauuuaauucucacaauaguuugaugagguaggaacuacuacuaguuucguuuuacagacauagaaucuugccguaauccuggacauuccuauagcagaugguuuuuuuucuugugucuuuucuuauuugauccuuauagcagccccuggaggcaggaggggaagaaucauccccauucuucagaugaugaaacucagguccaugaagguucaaugauuuugcugaaguguuagagcugggacuggaacauaggucuuuggucccucaugugauagccacaguaguagugguagcuccuaccccaggccaugcaucuugaaggagaugaaugcccauaugccauugcucugaguuaggcuuccccaaggcuuauggggccagacuccaucuuugcuuuuucuggggauugagguacuuuggaagggcaguacccccuggucuccuauguugauuaggggugguacaugucucugauuaguaagaaauugaagacauugauuauuaguaaauacaauuuggcagacacagcuuuuucaaacaugggaccuaugagggagaaguuucuagaagaggccaugggaguuagaguauuacacugggcugcucuucagggguuucauggaaccuugugaauuccguucccccuacagcaggcauuaaauaggucaugaggcaaugaggagauggcagagaagaggggcucagccaccuugccugugccaaggcuguuccuugaaggcaggcaucuuauuccccacuucugugacuuaggcacccagcccagggcugggagcugaguaggcacuuggcaucucuugaggaaucaguguuuuaaagagacccaaugaguuuucuagguauuccaggucuuggaaaacuccuuacugggaaggagauugggguggaggagaauaagcaaggugagagaagcucaacagccaggaacaggccugucaaggcuggugccuagacccaggcuucuuggauacagucgcuugcuguugagaacaaugcucaaagcaggaagcuggcugguggaggcucaaacggccuccucugcgucuucauuucauauccuuauugcucugcaucugggacugggauaccuguuggcuacuggacuaggcugucuuccuucccuggcugcugggcccuuggcaucaucugugacuuggcacaagggugcuggcaggaaccagcugauugcacaagacccuuucuagcuucagguuucucaguuuuagcuuugggguuguguggagccacccuguguagguacuuucuucuugugggugccuguccccaagugaggacagcuagacucugggaaagacauuucugaggcuuggaguaaggcuaacuuuccccuccccuaggaccugaagcagguccuaggggcaggacuggcuacauaauuugcagagccucaguguaaaaugaaaaugcaaggcuccuuauugaaaaagaaggaaaaaguauuagcuuggugcaaauguaauugcgguuagugcuauuacuuuuaaugguaaaaacugcaauuacuuuugcaccaacugaauaucuuuaggccgggcguggugguucacacccaguaaucccagcacuuugaauggccaaagcaggaggauugcuugggcucaggaauuugagacuagccugggcaacaugguaaaacccuaucuuuacaaaaaauacaaaacuuagccgggugugauggugcauggccauagucccagcuauuagggaggcugaggugggaggaucacuugagcuugggaagcggagguugccgugaacugagcucacgccacugcacuccagccugggcgacagaaugagacucugucucaaaaaaaaaaaaaaaaagcaucuuuagagauccuaaaauguaaaauuuuguucuucuguaguuuuucccuugacuugucauuuaaaaaaaaauaaaauugcuauuuaugggcaugguggcgagugccuguaaucccagcuacuugggaggcugagccaggaggaacgcuugaacccaggaggugaagguugcggugagccaagauugcaccauugcacuccagccuaggcaacaagaguaaaacucugucucaaaaaaaaaauuuuuuuuucuauuuaauguaauucuacauaaagaaaaauuaaguuuaaauuauuagcauaaauuuuauaguuauuucuauauuguagaauauaauguuuuaaaugugaauaucagugcauuuaccucauaugcuaggaguugccaccaccaugccccacuccaagacaccauagagcacaagcaccuguauccaugccccccugggcagcagggaggagcagggagcccaggcagggcuuagggcuccaggaggcugggagugggcaguuaagaaccugguccuccgaggcagggaguggggaccaggcaugaguccuucagaagguuaccucuggagauaaugccaaguaucaaggguguguguuuuguauucagcaacccauuuuuuagucugaaaucaaagggaguuggagagugaaggaugaaccaaaugugacagauguucaguuggggauuuuguagacaccaggccuagaaggcccuuaggaaagccagugaauacuggacagcccaggaggcugcccuuaauuaugaccucacccaaccgacagucuucugggccaccccuaggaaggagucuguccugucuucuauauuuuccucccuagauaaauguugaacuucauggcagugaaauuuaucuuguagaaugucaaaccuauugauucacuuauauaucaucuuccuuuuuuuuuuuuuuugagacugagucuugcugugucacccaggcuggagugcaguggcggcaucucggcucacugcaccucugcuucccggguucaagcgauucuuccaccucagccuccugaguagcugggacuacaggcaugcgccaccaugccuggcuauuuuuuuguauuuuuaguacagaugggguuucaccauguuagccaagcuggccuugaacuccuaaccucaggcaauccgccugccuuggccucccagagugcuaggauuacaggugugagccaccgugccuggacguuuuuuuuuuuuuuuuagauggaguuucauucuuguugcccaggcuggagugcaguggugugaucucggcucacugcaaccuccgcuucccuuguagcugguguuacaggcgcccaccaccaugcccggguaauuuaguagagacgggguuucacauguuggucaggcuggucuugaacuccugaccucaggcuguccacccgccuuggcuuccuaaagugcugggauuacaggcaugagccaccaugcccagccuuauuugucauccuucuuauugagauguugcugggaacagcagucccagaaacuuuauuucaaaccuggggguaauagucccacaaagaauuucugggaaacuagcagcuuacauauauacuaaaauagaaauucugaacccccucauugaagguuaagaaagguuuucccagcuuggcaaguuuuggcagaaucccaugcuuuauauuucacuuccugguugcauuuucaaggguaaaaacugguucauggauuuaaacguuagguucugugggaaaggaaaaacagugaguguuguuuagaaagcgaaaggaaggauuaggagccaugauuuauaccacaucuccaaaaagaaacuucuuuaaggaaacgucuuuaagaaaaaugguugcaaguugcuuuuuaaggcucuuuacccaugagaggaguguguuuuagagauaggacagaugcuggguugggaagagguguuuucaugugaugaggguggguguagguuucuugugccuugauggcacccucuccauucucucucucucucuuucuuuuuuuguuuugagacagaguuuugcucugucaccuaggcuagacugcaguggcaugaucucagcucacugcaaccucugccuccuggguucaagcaauucucuugccucagccuccuggguagcugggauuacagacacccaccaccacgccuggcuaauuuuuguaucuuuaguagagacgggguuucaccauguuggccaggcuggucucaaacuccugaccucaaguaaucugcccaccuuggccuccuggaagugcugggauuacaggcgugggccaccgggcccagccuccauucucuuuugaugucuaugggaguaaauuuggugcuuccuaaauugagaacuuuggaaaaaaauuaagacagcacuuuaaacagaaacgugugcaggggcagggagaugccaguuuaccccccccguuaagucugaggugacagagggcuguaggaagacugcuuguuggcuuuucagccucaauauguggaauauuuggcaauucagugagguaccugcucuuguuuucuaucuucagaggacagcacagguuugaaucucuuugcucaguguaagacagcaucaucucagcaaacuggcagguaucuuaaguaaauauuggcagagggaaaaacacggaggaauaugguuguauuugccuguuguuuuuaaauggcugucaaaacauuugcuuuucaauuuucugaaaugagaaauauuuugaguuaauguuuuaucauuuacagaguauuucacgaacauucucugguuugucccauaauuauugcauuuuuuuagugcgggaauuugggcucagagggguaaagugacuucucuaaaguuguauacugggcugggcauggugacucaugcuuguaaucccagcacuuugggaggccgaggugggcagaucaccugaggucagaaguuuaagacaagcuuggccaauguggugaaaccucaucucuacuaaaaauacaaaaauuagcuggguaugguggugcgugccuguaaucccagcuacucgggaggcugagguaggagaaucacuugaacccaggaggcagagguuacagugaacugagauugcgccauugcacuccagccugggcgacaagagugaaacagugucuuaaaaaaaaaaaagaaaaagaaaaaggaaaaaaaagguguauacugcauuagcucagcuucuucaaaguucaagggagaggccuggacauauuguuccucauauccaggcuucucagacauuucagccauaggucuaauggcagaacagaaugaaggccaacucaccuaggagacuggaugcaggaagugccauuaaauguugguucuguccaaaaacucauugacagacuaaaauuaauugagacuuuacccucaauuuaauuuauuauguaauccuuucuuauaucuuccuuucaaaucaauucuucggccagaugcaucauguuuauugcuuuguguucuaaauagaaauguguaccggcagaggaaugcgaguucccccuguucagucuuaggugacagaggagugcggagagacuccuuguuggcuuuucagccucucugggcccuacaucuccaaacaggauguacaggaggacuuaaggaaaguaucagcaguugugguaaccuuggauugucuuuugcuuguacugaguugugaguugugccggaucacuucucugucucauccagcccucuucaggauacuggccugggcagcaggguugguuuuuguugaagcccaaagcacagcuaggcaacuucaucaugcagaaaaauguaugaaaagggcuuuugaugugggugacagcauguguaaagagacgguauccaaguguguggacuuuggagucagacuaccuagacucuaauucaccuccaccacauacagcucccugaccuuggcagguuaccugcucucuuuaagccucacuuccucaccaguaaaaugggguuaaaugugaggauuaugugaguuaauugauggauggaaaggguuuagcaaguaguagugccacguuuacuggcacauuguaaaugcccaauaaaugugagcuccucuucuguacauccacacagcuauggggcagggugaagacaugacuucugaguccuaauugcauucauuggcugcagaagucuggugcccuugaacuaggauugccggagucaggggcaugcaaacuguagaacucaacucagaaauugguuuggaccaauaaaaacugcacaaccuugggcugggugugguggcucacauguguaaucccagcacuuugggaugccaaagugggcggaucaccugaggucaggaguucgagaccagccugaccaacauggagaaaccccaucucuacuaaaaauaucaaaauuagccgggcacuguggcgcaugccuguaaucccaguuacucaggagacugaggcaggagaaucgcuugaacgggaggcagagguugcagugagccgaaauugcgccauugcaugccagccuaggcaacaagagcgaaacuccaucacaaaaaaaaaaaaaaaaaaaaggcacaacuauucugguacuuaaaggauguccuuauucuuggaaauacacacugagguuauuugcucuuaaguaguuaaguggugugggggaaaauuguguuggggggaaggaguggaugacagagcaaaugggacaaaauauuaacagugggugagucugaguuaggaguggccccugguuuaccucuuuacugggcaguuagaagucugcacagaugucugcuucuuaaucugugcagccaccugguuaucggcucugaccacuaaaggacaaaugcauugucuggcacgucucacgucacaggugucaacaauaauaaucuucguggugcuuucuaguugaaaaaugcauuuguuguagaggcagauauuuugauuguccucauuuuacagaucaggcauuugaggcugaugggggcagggaguggugguuaauagaucuucccaaggccccagcaucaccgagggguuuaagacuugaaccgaagucuucuuggcuccaaauucuaugcaguuucuacgugguacauggugccuuguggcucucaucaucacucuuucuguuccuuuuuuuuuuuucuuuaaguguugagguuuuguucuguugcccaggcuggggugcagugguaccaucucagcucacuguaacuucaaacuccugggcucaagcaaugcccccgccucagccuccugaguagcugcgacuacaggcgugcacugccaugcccagcuaacucccucucuacugauuccucccucuaggguuaucccucagaagcaguucucugccugcaccuucccugaugacugugaggcagaagcccccuugggccucccucagaaaggcaggguagaagagugauggauggugcauaguccccacacagaacugugagccagucgcuggugcucugggaaguggaccuccucaagcuggagaggcacccucucccgccacagaugucagcugaccuuagcuuaggggccuaugagcuucuuaagccugcuuagagccaggcugucucuuucagguccugccagaagagcauuuccaauaucacagccaauuuucucaggguuucucaggggcuuuuuugccaagacagagccucgcccucuugaggucucacagcuuggaguuagugugcagucucuuccuggggcugcuggcuaccucuuguagcuuggaguuagugugcagucucuuccuggggcugcuggcuaccucuuguagcuuggaguuagugugcagucucuuccuggggcugcuggcuaccucuuguagcuuggaguuagugugcagucucuuccuggggcugcuggcuaccucucgugacuuccuacaucacacucuauggugcagggaaggggagcagcaugcuugggggauggaggggccagagaucccauuccagcccuguaccaaggccacuggcugcacagcuuccuguguucucucccgcugggugaggcgggagaugagcuuguccucgucucggaagaggggagccagagcaaugguuuagguucguucacucaccuuugcaacaaucauaucuucuccacuugcaaauugagcugucugugccuguccacagauggaaugaguuggccaucuugagggguggugggcagcuuauuagaggagcaguuuaauuggaggcugguuggcuuuugaucaaggaauuaucuguucagucaccagacuccaauuaagcagcuacucuaugccagacacucggugcuggggagagaaaugaagcucacuguuucugcccuccagcagugcccaguccaagacaggagaggaaugcuggacaguuccaauaugggugccuggggcuggggagcuucggagggugaccaaggaaggccaggcagccauggagcagagcagugagcagcccaaggcaggagagaccaaugcagaaaaugugaaggagcuggggauuaggggugagggccaugguaccugugugccuguuugggucucagagagguuagugcugaguugaggaguagggacagaccuuagauaaaauccuucacuaguagcuuggcugcaggagugugguguaugggagcuaugcccuagagggcucccugaauuccuuugucuauaggguggugccacaugguguuuacaaaacauggauucugggaucagagugccuggguugaaauccucacucugcuuuuagcuuuggcaggucacuugaaccucucugugucuuuagauguuucuucaucuguaagauggggacaaugacuguaccuaucaacuuagaaugguaucuggcaacuuguacaugcuauauaggaauuagccauuaucacuacuacuccuaugaaggaagccccuuccuaaggugaaauguggccugguuggcagaggagcugugguugguucucuuuggggagaucuccuaaggucaggcuagccagagggagaaagaauugugcuuccuuguugagacuugucuuuaaaaggaagcugggcaguaaaugauuggugccaaaugucaaagaaacuauuucucaucucagaagcccuguguggcuguguccaaccagagagaagaugaacagguuucuugaggagugucauggcucaugccuguaauccgagcacuuugggaggcugaggcagguggaucacuugaggucaagaguucaagaccagccuggccaauauggugaaaccccaucucuacuaaaaauacaaaaacaaaaaaaauuaguuggguauggugaugcaugccuguuaauuccagccacucgggaggcugaggcacgagaauugcaugaaccugggagacagagguuacagugagccgagauuccaccacugcacuucagucugggugacagagugagacucugucucaaaaaaacaaaaacaaagacagguuucuuguacuuaccauugauugacacauuugauuuauacucccuguccauauccccccuccaguggagaggauucccacaugugaguauuaggguuugcaucugguucuuuuguggggaggcaguaacccuggugucuguauuagaggauugguaaggggcagugaggguagacaugaauuagagcuucugugggguggggcugggagucagcauuuaucacaagcuccacaggugauucuuauggacacugaaaguagaagcaucucugagcuucagcuucucugucucuagaauaaugauauauuuuucucccuaguguuauuuaagaaugaaaugcgauagccugucugaagcuccuaccaugcuauucagcacaugauaggugcucaggcauugugagucucuuuccuuguagaagaacaucugucuaaagucauuggguuaagcugugcaaaaggcuuugagagaguaucagugggguacagcugucugaauguacaccccguuacccaggagggagccugggaagccagguuccuggggagccucugguuuucucaguguggguugggaaugugcugccuucaccucugcugagaugaugcugucagucccaguuagaaauggugggacugagcuugugagugaccacugaaugaggccuaugucugccuggggguaggugugcagcuccacaucuuggaaccccgugaccacuuagagauccugcaggcagaggagggccuggggugacaaguuguucugagugauugacauuaauagccagagaaggcaagcagaaggcaauuaagcugagaagugggaaggcuuccucugugugggagaauacaugugucccggcagacaguggcagugaugagcaagucauagagaugucugacauugcaguugucccugagcugguccugggggaauggggcagggccaggauugugacucaguugccaugaagagcuccccaacucccuggggacagugucaggcacagagacagugcucagccaaauagguguguguugguugauuugacauuugccauuacccuccugaaauugcagauauacgaggauagagggcugguuggaguugggagugagugggggauuguauggugaggcugggaggagggggauaagucaguggucagagucccagggaagagaaaugauuuccuacccaccaaagaaaguguuuggcaagauuuuuuuuuuucaacacauuuugaccuggggauuuaaaaaaauaugguugaaugcuaugaagcuaaauaucuauaauaacuguaccccuuaaugcauuucuagauguaauuggugguacuugaaauuauauccacuuauggagguuuugaauauuuuuuuuagcuuugguguguagaugggagcugaagagagcucagucgguuuuugcuucaacuuuuccagcccuucucaccugaaaauguguagacguguuuguguguuuggcacuggaugguuuugaaaauucagaggggauauuaauucuuuuggggaaaggaaaguaauuggcuuccuguucugugaauacauagauauuuaaauuagaaccccaaguacacucuuuacuccaaaagccgcaugugucugaggagccuagugacauacgauguaagaauugugggguaaucuugccaggccuuuccagguugcuccuuggggagggaggucuugguuggugcugauugccuccuugagucaguggaaagguuugagaguuuguuuguuuguuuuuuuccugaagguucguguuggguuuugcucaguucaagggugcuagugagcugagggguggggcugugaggcucucacacugagaagccaauggcuucuacuuauuuguuuauuuuacaaauguuuaucugguacugacacuguucacacguacacuguucuaagggcuucacagacacagccuccuuuaauccucaugccaaccuuauaagguagguacgguuaucauccucauuuuacagauggggaaacugaggcucagggagguugaguccaguaauuggaugcacagguguaaggcggcagagcuggggucacccagcguucccuaucugggguucucauagucucucucuguccagcuuggccugucuccaccauguucugugacaggcugugccguggagacugcuccaguuuauuucaggaagacacucgagcuucgcacaggucagaguccaugggcauggugagggaagagaggguguagccagggcuguuagucugggacucacuggaagcaaacugcaugcggccuucugucgagucagcaaccccuuuuggguuuaguaggaauugucaccucuccccccagcacaugcaccuguagagaagcccccagguguugcagagagccccugagggaggguauaggcugugcuggggcucagagaccuggagcucagaggcuagcugaggcaggcuuuggggucuugcuaucuugccuccugcccaucgagugccaggugagugaaggaagucacugucugguuagcugcauucucccuccuguuucuggggucugagagaggagacagauugccggucuuuguuuuggacuugacucccucuagagauggaacccccacccuagccccacucagacaaaguuaagagaauauugggaaaaugggcucuucuucacaguggaaggguuuggcauuuugagacucagcaugaaaaccucacucuaaugcuuuccugaagacucuggggucauugcucaccuccuuguccauggacauuucugaugggaggaggaggagguagacuaugggguggagcagagagaagauuggaggcuuuucucucugaagucccuauaggcaccucagggguauuguuagagggguggugaugggagcaguggugaccuggggugaauacagaaaugaccuuggcccagaagcacagccuuggggcaggggacuccacucaguccugauguguccacaaaucaguccaugcugugugaggcagaaaaagggcuugcuugggccugguagcuccaggcugggaccuggcugaacuugaagcugauacccacaggguagagaaccacucugagauucaacuuuuuuuuuuuuugagacggagucuugcugugucacccaggcuggagugcaguggcacgaucuuggcucacugcaagcucugccucccagguucacgccauucuccugccucagccuccugaguagcugggaccacaggcgaccaccaccaugcccagcuaauuuuuuguauuuuuaguagagacgggguuucaccguguuagccaggauggucucgaucucgugaccucgugauccgcccgccucggccucccaaagugcugggauuacaggcaugagccacugcgcccggccucugagauucagcuuuuaaguuaugugaagcauucugcagcacaggaaacucaguccuggcugaggaccguaagcuguugacuuccuuccugcagguuauaagcauuucccggcucucccaucccuguguaccugaaaccuuucuggaacugggugugaccucaggccuguauucccaaggcugucaggggcuacguuauaggucuuuuccacugagaaguccugccugccugcugugugguucucagaugggauagguggagggaccaccccccugagagucuacugucuccauguugagggccuuugaccagacuuggccucccucacaguucagcuguucucacuccugacuugaaauagggcagcuauggggucaugggugagcacacaggcuuggagccagacuucauggcuauggaacucugccagguuauguaaccucuguaaaaugagguaaaugccgguaucugccccuuaggucuuuugcagagauuaaaugagaauaauacacguaaacuacuuagucuccagaacauaguaugguucaacagauuuuauaauuuauuuccaugaacagcagauauuuugucuuuucucuauaauggcuauggugggccaaauguauuuagguaauuucuugacuucugcagggacucugauauacacagagcguaccuguguauacuguccaguuagcucagauucucaguuuugggcauuuucuaagggagggcaaugaacauccugauagguuuaacuaagguuuuaaaauguccaauuuuacgugugguuuuuaaccacaccugcauccuaauuacgaccuuggcuguuauagcuuauagguuuaggcaaucuggauauaguuguagcaaagguuauuuuugauucgagacaugccuugcuuccucugggcagaggaagaaaaagcuccagugaugauggaggacuggagaggggaggucagauucaguuuugaauuuuaaguccauuuaccugacaucauauuuguuauacucugggggauaucagggagccggcaaagcaaauguccacaugcuucaggcgauaggauggucagguggcaugugacuaacugucaggauaauagugcaggugcuacauggagaguaacacucaggagggagcaguucaggggcuggaugagucucagaagacuuggugugugugcaggggucuugugaacugggauugggcggggacgagagacaguguggguguuguaggcaggggaccggcacucauuguucaggggucccuucauuuagcagacauucacugagcacuggaugugugccaagcacuggccugggcacaguagauaccaacaagagugaagcagaguagagaaaagagcauugaaagccagaguggcccagugcucaggagcauggucugcuaugugguugccucggcuugaaucccagcccugccacugacuagcuuguggugugauccugagcagguuguguacucuggagccuguuuccucaucugaaaaauggggaugguaauaauuguggcagggauuaaaugaguuaauaggaaguacucagaauagucuugaauauagaaaguacuacuguguguaggauauuuauugucacuggaauauuagcuccaugacaggcauuuugucuguuguguucacugcuguagaauacaucuuguacauaguaggcacucaguuaaugaaucaaagcaacacugguguccucaaggagcccaggagccugugcucugguggggacacagccaugucaaugaccagaggauacugugcaaaugcuuugagaagggaagcauggggccugguggggcacagaggagggcuggccaggggaggcuugggguuggagagcccgagcuggaucuugagaaacaagcagggauuuguugguugacagaagggagucuggauguuuuugggagagggauagcacaggcagaaccaggagagccugucguguucuaggacacuggaagagaggauccugcagaaugggccucucagaggauccagggaggggucccagcagggcugugaccgggcccucugaggcuguacgggaggaagguggaauaugcugguugguguucacucagacuccagcccccaccuauguccgcagggguggggcuggacauagguuggcaccagugagagcuccccugcagcaggugaggguuggccuccaaacaaggagaaagcagguggcccccacuacugccuggcagcacuccugcuguaaaauagaagggaugaagagagugggugauuagugucccugggggaccuaguuaaaaacugaccccuggaacugcaacuccagguagcccucacuuccacucagacaccagggccuccuaaggggcaucugcugagggccaccuugcuugccacaccuuggcccuccucgcagcuuugcacagugcacagaaguccugucaccugguggccuugacccuacugacagagaaagacugacuuccaggccugugugcuuggugcuucuaggggcagguguaggggccauagggaaagaccgugaauucaagcugauaaaacugauguguguaucguccccaguugaagaggacuuugaggaaacaucuacuuuauacuuaagcuuguguuccccacaguuuaccauaauuacucauggacuuaauuaucugccauagauaauuaucugauacuaacaccuugcaccuccuuguuuccucccccuuccuuaaaucuacccagacacaguaggcaagagggaaaauggagauggcuuucacuuuucucuuuggccuauugccuuauuuuccuuuggucucuccugauuucucugagggcuuugggauuuauuucuguggcugaucauuuauauacagggcuugccaaagguccuugugcagggcuuuuaaacuuuaacugagguuguggguaugacagaguguugauguuugcaagcaugucaaguggaaccauuugagaccauugcagcuggggcaguuuuuauggucugcaaucuagugucaggagguugcccagagacaagaaaggaaacagugucccuggcucauuucuauacucacguaaccaccauuuaucuagugccuacuguaugcucaguggcucuucacaaugacucugccagcaaggagagccacaggaacugagagagcugggaucucugugaaugacccaugggugcugguuguuucugguugaguagagccagaggacauguuuaaaacugccagggacuuuugcugaaccugcaggaauuguuuccugccugccccccacucugcccgccccgacccagccccuuccuuaaguccauccagagauaguaggaaagaggaaaagugaagaagguauucacuuuucuuuuuggccuacugccuuauuuuccuuugguaucuccugauuucucugaggccuuuggaacugauuucuauggcugaucauuuaccugcaggggcuugcauagaaaggguuucuugguacugagccugauaggaauguggcagagggaggagagagagcugagggucucccugacgccuuggcuaucucccaggcugggcagagggaaagguggcagaguuggcagggugaggugcugguauggaagaggauucaaucagagcacgucaaauaucacuuaagggccuggagggaauuucacaaccagugaggcacuuuucugugaccaaaacuuuuuacacauuauuugcuuuaauccucaugguagcccuaaaagguguuauucuucgcauuuuguagaugaggacacagaggcccagggaggcuguaacuaggaaugguugguguauucugauucuguuggccagguuaauucuuuuuuuuuuuuuuuuuugagauagagucuugcucuguugcccaggcuggagugcaguggcgagaucucaacucaccacaaccuccgccuccuggguucaagugauucuccugccucugccucccauguagcugggacuacagguaugugccaccacaccuggcuaauuuuuguauuuuuaguagagacaagguuucaccacauuggccaggcuggucucgaacugcugaccucaagugauccuccugccucggccucccaaggugccgggaauaacaggcgugagccacugcacccagcccauauugauucauuuaaaaccucauaagaauccugcagguggcauauuaugauucuuguuuacccauguaggacugagacccagacccagagaccacagacaggagguaguagagccagggcuugaacccauaucaccaagcugccucaccgggcuuccuuaugaaggaguuccuccuuccacccuugaaagccgggagcaauuugcccaugagccacccagcccuucaguggcgaggggaguggggcacaggguggugagucuugcugagagaauccccuuuccagucagaucugagagcuucccccacucccuucccacacagagucacguagcuuucagccuggagcucugcagagacgcagcucccagaccugcaugcccaggcuggggggggucccuggaccaaauucaguuuguccuuuggccuacccaguaccagcaucugguaaggcccaggacuaccuggcaucaggcacauucccggggagcuuuuaaaauccugucagcccugcccugcuuugaaauuuauccagaaucagaccauucucaugcccuccgcugcuaccacccuaguccacgccacugucaucugccgccuggacaacugcaguucccuccuaauuggucuuugugcuucucuccccgucugcuaguauagcagcuggagggacuguuuaaugguggaaguugggucauggcaccucuccgcucgaaccaucugugggcuccuaucucacauacaaaguggacuccagaauccuucguggcccaugaggcccacgucaucuuguccccucuccaaccccauuaccucucuggccucauuuccucccaucccugcugcuguuuuucaaacaugugaagugcagccagccuagggccuuugcacugcuguccccucugucuggacuguuuuccuccagaucuucccucacuuucuccaggucucugcugagaugucaucuucucagggugacauuucuugacucuucuucuccagcacacucuauuaucucggugcugcuuucuuuuucuuuggaguucucagccugacucagacauguuauauuucaauuuguuuuccucucccugcuagaaugcaucuccaugaagacaaggaaccgagccugucuuguucaaggcuguacuucuagugccuagaauagugguuggaauaaguagguccuaaaaaauaauuauugaauuaauuuauuaaaugguuaguugagcucuaugauuuucccucuuugggacucugccugagaagccaaucagcugcugagaggucccucccugcaucugagggagccugggagucucgggggcagagggcugggccuuggguacuccggcugagggcuccccaaagauuccucuccaguuugggaaccaccggcauccuuguuugucucugcacuagcuuccagucaccccuucuggggaauuaucugaaaacagacauuuucuaucucaucugcccacaaugacaacagugaauuaaaauggguuggcuuaccagcuaaacauuggggauauucaaaugcccauugaguucucagagccauacagauacuggcaguagccagaggagaugucauccaugcuccugagggucucccuguagaguugcagcuaagcugugcccagaacaauaggauucacucaaugcucugggaugugauagaccagaaggagagaaacugauguugagugaauccuuccugugugugguacacagccacagugcuuagguaguacgaguauuugguaaugcccaggacuaccuggcaucaggcacauuuccagggaacuuuuaaaauccccucagcucugcuuugaaauuuaaaguguuacaaccuugagguugauaauggugugcccauuugaugggauggggaaauuaaggcucugaaucgaugggaacaaggcuuuuauggaccccacagccuuaggaguaacugagaaaggcuccaaggaaggacucauaagcaggccaugaaggaccggugguauuccugucacugaaacagugcagccucaaguguagcacagauggugagguacgagugcuguauaagguggagcccggaugguuuugagauggcccauugaguaugaacaggugugucuuccuuuuuccuauuacugauuaccugggaacagggagaaguuuuuuuuuuuuuuuuuuuuuuuuuugagacagggucuugcucuguugcccaggcuggaaugcaguggcgugaucucagcucacugcaagagaggguguuuuauuuauuuauuuauuuuuauuuuuauuuuuuugagagaauguuuuaaaugaagccccagagagcugaggaacucuggagaaacccuggcaucaacucuccuccacacaggaccugugccuucuuggugucaccagggaccaacccagccaaugcuuaucugaguacauacagcucagccucuagucuccaggagcaauggagaguaaaccucucuaguguuggagguuuuguggauggggaagacagaacauugcuauguccagguuugggggauggugcuggcaugcuucggcccuucaagcccuuaugaaauaaaugcuucuugcuacucagcccauguagugggauuagagcuguguguaguacacagccacaaagcuuaugugggcauugggggcgggggggccaaaagaggcaccugucuucuuguagccaguguaauugacuuguucauauaaucacuuguucaucagccuuuauuagcuccuacucugugccagguggcaccaugccagauccuggggccacaaaaacaaggacaucuucagggaauucacaguccaguguggggagauggauaaaccaaagaugacaugcaguguaguggggacugugugacaugaaagcaguagagcugugguguggaacuuacggucacaaagcuuuaggguggcaggcuugaguuugaaugucauccuaacccagccacuuaccagcuuugacuuuggggaaguucuuggucuguguuaaguaguuauauaccuuagcucauuuauucuucaaaucuaucuagugagguaaaaauuuucuccauuuuguagcucauuucguagcugaggaaauugaaacuuggaaagagugaguaauuugucuauggucucucaguaaauaagugacaggaccaggauucuaguccaggucugauuccagaguuccugcucuucccacucuaacaagguaaagagaaugaguuuuguccuugcucccacauggccagggcccucugagaaauuagcucugggacaaagggguuuugguuuugauuuuaagcugcauuaauggaaguuucauccccagaacacaggaggugauggugcugcucugcucuggggagaucacagauggagcacuggggcgcauucaugggucaccccuuugaggaagauguggcuauuugggguccuucugaaggguugacugugaugggcacuggaaaccuugucucccaagcaacagcugaaugaacuggggguauuuuacauggaaaagaggagacccacagggacaugagggcuggcugcagauaucugaagggcugccacauagaagagucucauccucugugaaagcuacagggagaaagguuuuggccccagguuuacaacgauaccuucugaaauauuugggauguagugaguucacuaucaucagagguaaucaagcaugggaugggcuggaugcgguggcucaugcccauaaucccagcaccuugggaggcugagguggguggaugaccugaggucaggaguucgaccagccuggccaacauggugaaaccuugucucuacuaaaaauacaaaaaauuagcugggcaugguggugggugccuguaauuccagcuacuugagaggcugaggcaggagaaucgcuugaacccaggaggcagagguugcagugagcugagaucacaccauugcacuccagccugggcaacaagagugaaacucugucucaaagaaaggaagaaaggaagaaagaaggaaggaaagaaggaaagaaggaaggaaggcaggaaggcaguggagaguauggaguaaaugccuucugccauuccucugcccagaguuccugacugucccuuggcugcucuggauguggcucccagggcagcccuaaggagagguuuagauugcaucucucuccaagcccagaucuucucaauaggcucagcuuugcauguucccucagguacggugggaggaacacaaaguuagaaccagaauuaggagaccuggguuuggauccuggcuuagccccuuacagcugccugaccuggggcaagacauuugccuucucugugaaaggggaucacaucaguccuuccccuguaggugagguagugaguaggaaagcacuuuguuaaggagagaggguacagacacugguuauuaacaggugcagucaacuucagggagccuggccuuccacacacugucugagaaaacuucacccagugguggugacccaggaucugugccaugccagguauuuuagagaaugaaauagguuuuggcccuagguuuguccagagcucucugaaauauguuaucaaaugaguuuccugacaguagcaaugaguaaaagaauccucugcccucaaggcuaguugaguguaggaggcagaaagaguuugggacagguguugagaagggagggauccaggaagccuucguggggaaagugacauuugaguugggccuagacagaggcuucauuaugcaggaaaaggagcaggcaaagguuacagcagaagcaaagaagcaacuuguuuaaaggggugggguaaggaguuccugggaggcuguuuuacauucccuucauuucucaaaugaagaugagguccagagaugggaaguggguuuccuagcagggauaggguaagcaaagguuagaaccaaugcccagcaccucaccuggggcuguuuucaccacgccucaagggugcgucucuacucggaagccauuucuccugguucugccuccugccaggcuguucugucuuaaggaggaaaaggagggagcaaaaguuguauuuaccaaaggagcugguugggcaggucuccuuuccgaggucaaagucaaggccaagguuggccuagcuggcuucuggggggcggagccaggccuuggcuggccaccaggucaguggggggugugggggaugggaggucggggaggcuuuugguugggagggagugaucacugguggggacugagguuuuuccaaggcauugccccugugaacagugggcugaaaagauuacagcccacacauucuuucucagcagauuagggccaugggagauuauggaauacacaggaggcuguaggaggccugcaaauuucccauuuggggcaauuaauuugauggauuguaaaacagcucacugcuuccucuccgccuucccugggcuggguugggcugggcaguaagacuggcuggagaauguggcuggaaaugcccuugccgguguucugcaguaccugcuuggaccaccuuguuaaaaccuucucugggcaggggcucggccugccccuuuccugccucccuuccugguacaaggaagaucauauaguaggugcuacauaaagcuaugcagagcugauacuuaucugauuggggccuuuccaggauguugguagagguggggcucaugguggaagcucugguuuauagauggggaagcugagccccagcggugaagucaccugcccaagguuacucagguuguuggugacagcugggacuccagccagguuucucuacuccugggccagggcgucuucuccccacuugugugcucaaagugaaagugaaauaaauagugagcaauuuuuaugguuucucuccccugacuuccuccuugccuccagccagucaguaggguccccacuuuggugacugugggcaaggugugacaugguucugcuggcaucuccccagcagcuuugcagcauucccaggagggcucugguggggcugcacuuuucuuauguacucaaaaugugucugggcucauucgaugccucccuucuccauggggucuugcaccugugauuuguaacagauucuugugauuaguccuuucucuggugccuccuaaagaccccacugucaccaacucauaucugcagcggugcagaugguuccgacugguuuucuugccuccauccuguucucccuacaggggcccaaauaccucauccugauaugcuuccugaugagggccuucagagguguccugacuugggcuucucuuccugugucuguguccuguuaaagcacaccauuccccucuggccugaacacacuccacaacaucauaagcuguagcacucucuugcuucuuugucuuugcuuuuguaggaaugcccccuuccauccagguaauuccuaugcauccuuuaagacucaggcauuaccugggaagccaucuguggccacccgccaucaaggguuugugauaucccuccauuugugcuuucauucauuuaguuagcagugcuuucauucauuuguuauguacugagaagcuuuucugagccugacaguguuguacugaggaguacaguagugaacaaaaggagggugccugugggcauggagcuugcaugcuagcauccucucuugccacauaucaccuuagucuguguaaugucucucugucucucccucauuagccugugaauuaucuuuauguuugauugauucacauaucuguccccagcacucagcacaguauuaaguaacaagcacaguguuucuucaagcaagaaaacuuaaaauguuaaugcggaaugaacggauggauaagugguuccgccuucccugccccucuuaggcugucuagcuguuguguguggcuguccccacccccaccccaagagcucucuugccccuugcacucuuggcacugcauuugcugcucacgugacuguccugcuucauguuacaccuuuuugugucuacaucucucucacauuguuguaaauuucuucaaggcaggguccauucuaguucaguuuuguguaucuggaauuucuauacuugauauuagccaaaagguugagaagcaaguguacuuggaauuucugccuguccucacauucaguaaaaugaacagcaauucacaaagcaauguguaaagaaaucaaaauguaaggacacaacuaggugccuaggaguggguugguuuauucauaaacguguagugggcaccugcaugccaacccugggccaggugcugggcauucuuagaugaaugaggcagaggcaucugccucaagggcuucugaaggcuuccuuccuugaggaagaagaacaugcagacagggugaggaggugcccagcccgcuggcacccaagacacuuaugguauaggauauccggauccuuccuuuugaugaaagaagaugccaucacagaguuaagggggcugucaggccucaauuuuaaucccacuucuguugcuugccagcugugugaccuuggacaagugagucaacuuuucugagcuucaguuuccacaucuauagucaguagcuaguaagaacaucuaccuuguagggucauucauuccuuuauuaaaugaauauuuauugagugccuacuuggagccaggcauuguucuaaaugcugggaugggauagugaacaaaaucaauaaaggucucugcccucauggagcuuacguauuagcaggagagaaagagagcaaacgaaaugguuaaaauauauaguaucagaggaugguaagugcuauggagaaaaaugagcaggaaaaggagacaggaggccugggugugagaguggaauggucagaagaggccucuuuguggagaugacauuuggguagagaucugaucaagccauguaggggcaggacaugccaugacgaggaaacagcaaggaggccagaguggauggagcucagggaguaggaguugagacuggagaggugcaggcccuugacuugagcuuucacccugagucagcagagaauucacuggacggcuuugaacaauggaaggcuuugaacagaggaguggcaugaucugacuuuugcuuuagaauaaggauaauuauucuaaauauuuauucuaaauauucuaauuauucuaaguacuuauucuaaauauuuuaauuauuuaggauaauauucuaaaauauacuuauucuaaagaaaagucagaucaugccauuccucuguuaaauuaugguuguuguacguagaauagacugauuaaagauaauguagguagcauguuuaacacaguaccugguaugaaauaagcccucauuaaaugguaguuuuguucuucaugauaauauuauuuuaaaauucuuuuuauuuuuuauuauuuuuugagauagggucucacucuguugcccaggcugcagccucgaccuccugggcucaagugacccucucaccuaagccuccugaguagcuggggccacagguguaugccaccaugccuggcuaauuguuaauuuuuuuuuguagagaccgggucuugccauguugcccaagcugggguaauauuauuaaagauggaccugggugccuucuagucuuggccugggcccucauuccaccuaucuucugcccuuuugggagcuacggcauccagggagccuucucccugaggaggacagugaugaguauuggacuugggaaugagcagggagaaggugacugauucuuuggcuguuccugccuggaucuucuguuuaguagucauggugaggcgugguggugcggcaguggagacaggagaagaaucuuggccuccacaaaucuagacuggggagcucaaccugcaggccagaagcugccaguaaacgagaaaugccacaucagcagcccuaugaauucugcuuuuccuaucugguuguuaggguucccaggaggggcuacagcuguaccccagagcugcccuccuccucccagacuucauggugggcaucccuccucacuaccuccaucccuggaaucucaggccuuuauggaaaggucucaagccucucacauggucugaugugguuugccuauucaccugauauagagacuccuucggcagcagugcugaccaaacugcuucugcucaaugacuuuguauaacagggagaguucacuaccucacaaggaagccccuccuguaauugucacauucucauugauaggaaguuccauuucagguugagcugaaaucuucucugcucugacuucccccauugcuuuugguucugaaauaagagugagucaguuauaguccucuccaaccuucccauccccugugcuaccuccaugaagcaaagguuuacuggugucccaagaggcucuguucaguucuugcucuguuacucagccugaucaucugguaggaggcccaggaaagcuuaauagagcacaugaugcuugagugggcuccugaagggugaggggugagccaggucaggaagggaagaaaggccuuugagucagaagguaaggcagugucucgaaauaguguguggaguccaggaauccuagauaguucaguaucucuggaguaguugggaguuucucucucucucucucccucucucucucugucucucuuucuccguguguguguguguguguguguguguaggggauagugagggaggugaagucugagagguaagagagguagacccaagcuaaagcauggagggccaccugugccugggucaggucguggacacagguggcagaggucagagagcugcacaggaggacggguuuuagaacugguuuguuuggggcuccgguaccacggguuucacauuggccuagagcugaugaauggcuuucugagcaccacugacucugcuuccugcuuucgucuaggguuccugauuaaaccuguccuugagaucucuguagagugggacagggacaguaagcacuuugaaugugcuagucacccuggacauucuguuucugggcucagcacuggaugagccaggcuuucagccccugcaccccuuuccuggguuggggugggggccaggugcuguagccaggggcaacuggcucgccucaagcuugccugugucccagagguggcuggacacacaggucugucucugcccugcaagguuucugauuuaugcagggagccugcauuugcccuuggccaaauucuuugggcauaaagcuuuuguaaaggggcuuggggcccuuccagggcauuaacaguuucuuuaugccccauucagauaucuauuuguaucugauuuuuauauauuuccaaaguacuuucccagcuuccugggggagacuuguuccccccagccuggccagaucauugggaaccuucuggcagaccugccucacgcugcuggcauauggaguguccucucaccaccgucuguccuuccuggugucuugcaugccgaagggccgaggguggagugggguuuuuuguuuuguuuuuaaauaagggcaacguggguaaacagagcaguguuucuggugccuucggggagggccaggacccugcauuccggcuccaugacgacagccuguuugguugccacuugcugggcugugggcagcagcaguucagacggagacaaugguggcucuguugaaaugcugcugcugggcucuggcagaaugcauuuuaauuggacauucuccacccuggaaucuguggggaucugguggcccacuccuccucauuccuucauuuuucucuuugcaacucaagagccaaguuauugcagcuccuuccccgccccgccccccaaccccgucuacuauuagcagccucuugggggaaaaugguguuucuagccagggcaugguuugcacugggcugacuggaaauagugagagaaagggagaggguagggggcuggaggggcugggagauauccuguggccuguucuggagcaucacugaggggugaagagcagcagguguuccaggaagcucuucucuuccguggaccaggguggucaggaacacuggcucugaagucaggccaacuggguuggaauccuggugguagcacugccagcugaaccucucugugccucaguuuucuuauguguaaauuggggauaauacuagugucuacucguagaaucauugugagaauuaaauuaacauauaugaaguacucaggauaaucauaccugcauguaguaaacaccugauaagagccuccaucacuauauuuugucauuuuaaucuuauguccuggucaucgauauuccauuccuuguaagggccucaucugagacugcaggaggaacagagcaacacucuuucuaaaaugcacauuugcuuuugucacucccuguccuagacagccucagugaguccccauugaucucucugcauaaagaggagggacuuguguuuauugaagguaucaaaggccuacuaugugcugaguacuugguguucuuuuagauuagcuccaaaguagacacugauaugugagacccuucaucauugggccguaucuugcugguuuguuguuguuuuugagauggaauuuugcucuuguugcccaggcuggagugcaguggugccaucuuggcucacugcaaccuccgccucccggguucaagcgauucuccugccucagccuccugcuaauuuuuuuguauuuuuaguagagacgggguuucuucauguuggccaggcuggucucaacucuugaccucaggugauccauccacuuuggccucccaaagugcagggauuauaggugugagccacuguaccuggccaucuugcugguuuuuuauuccccuaucccccccaaaccaaaccaaacaaaaacauaacuaccucaaagaacagcauguucuucucugaugucucaucugcuuucauccgccaugccuuacugagcauucugccuucugccaggauugcccugugggaggcggcuguggauccaggaaaacagacuggacuggggagugucuggggauuuccuuaccauucucccccauggggcagccuguggagagcccacuugccaggcucucucugugggaccagcucugguuugaauccuggcuccaccacuaacuguguggcccuagacaugaccucagacuagugcccgucucauacgcuuguugaugagauaauccacacaaagccuugaguacagugucugacaugcugcgagggcucagcagaugcuagcuguucuugcuauugugauucuucccguuuucuguuuggaaugucugucuuucuaggcucaaugcuggacugaguuucuuugaaggaaacaagcauugaagagguuccauggaucagggaggucuaaguagggguuccuuuguucugccuugcacuuccuguggcuguuggucauuacugugggucguacccauuuuugccucccucuagucugccuguggcaggaccccuugcuucucagccacugaguguaccugccaguguggccacuccuugugggauagcuggggguagacacagguuagccuuacaagauguggagacccugccuguguacacagaccugcuugcuuaugauggacuugccugugaguuaaucagucacuagauagccaaaugaggagaaauauugguagaccaaagagaauugcugcgacucaagauuagccagagaaaccaaucucugugaaagaaggaggaaauaugucuuuuuuuuuuuuaaucuugcugacuuuguagggccagguucucaaaguuugaguauuuugcaaguauaucuccauugaaaacaacaaaaaugguaaaaggcuuuagaaaggguuggaggaaaaaagaauggaaaauuuuaguuucagggagcuauggugauguaugguuuaugccaccucaguuccccuauuauuggguuuaauauucaggagagcuagggcaucauccugguucugucacuaacugacugugugaccuugagcaaggugggccucagaucccaugucuguaaaaugggaaugucuuacccugaagguggggcuggagcuuugcucugaaggugguggggguggagguggaaugacuugaggcacucgaguaaagaaucagguugggaggcuggaugcgguggcucaugccuguaaucccagcacucugggaggccgaggcaggugggucgugagguuaggaguucgagaccagccuggccaacauggugaaaucccgucucuacuaaaaauacaaaaauuagccaggcgugguagcgcgccuguaaucccagcuacucgugaggcaggagaauugcuugaacccgggaggcggagguugcaaugagccaagaucgugccacugcgcuccagccugggcagcacaacaagacugcgucucaaaaacaaaacaacaacaacaacaacaaaagaaucagguuggaacuuuacaaaucuuguucugguggcuggggagggaggccuguuuuagaggaccccugugaccauaaaaugagagaugauacaggccugaacugcagcagggugugggcgugggagacaaggggaggcauauuuguaugaguacuuguguguguuuauauguauaugcuuugggaaaggguaaacucuguauaugcacauuggauaauuucauugcuuauugagguagucaaaaguacagacacccagcaguuccaucacuauggugacuccguccuuccaggguaguaaguagacaaguugcaaagguaugcauacagggauguucauugcaacuugcuuauaaugcuaagaaauugcaaacaaccuaacuggccauccauuaggaacugguuaaugaaauuucgguaccauccaacuauuaaaugaugcugcagaucuguuuuucuaaauacagcaagauacacauguacaucaaaugaaagaauggaaaaccacacgugcagcaucuagccugcuaccacuuugccauuauucucugugauucuaaagcccaucaugguuggguuugcucaggccugcuacaccucuuucccugugauugacuuucucucucuuguuacucauguaacuguuuugcaucaggucucugugaacaaggaccaugccuugcuuuuguuucccguguuuccuucaagcaauaggaguagguggccacuaauuacugcagaauuuaauugagggacgugaacaaaaggccuuguuaucagcauuaagugauauuaagcuguaggcugauucucccucucuuacaaaauagaaacugugucuggcccauaaagaggcuuuuaaacuaaaguuguguuaacaaagaccucuuuccagagaccucccugcuugaggggagcuggaguaaauucaggcuuuguuuccucugucuuagggagccagcuggaggugaggggacaggaggugugccugcuguccaaccgauuuuaaugcacaagaucucagucaguggguuuuuguuggaguggcaaagggggagggaaagccuugccucaagucugcugggugcugggccccugauguugucuuguuucauccucacagcagaccgaggaugagggaaauacucuaccucaucuuacagacaaggauaccaaggcucagagagguugaauaacuuacuuaaguugcccagcuaggaacugacaaagcgaggauuugaccauacugugugccuugaucuaguuaccaaagauccuagagcagcuacugggccacagucugggcacuuaggcauaguugcugagcagguuuggcacugggaugaugggaaaggggugggaggcucugaguuggggcaggaugggcguuaaccagcuagguauuuauuucauaucugcuguguaaacagcauggugcugggcacugaggggauauggagaagagggugacaccguccuugucuauuuaaccauuugguugaagucauucauucuuaccuaaagaaauacaccaggggaucgggagggauaaauaggggcauagaaaacaagagguagaggaagucugaaaaggcacaguuagcaggacugacauggguggggaagguuucauugaggagggagacgugugagcaauguguaacaguggaaggucugggcugaagugggggcucuugaaguugagaagugggagccuguuuggaaagggaaggagggagguggucaggaggccuugggcacuggauccaggaguucucucugauucucugaguaauuaggagcugucguaagcuuuugaacaaggaguugacauggugggaaacaguuugaaggugauucuucuggccaugguuuguuuaaagugcagagugguggagggagagaggaggagguuaccucauuuuucuagaaaguuuacccaucugcaagauuaguagugagagggauggggaugcucuggcugaggugcacugggggaucucaggucuugacuuggacaguguggugguaggaagaaacagauagcuguguguucuguguccuggaguguaacugcacacugccaggugcucagcuugaauggcuggcaugcaagcauacguguaugcauccauucagcaauuauuuauugagugccuagcauggcacaugagcuaggcuuaugguagugagcuaagcaggcaugauccccugccuugggucuggcuuuaaaaguaaauguccuaugagaccaaaaaaaugacaggaagacauccgaaccgcucuaagaaaacaguuuguuccauagcuugguugugccaauagagggaaagcauuacuucucuuugcagaaguguggcuuacagaggagggucugggacagaucuugccuagagggcuggggauuuuagauagcagcuaguccaaccaccuucauaagagggaaguuaaauagggccucacagaaguuggggaaauuccuucaaguuguacagcacauugcuacgucucugugcuugucagcauucuggccccguaccacaccgucucugcucuauggcugagccagccuuucuagccuguuuucuccccuugagugagggaagaggggugcuggaggaaacaaggggaauaggguagacuauuagaaauugaauaagaaaaccauuuuaaauagggcaaaccacagaggagcacucucccuucuucugugggcuagggagcccccaucagaauuucaaagagacauugcauggccucugaucuuugccaauuucccaaaguucauagcuuacucccaggccuuauuucuuaaggccuaggugguggggaccaagaugucacucacucuagaaugccaaauacccugagaaauuccaggggcuuucuuuuugagccuuggggcucuggccaaauagcuccugguaugguugcagccucagauccauugaugaguaccuaugccuggcaagggcugagccaaaaggggccagagggaugcagaccauucaugaguacagccccuuccugaggugggggccggcuagcccacaagcagcuaugcugagccucugaaugaugugaguccuagaauggggacccacacacaauacuuugcuagcugagagaauaacgugauuguggcuggaagaguuacagauggcaaaauuggagcuuuacuucaagcauuuaaaaaagucauaaaguuacuuauauucacuguuguaaauuuagacaaugcagacaagcaacaagaaaauaaaaaucccuuguaauccuaucacccagagauaaucccuguuaacaucuuguugucuaucucuguguaucuauguauuuauauguguguuuuaacaaaaaugggauaauauauaguuuuguauuuucucacuuaacuauauaguuuucucucucggcauccauuggggauugguuccaggagcccccacagauagcaaaaucaguggaugcucaaguuucuuacaguuggccuccauauccauggguucucugacauggaacccauggauauggagagcugacuguguauuugaaaaaauauacauguccuuaauuuauguuuaucucaucaguuuuaauggcugcauacgauuucauuauacaguugaauuacgauuuacuuagccaguaaucgauaaaauuuuuuggaguugucuuccaaaagggaguaucuuuauugugguagcugaucacaaaauaaauacaugcuuauguugaauuuuuaaaaaagcuagucucaaaagguuguauaguauauuauuucauugauaaaaaauucuugaaaugacaaaauuauaguaauggagaacagaucagcggaagacuuagaagaggguacauuucuuugaagugguggaacuguccuguguccugauugugguggggcacacaugaauguaugcaugugaugaaaucucauagaacuguacauauauacauaguauauauaaaaaccuggcuucuuuccgcgccgauagcgcucacgcaagcaugguuaacgucccuaaaacccgccggacuuucuguaagaaguguggcaagcaccaaccccauaaagugacacaguacaagaagggcaaggauucucuguacgcccagggaaagcggcguuaugacaggaagcagaguggcuauggugggcaaacuaagccgauuuuccggaaaaaggcuaaaacuacaaagaagauugugcuaaggcuugagugcguugagcccaacugcagaucuaagagaaugcuggcuauuaaaagaugcaagcauuuugaacugggaggagauaagaagagaaagggccaagugauccaguucuaagugucaucuuuuauuaugaagacaauaaaaucuugaguuuauguucaaaaaaaaaaaaaaaaaaaaccugugaaaucucugugaggucuguaguuuaguuaauaguauuaccaugucaguuuuucuguuuuugacaauugcacuauuguaauauaacauguuaucacugagggaagcuggcugaucgguacacaagaauucucugaacaagaagauuagcauggccccugcgcaaggaugacacgcaaauuugugaagcguuccauauuuugcgcagucugucaagaucauuucaguaucugcuaauuagcacuaaggaacuagugugaaucuaagcaaaaacggguggcacccaaugacgaaauugugguuuucauuaccaaaaaaaaaaaaaaagaauucucugaacaauuuuuuuuuuuuuuggagacagggucucccuuugucacccaggcuggagugugguggcacaauccuggcucgcugcagccucgaccucccugggcucagguaauccucccaccugagaaucuuacccacguagcugggaugauaggcgugcaccaccacaucugguuugaacuauuuuaaaauuuuuaagugagucuuaaauuuucuuucagagugaaaaguuuaaaacaaauaaaaaugaaaaaugugcuuguugaauaacauugacacuguaaaagguaugugaugauaaagaagaacccuuugguagaaggugggagaggggucaugcaggcucaagacaauggcaggaauguccuggggguguccaagacuguccaggacugggcugguccacagggaggaagugggugauguggcaggaguggauagucacccgacugaacagggccuuucauguuugauacucacaguggauggggaggaacacuccagagggagacucagguuggagggcagaguggugacaggggagggcauggacuuuggaggcagacagggugggcucaaggcauagggcccaucauaggaagcagcugcucagucuaaguuccugucccucacugauccccaggccucaccugcaauugaaugagaaucucugagguugggucccuggcaguauuuuccuuuaagcccccaagugauuuuaaugugcagcgaggguugagaaccaugugguuagacucuuucacaucaugauucagcacagugcauggcuuuuaaaaggggcaccaagagaaacuucucuuuucaccucugcugccaucaggggagaguuugaggcaguugcaugguggugugaagggggucgaucugggagcccugugugguggucccugccaagucugaugucuuuguguugguggcccuuuacuugggauucuggcccccacaucaccucuuuaccuuguguggggcaugauuugaacacugcaggugauggcuuucuaguggccuguguucuugcccaucuggagggaagaaggggcuggaaggcccugugagagagcugaucuggggcuuggcaagugccuggugggaucagagggagaccauaaaguacauaaaaguacacauccaggcacuuuuugggucauauggugcuuuccaacaugggcccacccagucuucacaauaagccuguaaggcagaugggccagaaauggagaaaaagggaaacagagggucuuugauucaaggaaggagcaagcgagagucaagccucucucuuuuggcuauuaauccacuuucuuucuauaaaaccaucuaggccaauggauuuucuggaggccuuggggcuuaugccucuuuaggaaacacuuuguuuuauuaugucaagguguaugguuacuggccgagguuucuaguuuuuuaggcauuuaugaaaauccagcugcugagucacagcacguguguaauuguauugguaaguuaauggcuauuuauguuuggagguguuuggaaaacaagaaggaggcaagauuuuaaaauauguuuugaccagguguaguggcucacaccuguaaucccagcacuuugggaggccaaggcaggaggauuguuugagcucaggaguuugagaccaaccuaggugacacaggaagaccuuaucucuacuaaaaacugaaaaaaaagaaaaaaauagccaggcaugguggugcgcaccagcagucccagcuacuugagaagccgaggcaggaagaucacuugagccuggagauggaggcugcagugagcugugauuacaccacugcacuccagccugggcaacagagagacugguucaaaaauaaaaauagcugggcggagugacucacgccuguaaucccagcacuuugggaggcugaggcaggagaauugcuucagcccaggaguuuaagaccagccugggcaacaugacaaaaccccgucuguacaaaaaauacaaaaauuagcugagugugguggugugcgcuuguagucccagcuacucaggaggcugagguggaggaucaguugagccugggagguugaagcugcagugaguuaggaucaugccacugcacuccagcgagggagacagagugagaccccaucucaaaaacuuaaaauaaauuugcugggcaugguggcucaugccuauaauccugacacuuugggaggccaaaguggguggaucacuugaggccuggaguccaagaccagccugccaacaugacaaaaccccaucucuacuaaaaauauaaaaauuagccagaugugguggcacaugccuguaaucauagcuacuugggaggcugaggcaugagaaucaccugaacccaggaggcagagguugcaguaagcugagauggugccacugcacuccagccuagaggacagagcgaggcccugucucaauaaaaaagaaaaaaaaaccaggaaaaugauaagaguccuuaaugacaucugcgaaaauaucccuucacuuaaaaauaaaaaaagauauuuaaaaaaacuauaaaagaaaaaaauagaauaaaaauguuuuucucuguauuuguauccagauaauaauucaaauauguaucuccugcccugaccuuucuuggguuccagagaaacauuuaacaaagccccaaauacucaacugaacuuggauaugucccuggcaccugugugguaauaguaauagugguuaugguaguaauaacagcuuccauuauugagcguauccuauacaguucagcacuuggaacucaccuaaccuggaaagguugcugaagagauuaaauaucuguauuucagaaaucaaaccaaacaaaaaacuuuugccacuuguuggcuaaauuagucaugacaccucuguacaguggauuauuaugcaucuauuaaaaauggugcugugaaauauuaacuaaggaaauggaaacuguucccuguacauuaguagauaaaagaaaauuacagaacaggcuggcauuuggagguucucagugaguguuuaaauccacuuacauacaaagcuauauugucacucuccuccuuuuauuggugaagaaauugacuuguguaaaggucaugcagaauuuuagaucugggucuuuugaauuaagacugaagugcuuucuuugugauacucgucuguuucugucuauuaaaaacacaguaagauauucucuaaucaaggacucauugcuaugcucagaucagaaaaguccgggagaccuguuugacacccacauuauuuuguuugcauagcucuuuacaguugauaaagcacuuuaaaggauauauaacuuuuucugauuuuaaaagaugaccuauuuauuguauaauuaggaaggcagagaaaagccccaagaaggaaaaaauauuuauaauccuguagguuuaacuacuauuaacauuuuuuucuuccugucuuuucucauugcaaauacaaauuuuauaaaauugggaucauguuguacauauaguuuugauucuugcuuccuuaacuaaucuguuauagacaauuccucguuaauuguucuucuacaaugugauuucaugcacaguaucuaguuuuuguuuuuguuuuuguuuuuuuuugagauggagucucgauuuguugcccaggcuagagugcaguggugcgauuacggcucacugcagccucgaccuccugggcucaagcgaucuuccugccucaaccuccguaguaucugggacuacaggcacacaccaccacaucuggcuauuuuuuuuauuuuuuauuuuuuacagagacaaggucucacuuuguugcacaggcuggucuuaaacuccuggacugaagcaauucucccugccucagccuuccaaagugcugggauuacaggagugagccacugugcccagccuacauuuucucuuuugauccuuaaaauaacaccuugaagcugguaggggaggauuauuauccccauuauaaagguuggaagcugaggcuucuagaaguugccauuuguucaagauaagaaacaacuuuggagugagaaagggaauugcuuuaauccagugagucugagggaguggaguaggagguagguucagauucaucuguuuuguuguauuauucaaaguucugagaaaacccccuuucuguaaccucuaccaauguccuggucuguccucuguccccacauagaaaaaguuuucaccuuuuaaguguuugaagaggcucccauguggcccuauguguuuuccuuuccagguuaaaucauccuuguucccucaugaaacuuggcuuuuaguuuacucguugucuuugacaucacucugggcauauuccccuuuagcuguaauccucuuaauaguguauguacuaguaagcucuucagguugaaagugacagaaacccaacucaaacuagcuucaagagaaaaggaaggauauuggcaccaguaucugggaacucccaguguaauccugaccuggccuuggcacuguuggacucuggugcucaaagggcauuuugggggcccugccuucuccaucuuucaagucugcuaacucuuuugucaaggaagagaaaugcucacucucccaggagcuauacaucucuucuuaggggagauuaugauccccugcuuggaacaugggccuguccuagggguagagcgugguggcugaacaguugcagcaugacgauaugggaggugugacuucugccagugaagggaugcauaugagcaaugcauguccaucauauugcaauauguagaauuggugacuggccagcucagaauagcaugggaucaucaucugucuuuuccucaauaucauacuugaaucaauucaaccuaaaaucaaaauagguucccuauuaagauguaaucauauuacaucaagcacugcugcucagcuucucucucuccucuuaaacugcuggucucaaauuuaggucuuuaagcuuaucucuguuagauuccauauggcuguauuagguccagagaaucagcuuguuaagaucuuuuagcucuaauucugucaucuggcuuccugcuucucccucacagcucaagcacucugcagucaggugauaugaugcaacugacauuugggaguggcggggaugggagaugggaaagugagacagcaccaggcagucaguugcaucaaaagagccagaaucuucucucaccuccucccacacacccuaaaaccccuucaguuuccuuugcauggcccauaagcucggccuucuggguucaugauauauuaaaggucaccaggaaggacaucacacauucugcuuuuuuacugaggcccuaaauggacuuaaguaggaaggaccuagguuagacauuaagaacuucuuggcauagguggguauggggggcauauuagagaaagcaguaguagauccguuucuggaggcugucagguacuagcguguuccugagaagucugcaguguauagaguguuaagugggggaugugaaaucccuaugaggcuuguugaguuugcaggccuaucaugccagccauugcaugcaagcgcuguugguggugggggagucauggguguacuggauggcuuuggccuccauugcucuauugaagacuccaaacuguguuguuccgcugcaaaaauuguuuuuuuccauuguaagcaagaaacacaaagcagcccuucaaggagggugugcaggcaugcaauucuggcaguauguugcauuaaucugauguggcauggggugaaccaccccagauggccuggcagaaacaguuggacaacagcauccagaggaccccuggaggacagagggcagugcagagagccuugcccuggaaggaccugagcccacagacauggccaggaggaggccugaucucagcgcuggcuugcccaugaguugagcaggaguagagcuggagagcagccuuuuccauguggcccacuguggagccucgugugugcugugcaugagucucugugcccagagcugagucuggaacaguuucccuugugguuguuugggaggagagggaggcagaucucuacugaugagugucagcaggugugugaggccuccucacuucaagguacguuugccaaaccccucaggaucuuggcaacuguccuuugacaccuagaugacuuccuguggguaaagcccauuagcagucuauucccucugccugcucuagaucucaguugggguuuugacuugggcuaagugggguucuaucuauucuucucccuucuucuuucccuccgucucuccaggccuccuccucacuuuccuauaugcccugagccccucuuuccaugccaagggagaaugggagguagucagacaggaaaugacuuccuuaucuuuagauggguaccucuuucugggcaauuagucuaaagaaaggucugaaguuggcuggugagggguggggugaggcagcaagcuggcaagugugugugugucaaaugggggugccugaaucacucuggugccuggagagcauaaaacaggugcuuguguggugcucauucugggcuccuggccuguccgucagagaaagcugguuuggagugcaccugaguguugcagaaggggagcugauuggagggaggcaaagcaggggugauggaguaggggcuguucucuccuggacuuagggugcugugaggcccaggacucucugacaggaggugacuugugccuacacugugccuugugaggggugggccccaagaauggagggccucauggcauuaagcagagcuguuuccuccccucaccuuccccuguguggcagagacacagcaugaccagcaucgccuagagcuccccagccaaaggucaauuugaaucaccuagauuuuugcuuauuuugcuauaagagaacagaagccaacuuggggaaauccuguguugacugagugguagggaguguggauuagcuggggucugcccuaauggaaugguuucugcgcuauccuagagguugcuggagaaauuauauuuuaaugggaauguucuuuucuaaacuuuaacuagcaaagccacagaagcguuugccaguuaauaauguacuugaugaguuguugagcugaaauuuaacagccaguuuaaaaaauaagguagagaauuuaaaaacaaaggacauugagagcaugugugucuuagaaugcuuucugcauuucuguuggaaucagugauuuugugcugacugggagaguuucaagggccccguaucuucgguggccuuuccaggaggcccuaaggcuuggcuccuuguuccugaaaaguaauuuaauguguagcccauuuguagaugaaccauuucgccacuucaugaagccacaaggcuggggcagcucuucuugcugugagauagcccagugaaggugguggcaguagaaacgguggccugaauucaggcaggcuccagguggacgacagcaauaaaaccuucauggccagagcagggguggggcugacugaaggaauaaagcagggaguggaguuucugcucugauaucugagaugacaaaguccugcagaguuugcucuggaaaagagaaaagguuaaaaaaaaaaaaauccgaauggaaaauuuaaggaaacggaacccaaggcuccacuuggauucugagugguguguguuacugcagauugguaccuuuuguuagaggcccuggaucucaguuacgccccuucugcuuaagcucccaguuuuacuugugcacccuggcuagugacuccagaugccccugagccuugcuugcucuucccaguacccuagugggcuucugguucacaguguggcccuuggaaaugggcuccacaggguggacuuucugccugacucauaucuucaucccucaaggugugucacacuagugguugccugguagauguuugugagauaccugggguguuucuuauaacugugagcagccuagacacacacacacacacacacacacacacacacacacauacaugcacaaccaugccuccagucccauuucugcaucuguccucacucucuccaccucuauccagaguuuuccuucuccugugucuugugcauguguuuguuuguuuuagauggagucuugcucugucgcccaggcuggagugcaauggugcgaucucagcucacugcaacccccaccuccugaguucaagugauucuccugccucagccucccgaguaacugggacuauaggcacgcgccaccacuccuggguaauuuuuguauuuuugguagagaugggauuuuaccauguuggccaggcuggucucgaacuccugaccucaggugauccaccugccuuggccucccaaagugcugggauuacaggugugagccaccaccccuggcccuuucuaccuguuuuauuaaaagagcuggaaugugcugggcaggcagugcacugagugcuuuuaucuggacucucucauuuacuccuuacagccacucacugacauagauacuuaguauuuuguugccauuucauagaugggaagaucgaggccaaaagaaaugaccuaauuugccucagaaguuaaugggguugccacuacucacccacagguaucucugauuccaaagcugagcucuucacuucucggauacagaccucccuuuucugggcuuugagcuggaguaggguaugugucucagggagaagaaaauacacugcccauucuccccuccccuugcaucucugucuacagaugccugucucucacuucccccaggaguaggagaacccaaaggugaguuggcaauagagaagugucaggcacuaaggggaugagggugguggguuuugugaguuauuucccccagauaucuuucucauugccauugacacaauacauuaaaauucagaggaaaaaacuacaacaaaggaagaauuggucuaagauaggggucuucaaaccuuuuuuuuucuuuuugagacagucucgugcugucauccaggcuagagcgcaguggugugaucuuggcucacuguaaccucugccucccagguucaagugauucuugugucucagcuucccaaguagcugggacuauaggcacgcgcuaccacaccugacuuauguuuuuggguuuuuuuuuguauauuuuguagagacgggguuucgccauguuggccaggcuggucucaaacuccugaccucaagugauuugccugccucggccacccaaagugcugggauuacaggcaugagccacuguaucuggcccaaaccuuuuuuuuuuuuuuuuaaaucauguauaucccauuaauaaaugagcauuugccccaacacauguaugcucauuuauaaauuauauacauaccugcugugcuaaugaaaacacacacaauuguaaaaggauggcauaaaaauaaaccugaauagguguucuacuguuuucuucuagaacuccgugggucaucuugagcaccucaggauugagugcugugcacuuuggagaccccuggugucccccaguaucuaaggaaugcucuauuacugcagcgcagugcccuguaagagagcgcacagcuggcuggaccuccaauuucaggugcucugauuuucagaagcaggaaaggcccugcccagccagcccucaugcuuuuugucuggaguuuuaccaaacugaaggaaucccagagugaaacacuccuaguugcuucucugguugcaguccuuugcuguuaccccaaggccccucaggaaguuccaagagugugcagacauccugggguaugagggaaaggcuguuuccuaggcuuggguacagcucaaggauuggugaggauguggagaaauuggaacucuuguguguugugcauugcuggugggaaaguaaaauagugcagcugcccugcuuuggugguuccucaaaaaucuaaauagcauuacccugugauccagccauuucaugucuagguauauacccaaaggaauugaaagcaggagcucaaacagauauuuguacacuuaggugcauugcagcauuauucaugguagccaacaggugaaaagaacucaaguuuccaucaacagaugaauggaucaacaaaaugugauauauacauauaauugaauauuacugagcccugaagaggaaggaaauuuugacacaugccacaacacagaggaacuucaaagacaucaugcugaguaaaauaagccaauuaccaaaggacaaauucuaugauuccacuuuuaugagauaccuagaauagccaaauacauagaaacagaaaguagauuagagguuucuagggccugagggaagggagaaaucggggguuguugauaacuaagagugcuucuguuugagguaguaacaaaguuuuaggaacauaguggcguugguugcacaacauugcgaauauaauaaaguaagaauaagaccuuaaacauaaaagcaaugagagguggcugggggcaggguuggagaaacagguaguuaauucuuuuguccaaaugcagugcaccuacugaucagaugccagggugucccuguccuuuuggauaccugcugccagauuagggcuacucgaaugggacacuuguggccacacccuggucauucugacuggcuguacaaauagcucuccuggcuccccaggggacauguucaucaagauuuaggccacaaaguagggccguuuguucccccucuugccccucuccccagucagcugacgacagcuccaguguugcagcccagcaccccaggauggaugacacaccucccuggugcuccauugucagggcucucugauuugcagaaacagguaauaguuucugucuaugguuuggaaucaugaaguagggcaagacaaguuucuuuggaguuaaauuuagggcuuagaauccaggggguggcugaguaaagcuguauuuaacuccuacuccacccucaaaaaagaaaaaaaaaaguccuaaauuaagcaagguacaaggagccugcagcuaccucaaccaaauuggaacacauaccucuaaaaauaaaagaugcugaagucuagaaaauaccaaauaugguuauaggucaggcacuugcuucucugcuuuucuaaugucaccaucccugucccaguccuggagcugcacagaaguggcauggcccuccucuaggaggacugcacuguguacaaggccuugucuuuccgugauacauccugggucaaggaguggaaggccaccucaucuacagaaaaggaggcugaauccagaggguugcaguggcugccuugcuccucgucacucugauugucuugcagugggaggaacaaguaugcauuugcuucucuuguaucuuuaacucagagcuccacucagugccaucuaguucccaaggcaccaguagccaggccccauaucuugagcacugugauuuucuuuuuguuguuguuguuguugcuucugggagauguggguacaugagacauucuuagaaacacaaguucaggggaggcugccaaaggaccacaucaaggugcuugugggccaggugcaguggcucaugccuguaaucccagcacuuucagaggcugagguggguggaucacuugaggucaggaguucaagaccagccuggccaacauggugaaaccacaucucuacuaaaaauauaaaaauuagcugggcauggugguaugcaccuguagucccagccacucaggaggcugaggcaggagaaucgcuugaacccaggagauacagguugcagugagcugagaucauacugcuacacuccagccugggcaaugguaugagacuguauccaaaaauaaggugcuuguggcuacaggcagaacuugaguucucagggagcgaagacuuaaggugguuuugggucgugaguguugcacaguggagauaauaaccacgguggaaagauauugggcacuuacugcucauugacuggucgccaagagucuuuuuacacaagugaucucacaaccaccccaucagguggacacugugauaaugcccauucagagugagaaaacauaggcuaauuagcccccucauggccacacagccagcgagaggcaaagaugggauuggaauccaggcagucugucucuagcacuuugccaccauguacaucagucauuucugccaaagccacagggcugccuccucaucugaagcacagggcacuguuuuaggaaaaagaaucgauuaaagguugacuugcuuccccccauuuccucccuucugaagugggagugggaucagcuugauuuugcaacguaggcuccugcuuuauaccugguguguuguggucaggccccacaggacauauucgucaugcacuuacuaugugccagacccuuccauagguguuuuacucauguuaucucacagcagccaaugaggcaggugguacugauccuaauuuacaggugagaaaacugaagcacggagaagugaaagacuugccuaaguuaaaucacgaauuaauggcauaaccugaauuucaucucaggaccaucugacucaaaaguccauggccuucucacccccucucuggaagaugccaugggucugcugugaccuuccacacaccgggcccugccagaauccugucucucacuuugaugaugccagggugugucugaggaccaagguugaaacaacucuguccccuucuggggaugaugcugcccaggggagaauaacagcucaggaugucacccuccaggcacagccaggggugggugcaggguuggagggccucuuuucugggccacuucuccgguugccuguagcccguaauuguaaacucucuggagcucuuggcugccuggcuggaagcugaggaaggcucauagccuuugagaggccagggcuggugugagaagcagguacuuuucccaucuuugagucuuacucuccgaugagcugagcauagccuggcguuaggaccaccucaaggcgcuugggcggccuuuccacagcccugccuggcugagucgccaagauucuguccuuucuucuggagccuuggucauccuagugaguggcagagaaaccagcugggacuggggauggggacagggugguuuggggaccucacugaggaaacuucgcugaaugacccgauuuuucuaaaacuugaggguuuuguguuuuggauuuggaaaaaagcugauaaugaggaggaauguuucagagaaucaagcuuuuuagacagagacccccucuugggcacggggcaguggccuuccuugagugggguggagggggacuugcuggcugggucucuuguuguggaggaaagacaggcaggggcugacguggugaaacgaagcuggaaguuucaggaugagcuuggguucaaggaguuguggguaacuggagugagagcugcuuucccagccuaggccagcccccugugugccucgguguccccaucugucuguuaggggugaagguagggucccucauggcaguguucccacccuaaggcauugggaggccucagccaugggguguagcuguuacacagucguuguuguuuguuauuuauuauuuaagcaccucuccuguggcugagcagggacccagggguugaguaucaccuugggcuguggcuccccuuucuccucuuugcccugcagucaccuguuuauaguuagcaccuacuguugcaggggacucugugcuggauacuucacaugggaaggucacagaugagggaagggccuuccuagaaccccuagggcgacgcuugccucaucugugaccuucugcagugcuuguuucugcccauggcgguggaggugggugggguguguaugucuccuucuuccccugccccccaacucagagcucaggcaacguuugaguaaauacagggagaauuuggaaucuagauggcuuaucucauucccacuuccuggcccagcucaggcuucuggggcccaugccuccugcucugggugccaggcacuugggaacaguagcauguuucuccagggcgggugggacuugaguccuggacuuggguccuggcuguggaagcaggggagcuggugggggugcuaugcauucuggacaaaagggaacagggucagcguccgggagugaagggggccccugaaaggaacguggccuaaaguggagagugaagccggagcagagcagggcgugagaaccuguguggauguggaggcgugugugcacacacacagccugggccagcgaaaggagggcacaggagugagguuggggggcaggaccugccacugcacaucuucuggucugucaguagaucccuuggggggcaguagguuuuagcucugacaauccugcagccuuaccugggcuccuucaguugggcuuggcccggggaggcaggcccugccuccugguaccuggggggaaguagguacaguccuccagggcugcugaggggagcccgcaacccccuccagaagcagguuuuaugggagagcuuuagccaggaaccacacacugauaaagaaguguuuucauucucaggggcguuaauuaacacagauuagauuucaacugaguaggccuuuuguugcuccagccuuucuaucaaggugguuucaauaccacugugguuucacggagccaauucagguucauuauucucaucuguuacuauccuggguguucagaccugauguuacuucuuauggcucuccuuaguccacuuuuucaaacuugauucacuaugggccuggccucucacacaucacccucauugggugcugaaccugaaaaaagauaauccaagcauguaggcacauuucuuggcucugugaauuuuauuaaacguuuacaaacauguuuucugcaguuuccugagguaaucuggcacacacaagacaggauuugaauuuucuuuccaguugucauguuuuuuuaacaguuccauccauucccacugacuggauggagagagauugaaaguggauagacaugggagcucaaugaugggaacucaugagagcaaagaaggaaacaacagacacuggggucuaccugagggggagagaggggagcagaaagauaacuguuggguccugggccuaauaccugggugaugaaauaaucuguacgacaaacccaugugacauguguuuacguauguaacacaccuucacauguacccacaaaccuaaaauaaaaguuaaaacaaaaaacaaaaaacgaaacaacaguggugucagggaagcugggcuaacgucugaaagggugcaauggcagguggccagccagcaaguguaaacaaaaggagcuuccuggcuuagguagggcucuaggccucuuuccccccacccgccuguacccaccccagcauugacacuucuguuuuuccaauggguacugcccauucugcuucuggguuacaguguucaucuuucuucuucuuuucaguauguuuugcucugguuacaucggcugugcaauugagcaauuagcaaaguagaaaauaagucaccuauaauccuaccauccuaggauuaugauagcuacgauuuuagcauauuuccuucuagauuuuggggacauuuuaaauauuauugaggucuuacauucuccauguauacaucuguauaucuugcacuugcagaauaguucuuuuucuuauugcagaaauaaugcauauuagaccguagaaaauuugggaaauacagaggaaaagcacagagauggaaaguaaaaacuauacuaauuauuccuccauccagaguuaaucacucuuuguggcuguuugcaugucuacgcugccagucuuuccuuucucaugcauauacgcacauuauuccucaccacaacuuggaaucaugcauacacagauauucuuuuuucuguuuuuacuuaaaaaaucccauaaauauugcauuaugauacaaaguuuuccucugaagcgugaccuuuuuuauuuuaauuuuuauuuuuuugagacagagucuugcucuguugcccaggcuggaaugcaguggugugauuauggcucacugcagcuuuagcauuccgggcucaauugauccucccaccuuagccuccugaguacguaggacuacaggugugugccaccaugcucagcuaauuuuuuaaauuuuuuguagaggugagguuuugucauguugcccaggcuagucuugaacuccugggcucaagcaguccucccaccuuggccuccgaaagugcugagauuacaggcgugagccacuaugccuggcugagauaugaucuuaaaaaauuauugagguaaggccaggcacaguggcucacaccuguaaucccagcacuuugggaagccgaggugggccgaucacgaggucaggaguuugagaccaaguuggccagcauggugaaucuccgugucuacuaaagauacaaaaaauuagccgggcgugguggugcaugccuguaaucccagcuacucaggaggccaaggcaggagaauugcuugaacccaggagguggagguuacagugaucugagauugugccauugcacuccagccugggcaacagggcgagacucugucucaaaaaaaaaaaaaaaaaaaaaaaagaaaaaaauuauugagguaaaauucauguaauauaaaauuaacuauuuuaaagucaacaaaucagugguguucaccacauucaugguguuuuacaaccaucaucucugucuaguuccagaauagucccaucacuccaagguaaaaacccuuaucugcuaagccaguuuuucccauuucucucagcuucuggaaaccaaccaaucuaccuucugucucuguagacuuaucugcucuggauauuucauauaaauggaaucauacaugagauaauuuuuaauggcugcuggauaugcuuuuauugaucgauuuaaauaagccucgggucuucagcaugaggucuucucaucauaaagcuagauucugucauauggauauaccagaauuuucuaaccaauuccuuguuuuuggauacugagauuguuuccaguuuuuuaaugccauaaguaauaauguguugaacaucuguaugccuagaccucuuuuuguaucucagauuaacaagaacauguauucuugaauauccccauggaauuuaguuugaaagugguugugaaguaaaccccuuuuuuguuaguuuuuucuucccuugaaugaaaggcucuugccacuaaccuuugggcucccuguugcuuaccugagucuuaucucauccaucagaacaauuccuuagcaggugacuaaugcugcgccuaaagccacggggggaggugauaaugccucacauuacacaaaacuuaaaccuaccacuuuccuugggaucaucugggcugucuuuaucuuucuguucuucaaggcaguguaacuuuugcauugacugguuaaacugcuuuagauugaguugacagggcuggccaguccuugcagaacauuauaaccgccagagaccucagguaagugugauaugcugcuuccugucucucauccaggugcaggaagcaccagaauaaagcuggcugagaugucuuuuauagacagauuguggauuagggcccaggcgggaguagacuucauaccuccuuuggaauccaggacuaugaggauuucccuuuaucccugucacagaccuggauuagguauaacuaaaauacaagcuaucuuuaaaucuuacuguggcauugugagcgugggauuauugaaggaccauuagcugguucuguuaaucaguagagagagccauggaacuagcuggugggaggaacacuaaacugagagucuaucuuugcuguguuaugugacuuugggaaagguacuucuccccucugggaaccaagugguucauacucuaaguggguguuaacuuguccugggggauuacuucccccuucagaauugcacuugcuagugccugguacagaaugaguauucaacacgugcauguggcugggcaugguggcacaagccuagagucucagcuaauccagaggccaagguggaaggaucacuugagcccaggaguucaaauccagccugggcaacauagcacagcccuguuucuaaaaaauaaaacaaaauagguacguauguguacacacacauacguacauacuccucugagcugcucuguuaugagaagagaauaugauuguuuugccuggucccuguggaaaguacaaaaagaacauauuuccacaaacuaggcuacugcguguggucacuuaccauacucaucccuaacuuuuuuguuuuuuuguuuuuggugacugggucuugcuguguugcccaggccuaccuuaaacuccugggcugaagcgauccucuccugaguagcugggacuacuggcacaccccugcuuuuuaagugacuauguauggucucuagaaucccccucuuucuagauaaccaggucucuaaccauucuccagucauuuuagaucccuucggugguuuuacuaagccugccuuaauuuuagauaacugagaacugaacuuaaaaucccauuuucccccaagcccccauucuagagcuuucuggagguagucuucacuguccuuccauuguggacugcuggcucauguuuggcauggccuggaggggaaaaaacaauaaaaacuuagagcuccaucuaagcaguuauuuucuuuaagcuucaucgauucugagcuuaacuauauacaucaucuccucuauuauucugaaagcaguggacuuauuugauuaacgcaaacaccuaacugaaccucuacugggugccaggcacuauacuaaaugcuggggaauaaaaaaugaguaggucaugguccuuuaagcccaguucagugggacaaacagguaaguaaacaaccauaaggcaacaaguaucuucaugaguauuuguauagaacacuuuagggacacaggggcaguuuauuccaugggauacagaaaagggaaugcucaauaggaagcaauauuugaacugggccuugaaggauaaguaggaaguugccauguugauggguagcagaggaauacuccaggaaaaaccauucauucauucagcaagucucuccuguuagccugcugcagccuaagcaucaggguucauuggggguuucaguuuucuucuuuguauucucuagggcgccuagcauagugcuuugcguucaacaguuguuugggaauuauuugaguaaauaaaaaauccaucugauaagggaauuaaaaauuacucugacauuugcaaaaacuguuucaaaugaaacaguauaugugaaaauaaagcaugaggccaggcaugguggcucaugccuguaaucccagcacuuugggaggcugaggcgggcggaucacgaggucaggaguuugagaccagccuggccaacauagugaaaccccgucucuaauaaaaauacaaaaaauuagccgggugugguggcgggugccugcaaucccagcuacuccggaggcugaagcaggagaauugcuugaaccugggaggcggagguugcagugagccgagauugcgccauugcacuccagccugggugacagagcgagacucugucucaaaaaaaaaaaaagaaaacaugagacaacuguaaaguaugucguuaauauuuaacuuucuuguuguuuuauuuugcuaucuuccaaagaaauuuauuugaauaauuucugugaccuuucaaauaacuaacagcauccagcauccuaucuuauuaguuuuuguuuuuuuuuuuuuaaagacagagucuugcucuguugcccgggcuggaguguguuggugugaucauagaucacuauaaccuugaacuccugggcucaagcaguccuccugucucaaccuccugaguaacugagacuauaggugugcacuaccacacauggcuaauuuaaauuuuuguuguuguuguuguuguuuuuguagagauggagucucacaguguugccagggcuggucuugaacucuuggccucaaguaguccuccugccucagccucccaaagugcugagauuacaggugugagccacugugccuggccauuauugguucuuuauuguuugcuccaauagugcuggauaagaaaacauuuauagugauauuuuuauuuuaucuuauuuuuuggcuauuguuuaacaaaauauguaaggccagaaacccuacaaaucccucuugccuuguggaguguccucuaucuuugcauuguuugcuucucaaccagugaagcccugaaauuuccauaugacuccccaacuaauuguagcuuccugugugugugaggggucuguuucugaacuuuauauaaguuucuguucagucagccaacuuucuaaucaugauaaagggcaaauuauuguuuuauaaaccuugugccauuugucacauuccugucuuaccaguuucuuaagggagaggugaaagaaacccauaagcacccucuaaaucugcuuugcauuuuccugcacagugaagaauagacuuuucauauguuugaacagaaaaauaaacacaaacuagaaaaacacugcccuuuccagucaaccaaguauacuuaccuuuaggaggcagugaaaguggugcccuuaaauacagaauuauuuauucaaauauuaagaauuaauaaauaaagggcucuaauauaaacuuuguguaaguuuuucuguguauuucagugcaaaaaaauauguagagcauaaaaugaaaucuaccugucaagcaugugauccagaaucuugguuuuauuacuauucuggaaagccccgguccuuaucauuugguuuagcuuauuuaaucuuuuaaauuggaaauaguguacaaaauuguucuuauuguguucauuuucuuuuggcacaagaucuuaggacuuuaagucuuacagauuauagucacuguaggauucacaaaagaacuuucuuauaacuuucuuuggauucuucauacucauuuaaaauuucuuauguucguuugguuaaucaguacaaggcauuuugcugauuacugugaaaaagaccaagguuuaagacuggucucugagauuguaauccaauaggaacuaauaguauccucaccaugccuuuaccuuugcuguuuccugugucuacaguguccuuucauugucccuuccugugcaucuggcaacuuaauccuuagccuuuaaggcauagcucaaacuucacugccuccaugaaacuuuucuuugaccucccugugucauuuagggcaaggguuccccaaaucuugggcugaccccuugguggggaaccucagaauuauuguagugucaguugucaaaaaaauacuauuuucaaauauauguagaugccauugugaaaaagcaaauuaaaaauuuuuuaaauuuaguuaauucaugaaaaagcuuuguuggauacauagaggcuuuguucucuuguguuuuuaaagucaagaaauacucaaaguauaauuacagguugaacauuccuaauguugauaaaucuguaaccuggaacuuugugaacacugacauggugcucaaaggaaauguccauugaaacauuuuagauuucagauuuugggguuagggaugcuuaaccaauauguauucugcagauauucuaaaauaugcaaaaaccccaaaucugaaacacuucugguuccaagcauuucagguaaaagacacuccaccuguauuaugacgaaagucugggaauuuuuuuuuuuuuaaguuaaaaguaacuauuccuauuuguauuaguugggguuauguuuagcugcaaaugauagaaacucugacagaacagugacugaaauugauuucucuuucacaugaaagucuggagguugucaucccagaacuacugggcuggucucacaaagucuucugggccccaagcacucuauguuuugcuuuucugcccuccuuagcagaaaggagcuuaauauggcugcuugaguuuugccgucauuuuuauuccaggcaacaguggauaggaucaccucccuuuccccucucacuuccuuaacacacacaguuaccccuuuaggaauacccaaaguccugcaugguccuucuaccuacauccauucaucgggacuuauucacacagcuacucagaguugcauggaaaugucuuuauucuggguuauaaggugcccagcuaaaauucacuaaaaauccuugcugaggaggaagaggggaacugaucuugggggaccuguguguauccauuuugggucaggcugggccccacagauauagugcauuagcacucagcaguguggaaggcuauuucagaucacaguccaggugcugugugauaccucacagguuccauuccucaguuagaccuuaguuuccucugaaaucauacuuguuuugucucauagggaugggaacuaaagauaaacagaagcacagagaugcuaguaauuagauaugguugaguauuuauggauaaaccuucaccagcacuuuaucauccagucucaucccuuuggagcucccuaauuuauucuuccuuucuuuaaaauaugcagcucuggaccagcucuuccaagaggcauucccugauuaaaacugacaaguuacuaacccagaaaugucucuaaccaucuccuuucccauaugguuuugcauugccucuaaacuuuuacguuuucauuuacauagcuuaccuagaugauggcaugacccuguggauaagagucugggucucagagugagauugccuggguuuguaucugaguucuuuuacuuaucaucucugggccuccguauuugcauuauacaugggaacuaauaaaaauaucuaucucauaagauaaggauucagugagacaauccagguaaaucacuuaaccuagagcccaguucgugguaagugcuugguagaaugcaccguuauuguuguugucuucuucgucaucaucaucaucaucaucgucaugaugucuccccucuuagacugauggagaguauucucagccaucccuauucacucaacuaaugucaacugaacaccuuccccaugcugcauggaggaggcugaagggcaaggugaaacugccuggguuccuauaccaguauuccacuuuccagcuguguaacacuggguaagauacguaaugcuaccaggcuuuguuuuugucuuugcaauauggaugauaaacuucauaaaauuaugaaggauuaaaugagauaauacagauaaauucugucugacacguagcaagcacucaguaaauguuaugauuaaaagaauagaaggauguuggggacugguuccuggcccuuggggagcuaacaguuuugaaggugaggcaggccugcgauggaugcuuucuacacagugcaaugaaugccaagguagaaggauuccugagugucgugaaaaugcagugcagagaaagauguagcuggggaaacaugaacgaggaagugagguggggaggaaacacuuuaucuauagcauaaaggccugggaguuaggcaaggguaucugaaugaggggaaaauguuugggaaaauguuuggaaaaagcuguuccaugcagggcagcccuaugugcauuggcuuggagaugugaauggcucaggcugagggaaugggcagguggagggaauguggcuaaggguaggcaugugaggcuaagauaucuguggggccacaauggcgagcagaucaggcuggauaguacuugagcauuagauuguggaaggccugcggaccaugcuuaggagucaggacucuauucuguauccagcagagauuuccuuuuaugaaaaaaaaaaaaaaagucuuaucucuucccaaaggagaggaaguagggacauacauacccucuucuuuguggguaugcacagccuucuuaucccuuuguuuccagcucccuggaacaucaggggacagcuuugcaccaggaagaacugggaucccugaaacuuccugauugggaucucuuuccaucauugcucuggguguucuucuuucauuucuuugaaggcuaguaugccuuaauuugagacuucacccguaaugauauucauguccaugcccauugguucuauuuucuugccucacagauucuagggcgugguauauagcaaaggauaaaauccuucucagcucuuggaaaaugguucucagcgcucuguucucccacugacuccucucccugcucccucccuucucugugcuccgcccccgccccccgccccacacacacuuuacucugccuucacuccccccuuaaccauuugcugucugguuuucauccuccacucucugagaucugcuuggccuccuacucaccaaguccaaagguuguugacaggccuaauucccaugccccuuguagaguuugacuuucuugaccaguuucccauucucagaaccucaucuuggcuugauguucuggucucuccccuccccuccaucuguuugucuccaguuugguuucucucccuccucugaauuucuguagcucaugaucuccaugcucugacagcauuuguuacuuucuguaucgugccuugguuuacauuggugauuuauauccaugucuuaacuccugugcuagauagacucucaggguaagauccaauucuugauucucuucuuuauuccuccaaguaccuaggauaggcauauagugggcagacagacauuggaaugaaugaaugaaugagcaaacaauuuuggggcauuuguuauaaguuaauugcuuagcaguguucucuaagugugauccacaggccaucugcaucagauucauguguguauaauagaguguuuuguuacaaaugcagauuucagggccauacccagauuuauugaaccagaaucucugagaguuuacaauuuucagucacaccgcucccuccccauguuguucacuuuaaaaucugagaacuccugguuucauggacaauaaaccaacauuauaaaugcauuucaacugcugagcaucuagagucuucuaaaugaggccuagaaggugagcaggacccugugccaccccuucccaccugcaggggagauggggcuuagguggaaggcauggcuucuguguaguggugaaugguggggaggagcacaaaggaggcagauggggggguuacacugaaacagauagacagauaaagcuugcuaaauagagauggggaggggguaaagagagugggaguugggcagcuuucugggggauggagucaacaugagcaaggcuuagagguaagaaauccaguguauggagugacaaggggucuggguugucugaguggacaggcacaaggggaagcagaagaaagauucacaucuuaaauggcuugaaugccaugcugagaagcaaugacguccugcuccagggaugaugcugaggaggccagagaggugucucuauagaccugaaacccacaggaccuguguugaggaugcccuggaagcgggaaagugggcaagggcuucacggagguggcugugggaauccuggagcucaugaucaaguucugcuaaaguacuuccauccaugugggaugugagaaaagagcuucuugcuucaagcuucugugcuuuucaucuucuccagcuccugugaacuugcaagagaagcugaggggugucuguguguguguguguguguguguguuccuccuucacucugugugugugcacaugugugugcauguggggugcgaguauauaugugugcauguaugugugaacacauguauuugugcagauaccaucuuaccuaucuauucuuucuuccucaucauuacuauggccuuaccuuccugaugugagggaaauggagggugaggcaauggaggacauucugauacagucaggggugugugugugcuucacugacaaaaauuguauuuauuguguauagcaugauguuuugauagcuguggaauggcuauauuauuuaauguauauaauaucucgcauacuuauucugugguacaaacacuuaaaaucuaucagcaauuuuugaguauacgauauauuguuauuuacuguacucaccaugagguacaauagaucucuugaacuuauuucuucugccuaacuaaaauuauguaaccuucaagcaacaucucccaaccccuccacccaccccagccucugguaaccaccguuuuacucuuugauucuaugagcucaccuuuuuuacacucuacauguaauugagaucaugcaguauuugucuuuuugugcuuugcuugcuuuacaacauaaauuccuccagguuuaaccauguuguuucaaaugauaggacuuucuucuuuuuaaaggcagacuaguguuccauuauguauauauaugcauguuuucuuuucuuuuuuucuuuuuuuucuuuuuuuuuuuuuuuuugagacggagucuuacucuauagcccaagcuggaguguaguggcaugaucucggcucacugcagccucugccuccaaggcucaaguaauucucgugccucagccucccaaguagcugggaauacaggcaugcgccaccaagcccggcuaauuuuuuguguauuaguagagacgggguuucaccauguugcccaggguggucuugaacuccugagcucaggcaauccacccgccucagccucccaaagugcugggauuacaagugugagccaccgcgcccagccauauuugcuuuuccuuucuuucuuucuuucuuuuuuuuuuuuuuagguggagucucgcucucucgcucaggcuggagugcaguggugcgaucucagcucacugcaaccuccaccucccugguucaagugauucuccugccucagccuccugaguagcugggauuacaggugccucucaccaugccuggcuaauuuucguauuuuuaguagagacggaguuuugucauguuggccaggcuggucucgaacuccugaccucaggugaucugcccgccuugcccucccaaaguaugaggauugcaggugugagccaccacacccagccucuauuuuuaauuuuuugaggagccucuauaccauuuucaauaauggcuguacgaauuuacauucccaccaacaguguacaagguucccuuuucuccacauccucaccaauacuuaucuuucaucuuuuugauaauggccuccuaacaugugugaggugauacuuucaggugugauuguacaacccaguagcugagaaaacaguagccuagucaguggucaugaaagguguuuaaaaaugccagguccuguggggcccaggccucuguauucuuuauagguucccagggggugcuggcgcagcugcguuuuggaaccagcagcccagaugacccaaucacuuuacccuuucaccuggggauuaggggccugcaaacuccaaaguuggaaugagaguuuuuaaacuugaaaauuucuccuucuucuuccacuuugaucaguggagaggaaaauaccuuaccgagcagaaugguggccgagggaguguuuccccuagguugucucugugggggaggggguguugcuggagcccgagucuaacagagucuaacagaaagcucauuaagacccacagcaaguugaggccugucaguaaugaguacuuuuaugcuguuuucuacagaaauuucacuucaaaaccuagagccuucagauauccugauuugccauucuaauuagguacugaaggagggcuuugugggcagguuuguggcauccucugugcauacugauuuugcaaaccucuugggaaacacuuaaagugaaauucuuugaacacaucaaaaaagucagcauaaacaaacuaaaaucccugugauucccaaacccuaaaaauauucugugaccaauuucaaagucccccccuccccuccacuuuaagguugguauaauccugccuggucauagggagugagaaaggaggguuucacacguucguucggggagaggucccaggguugaggguucuggugggugggguguccaguccucuuuagggcagguuauccagugucuagauuguuugggagaaggugcugggagaaaggccagaagccucagccuggcuggacaugggcuggcauggacgccaucucuccuggccagcauugcccaccuuuaggucucuagcaggaagagcccaggagcuagaagcagaagcacccagacggggaaagaucauggguggcgccacagcaggcuccugcugcccccaugaggagagguugggaaagugaguggcuucccacuaagugaggaggaaacgacaguggagggcaucuugccuguuugugucuguggcucccucaugagcaggcugggauuuugaggcugggaauguguuauaccuuaaaagcaaagcaaagagcaccgguuaccuagaugggaaggcagagcagcaguguccuuugaggccagagagugaaaguaugagacuuuguaggacuuuuguucuuaaucaggucccuagcgggcccacuucuugggcccagaucccugaugccuuugaaacugccauuuaauauggcauuacugccucccagcauugggacuccuucccuucagaucugcuaaggaccuccuaacuacucccuuccccucauguccccucaccaccccucaccuccacagagugccagauauuccuggaucaaaguuuuuauccugccccugcuuagaaacuuuauggagcuucuauuugccuggcugauaaaauccagugaucuagcccuccuucucugcccuucaggcuuucauccaucuguccaucuguccaucuauccaucaucccuuaccaagcacuacaggacuuugugaagagguauuguccuuaaggaacucucagucuuuuggggaaggcagacaacagucaauuacagggguugugaaaucacagaggagagacaccugugugaaggguaggccaacacaguaaacacacuauuacuggcuaguagaauacacuagaugccagaaagaaaccaguauuaguauuaggaggaauaaugauaaugaagcuuuugcauuauauagaccuacuucaaauuaaccuugauuaaaauauuaacucuuuuggggccgggcaugguggcucacacuuguuauuccagcacuuugggaagcugagguuggugaaucacuuaaggucaggaguuugaggccagccuggccaacauggugaaaccccaacucuacuaaaaauacaaaaauuagcugggcaugguggcacaugcuuguaacgcagcuacucgggaggcugaggcaggagaauugcuugaacccgggaggcagaaguugcagugaguagagauggugccacugcacuugagccugggugaagggggaaaaaaaagugaacuccucugauccuuaaaguucuuaucugugaguugguuaaggcuuaacaauaacaugaacuucauaagauuguuguuaaggauuaacaaucauuaaugagauaauguauauuugugaaacauaguaaaugcuuaauaaauauugguuauuaacguuauuaucagacagagaagaaauuuucuccaggauucuuggagcaaagucacugaaauuacagagaaaaacaucuccaacaauuugcucagcaugaauucaacaagucuuacuaaccugucuguuaugauguaccucacauacauagaaagaaugauaccagcaguccaauucagugaaugaggucuccugggugagaauagugcccuguuuugucaaauauggguuuuugcacauugaauuuuuuuuuuuuuuuuuaaggagaagaacuuuaauuuuuuuuuuuuuuugagacaggguuucacacuguuacccaggcuggagugcaguggugcaaucucagcucacugcaaccuccgccuccuggguucaagugauucuccugucucagccuccugaguagcugggauuacaggucugugccaccgcgcccggcuuauuuuuugggagacggaguuuugcucuuguugccuagguuggagugcaauggcaugguuucagcucacugcaaccuccgccuccuggguucaagcaauucuccugccucagccuacuaaguagcugggauuacaggcgcccgccaccacaccuggcuaacuuuuguauuuuuaguagagacaggguaucaccauguuggccaggcuagucucgaacuccugaccucaggugauccacccaccuuggccuccgaaagugcugggauuucaggugugagccaccgcacccggcccacuuuaauucuuucaaggugguuugguacagucauucccaaagagacaacaucaaaaacaccugggaaaugucuuaaacaugcagacccugagguucuaccuuucuucccauccccuaaacuucuucauuauuauaucugggcagggccuggaaaucuguauuuuaaauaagugccuccagugaguuuugcuuuuaugcacuuugggaacccaaggacagauccugggacucugaggccaagcccugggcuuaguuucuccuggcacugucucugucugccuggaugaucuccuggucacgaagguucuucgugucucaggguuaucaggugugagugucugaugaaaugaugaaugcgaguacccaucucuguguggacucuguaaauguaagggauuaucaauacucuuauuuauuguaauaaucccuccuucccauucccauuuucuugcccaaugacuuaaucagagucacuccaguauagcauuuaucuuugaagccugugguugauuugacaggauuugauauaaaauaaggaguaagaggcugugcuuuggcucaacagcaaguucucacugcuaaaaagccucugauucugcccugucuguguacuuuccuguaucgggggagggagagacugugcagguguuuaaauugggacuugaaagcuuuagauuuguguuguccagaaagguagccacugaccacauguggcuauggagcacuugaaauucagcuagucuggguuaagaugugcugucaaugugaaauacacccagaguucagagauuuaauacuagaaaaaaaaaaaguaaaguauugcaauaauaacuuuuauacugauuacauauugaaauaauauuuuggguuaaguaaaauauauuaugaaaauugauuucacugauuuucucuuuuuaaaaaccuagaaguuucgaaauugcguauguggcuugcauuauauuucaucagauacuggugcuuuaaguguuagguuagcuuugggagucagcuuaaaaaguuuacaggguuugcucuguuuucaaauucaaaagguaaauuuuacauuugaaguggacaucuagaacaguuauucugaaucauuuaacucaacuuugagcguuagcauuguuguuuauugucacuggugguuuuauugaaguagaaauuuaugaaauagaaucuaaagggcauucagcaguuuaucuacuauuuuaaaagacagucuccuaaccucucugggaggggcaagaagaaaguugccuaaguggagaaauugcuuugcuuagauugaauuuuuauugcagagcugcaaagcccagaagacagcaguuuacagcggccgcagcaauucauuuuuaaacugugggcuuggaaucaaacugcuaugaaauacugaugaaagcaccauucacaaucuuccuuaucaucuuuggccuucucucugccacucugcuucuucacucucuuccccgaugguguuugggauacuagugugugagacacagcugggaacucacacagcagggcugagaagagcagagucagcucgucagcaacagcugaguugaaguaggugcuagucauugaguuucucuauaaaugguggcauuccugggaguucagagcagugaacuugaaaauggugaugcuaaaggccccaaugucuacuucacaguaggauuaugaggagaauaggaaaaaccagaggcaggaugucagggaugcagaagugguugauaguagaagcccagccauuagcuguugacauggccuucagggcgucuccugcaggccucaagucuuucuccuuagaccuguucuaagggaauggauugguucuguauagucaaugaggcacaaaaucugaccccccaaguuugaauuugaauuccgcuaucacuagcugugugaccuugggaacaccacuugagugcucugugccucaguuuucucgucuguaaaaugggcuucauagaaccuguggugaggguuaauugagcaaauacauguaagauccuuagaacuuacgcgugaguaaacacucuguaaacacuggauucauucaguuagcaauauuuaugcuuccauguaccaggagcaacacugggguacagcagugaacaaggcaguggaaaucccuucgagagaggugcuuucagcagaggaguucaagauguguuuguugcuuauaauuacccaugcuugugcacuggcugaggggccuucacacauaaugcugcuuuacuuuauguauuagguuuugacauaguagucuguuuuuuuaagguuuuaaguacaaaacuuuggauuuuauuccuagcucacccacuucuucaugguauaaucuugggcaagcuacauaaacucacugaggcuucauuuccucauguauaaaaaagcuaauaaauaauaccuugcucaaaggagagugugagaauuaaauguuguauuaaauaggauaaugccuauaaagcucuuagcauauacuuggcucauaguaaguguucuguaaauguuagcuauuauugccauugcuucuaguucuagaaauucuaugagucagugauucuaaauuaagaggucacuaggcuggcagaaggggaaauugaaccagauucuccuguggugccccuuucuaugagcuaaguuguucaugagugccuuggaaaccaucuuccuuuucagagaaaaacaauagagauccagguguucaauagagcagcccaaagauagauaaugagucucucaucauuaggggcauccaagcuggacgaccagucagcagggauauuauaaagggaugggcccugagcuuguggauugcuuccagcucugagauuauggagccuuuguucauuaacauuugacccaucuggguaaggacacccuagggagggguacccauuuuugaagagcaaagagugaccucagggauuugccaccuccuucacccagccaguaagggaagcucacuuggacaucgcuucuacuacuuuucuucuccugaguguaguuauuucuuggagguaagugcuaggguugaguuggagaaagacaugccacaucuucacugaaucguuuauccagagaguggagggcaccugguucuuggugucacacucagcccuaaaauuccuucccuaggggauggaauagauagaaaugacuucagagccaccuggcuagggaggacugggccuguugucuacagcccuggggaagccacaggcagcuuuaauucagggcuccaucacuccuccccuuuuguuugccacucuguacuugccuauggaaagugaaaaaacaaaggcacuauguuggauucauuuguccuuuaaaaaaacaaacaaaaaaagguaauuaucuucauuuuugaacacuuacugguuaugucaggcaguuuauucacuuuuaaaggaaccauuucuugagcaucuacuaguacaaagcaucuguuagccaccagagagaaaaacaaaagaggccaggugcaguggcucacgccuguaaucccagcacuuuaggaggcugaggcgggcggaucaccugaggucaggaguucaagaccagcagccaaucugguggaaccccgucuguacuaaaaauacaaaaaaauuagccaggcaugguggcaccugccuguagucccugcuacucaggaggcugaggcaggagaauugcuugaaccugggaggcagagguuucagugagcccagaucacgccauugcacucuagccuugggugacagagcaagacucugucucaaaaaaaaaaaaaaaaaaaaaaacagcagaagaaaagaucugagauacuucucuucccuuaccccaaaauaguucuuccauuuuuucagaguaccuacuaugugccagccacugugcuaggggccagagacacagggcugagaagacacaagugguacuucuuccccuggaaguuacagcccaguaggggagauaggaauguuaaaguuuugauuguuuaugaagagggagacagauccacacagcuaacccuucuugcccccagcaccaguggcccuggcuuuggcuuggcaaaugugguaccauucucugaaccauuggguuucuuacucacuuccuauggugaugucugggucucaucagaucuaggggucagugaaaugcagcuggucuguuaccucugcccagagagcucagggugaguccccagucccuucaccccacacacauuuucuaucccaaggcacccuuucacucuucauaaacuuugcagcaaaccagaaauucucuggcucauuaauagaaggaaggccuuguugggguggaguaggguauguugccaagcuaauugguuuggggaacaugaggagagaaaacacgaaaaaaaucaguggcccugaaugauuuacuuugugagugacagcaucugcauaguuuuaaaacuagaaucugugcauugccugugcaguauuucuuuaacuuuaagcauuccugucucaccucugcauuuuugcaauacccguguaguauuuuucuuuaaauugacucaauaaaaacuaaauacguaaauuuuuaaaauuuccuauuauuuuaauuaaucuucauagcuuuuaucuauguuguauagcuaauauucauaguauauuuuuucuuuuuauuuuuuuucuuuagauaacagagccuugcugugucacccaggcuggagugcaguggcacgaucucgggucauugcaaccucugccugccagacucaagcaauucuccugccucagccucccaaguagcugggguuauaggcgugcaccaccacaccuggcuaauuuuuuguauuuuuaguggagacaggguuucaccaugucggccagccuaguccugaacucuuggcaucaagaugaucuaccugcuucagccucccaaagcgcugggacuauaggagggagucacuguguccagcuuauaguauauuuuuucaaauguucuugccacauugucaaagaucuugggcauccuuagguauuugcuccauuuaggaagauucugccuaagaaauucaugaauauuccucuaggagaucuuugaaucuucuaaaauucaaaauuguguuuauuauuguaaaaaauuguguuuguguauuucuuuccugggaaagacaguccaaagcuuuauucaagcaaggaccagagaaggguaagagccacaguuugugguuucuugaauugugucugauuauuauuuacaaaaauuucauuuucccaggaagaggaacauuguuguuguuguuuuuuacaagaaauggauguuuuauuccuaaagcauucuauuuuuuaaugaggugcagauaaacugcacauugaaaaauggucucucccacaucucuuucucaucucuauucuguuuucggccuuccaacaugugaauguuaaucacuauaggaggaaggugacuauuuucugauccaaaaaucaugauguauggucugauuaaggauuuuuauguauauaucaugccuuucaaagguauaaagggagaacuucaguuacacauuuaaugaauuuucuuuauuaaaagagaaaaauugaaaaaaaaagugaggggggcaccuaucuuagaauauugagaauguaaguucacuaaauguauuaauagaccaguaaauguuucagagaaaaaaaugagcacaaggaaagcuacucguuggggcauaaauacaugauaaaggggcuaugggaaaaagcaccaucauucuagaucacacaaaucaaacagaaugcaccauuuguauaaaugcagacgaagccacgugucuuucccugcuucuaggguaacacaccagcaaggggacacaaagggcacccuguucauucuuuccaucucaaccccuuaaccuuaggaagaauauuagaacauuuguguuugcauccugccuccuuccucugaagguccaugaacacuagauacaaugauaaaauagaaauaggaauuugaaaucaggacuagggaaaauauaaguaagaggaaaaggacaaacccaggagguugggaagaauacgaaggcacucacauuaagggucuguguuucugcugagcugcacauuugacuuggagcuuccuggcagccaaaacaagaaggaaacaggguaagcuuucuggauuuuacuguuagaaaagaaaaacaucgucugagugcuguggcucacaccuguaaucccaacacuuugggaggccgaggcggguggaucaccugaggucgggaguucaagaccagccugaccaacauggagaaacaccaucucuacuaaaaauacaaaauuagccaggcaugguggugcaugccuguaaucccagcuacucaggaggcugaggcaggagacucgcuugaaccugggagguggaggcugcagugagcugagauggcgccauugcaccccagcuugggcaacaaaagugaaacuccaucuaaaaaaaaaaagaaaagaaaaacauccuaguuaagggauagcuaagugcuuccuaguuuguuucuuuaaguuaaauuucuuauaaacaagguccucuucaacuuucuucuuugucuuauucacuccucauuauauggcuccucagacugggccaauuucucaauuuagguggcuaugauacagauggucguauaccucucuucuguaguguuuaucauagauguacauucucaugugcuuagaugauuauuuugaaagcuuguguucucuacuagacuauauaccucaugagacuugggccauauuguccucagugcccagcacaaucuuggcacaugguauacccucaauaaauauuuguuagaacaaaugaauaaggccaaagcauucagggauuuuaugugacugauucuuguagugucuucccaggaaaucaaggcccuuucaagcgugcaaacugucucuuguccagagagcuugguggccaucuccaagcucauuuuacuccacgguuauuaacaauuuggagauuguuaauaacaacgacuccagguuauuaaccugcuauaaauccaauccuguaauugguacuugauacauguugcugguaguccucaaagaugagggagacugaggcucagggggagggaaacagcuugcccaaggucacauugcuggaaggcaugcucuuuccuuucugccugcuguuucugagccagagcuacaagugucugugugaguuauggguucuuaucucuuggcaauuagagcagcucagcaaagguauuucuggcacaggccauugcugcuuucugacagcugcuacauuccaauaucgccugaguuuagggaaaagaaagcccacaccugggguuggcaaagauagucucagaacucauuuucccugguuucugcacauggugaauguguuuauuguucuugucacacugucuccugaagugcagaugcauuaaaguugaauauuauuuucauaaaagccacuggagagaaagggagagaagaggcaugauucgggugucuccaggaauauaauuggauuugcccaaugauugggagaguggaggugggaaaugacaacaugccaggaaguacauuugauggugcuuuugauuccaaauuuguuaggcauguguuuuuaauugcuuugucccuguugucauuauucuaauagagaccugauuuuuuuuuuuuuuuuuuuuuuuuugagacagagucucacgcuauuucccaggcuggaguacaauagcauaagcucggcucccugcaaccuccgccucccggguucaagcaauucuccugccucagccucccgaguagcugggauuacaggcaccugccaccacgccuggcucauuuuuuguauuuuuuaguagagacaggguuucacuauguuggccaggcuggucuugaacuccugacccugugauccgcccaccucggccucccaaggugcugggauuacaggcaugagccacugugcccugcagagaccugauuuuucaaaagggguucauuaucauauuaaacuuucucuauucagcaagguuggcaaaugggauguucuccuggcucaguguugccaccuaccgugugcugcauagauugucagucuucaaaauauuagaaggcaguaaaacacauuucaaacugcaacaaggcauaauuugauccgucuguucuuccacaagguugcaagucuucagggugaacauuauaagcaucugucaucacugugugcucuuggagugccaagauacugguuauagugaauucuggugauaaaaaaaaugcuagacaaaaauaccacuuuuucuuuggucccuugagaaugagccucaaaaacaugugcugcuugcacauggggaucugaauaauugcaacauucaggauuauguagagagaguaucccugaagaaggcacuuagggugguguuugcaaaugucacaaggcuuucaguucuaucuuuggcccccuagucucaguaaggauuuuggcucauaucagugauuuggaaaaccuaauaacuuuuaugucuccaaaguuguguuuccagacugcuggcuauuucauauuuuaaagcauguuucuaccuuuaaaaggacaccagagaauagcagugggcacugacaugccuuuaccccuccccacacuagaaaaggaccgacacauuuaaucuuuuuuuugagacggagucucacucugucacccaggcuggagugcaauggcacgaucuuggcucacugcaacggguucaagcgauucuucugccucaaccucccgaguagcugggauuacaggcauaugccaccaugcccagcuaauguuguauuuuuguggagacggggugucaccauauuggcuaggcugggcuugaacuucugaccucaguugaucugccugccuuguccucccaaagugcugggauuacaggcgugagccaccaugcccagccucacauucgauauuuauuuguggauagauuuagguucuuuuucccaauuuccccacaguagcuuugacaagucuuauuuggaagaaguaacacaguuacugaacuggcgucuuguuccuaguuugaaugguaagagccagaaaaucgcccauucacauguaguacauuaagauuucaccuacuuuccccagaaauuauuguuuaggcaauuagggacagaaaaguaugaaaaauacaggugcuaauuauaaccagacucuuuuuuuuacuguaagagauaaaaauuucaaaguauuuuacauauuaauuaggauauuuccuccccuuaaccucuaauuaauauccacaguaaacaaccuuuauuaauuacaugaaucugaacauuuaauauccaggaauaugaagaccauacacugaguauucauuuauugcuuauccuguuccacaguggauuugagguaacuuaugggaaaagggugaaauauggauaacaaaauaaaacaaucaggaucaauaggaauauaaauuauauuaggagauuaagccuaaggagacaaggagaauggcaauagccugguacuguuucuguuuagguaaaaagccaguucauuggacaaguugauguagccauuuuuuaaaaagcgacuuggaagcuacucuggguuuuggaaagcucuguguaaacaugggcugcuucauguuccugacauuucagcugaacuuugaaaauugcuuuuuuuuuccccuccaaaccucuaccugacccccagcacacacccacuucaucugagccaaggaggugucaauucuaaaaguauuuuaucaagcgagguuggcauuuuucuggaaaugcuguagccugagugccagcagggcauuugggaagcuuauuuuggaaacccuuucauuaucauggcacucaggcccuuauaagugguuccaggaccucauacccugaugggcugcagugauaggaggaccaaaaaagggaguguugaaguggaaggggacggugaaguccucuucucccaagccggcaggaggcacgauaacuuaucuuucuuccacgucuccugucuccagccucuccuccaggaccagagggcuuccuguugcuuucuggaggccugguuugcuggaggucauccugaaagaaugcugcucagauaggcucccaggaagcugaugcagaggauggggcugggaggcagacuuugcuggaucacagaggguugccugggcagcgugcucucagccuugaacaaguuacaaucuugugcugcgauuuggcucugcucuugcuuguuacaagccacugaaggucucuagcugggagagccacuuucucccuauacccaggaaggauucacaagaccaugagaugccacugauuacaucuucugcccccucccugaauggagaccaccauagcucacuggcuuugugacuuuuccucuuggacguuuaaucaacaugucaaacuaacauguccaaaauagaguucuugaucaauuuuaacaccucuccuccccuuugacuuguacuucucccaggcuuauucauuucaggaaacagugcuggcauccacucaguugcucaaaccaaaacgcuggaagucuuguuuuucucuuuccuucucuccagucauaaaucccaucagugaguccuguuggcacuaccacuaacacacuuggcaaagcugaaucccucccaggaguuucacuguugccauuuuggccagccacuguccucuccugccuguacugcugcagcagucucuuuagcucaucucccugcuuuuccccacuucuuuucagaggcauuggcauggaacuguagucagacuggcuuugcauacuggauccuccacuuacugugauaggcaaguuaccugaccucuuuaugccuggguuuugucaucuguaaaacugggacuauaauaguacucauuucaaaaaguuuucaugaggauuaaaggagaucauacauacagaguucuuaggacaauucagagcacauagcuaagcaccgaguaacuauuagguuuuuaucguccuuaauccccgggccauccucuacauagaagauacagaaaucuuuuugaaaagcaaaucagauuaugccuccuuucuuuuaaacccuuccauggcuuccuauugucuuuggaagagaacccaaauuccuacuagguauuauaaggcuaacccgacuccccuaccucaucuuuuccuacccuucccacuggucacugaguuccagccucacuuguccuucuuccuucccaggaacaaacuuaguuuauucccaucuauucuugugccaggacagcucuuccccugggucuuagcuuaaauaccacaccuuagcgaggucuuaccugauacauacccugaccugcacauaucacaguuugguuucuucauagcacauguuaauaucugaaauauuuuguuugcuuauuuauuaucaguauuucugucccucugucucuucugucacuacuacaucuauggugguuacuagucaugauuuguagaaggccugaaaauaaauguuuauuaguugacaggugggguguggcagcucaugccuguaaucccaacacuuugggaggcccaggcaaaaggauugcuugaguccaggaauucaagaccagccugggcaacauagcaagguccugucucuaccaaaaaaaauugaaaaauuagccaggugagguggugugcaccuguaguccuggcuacuggguggggaggcugaggugagaggaucaccugagcccaggaguuggaggcugcagugaccuauggucaugccaccacaauccagccuaggugacaaagcaagacuuugucucagaaaaaaaaaaaaaaaggaaugaauaaugauagccaucauuuauuuaguacuauugugucccaugcuauuauaccauucuguuauuuaaucuucauaauaauacuacagagguagguauuuuuaaucccacauuagaguugaggaauaguggcucagggaagaaaaaaaauuauccagggucccccagcugguaagugggugagccuagauuuuaacucacaucuaugagaguucauggaguuuauaggugauaacacuggugaguugagagcauucauaccuggcuuaugaguacaagaugagacugugcaggugucaaagguauaccaucuucauccuuuuaaaauuuaacaguuuuauagaccuuccuguguggccaaugcuuucuuuacuuguauuuuccucuuucuggcaccuuucaucgugcccuaguuuuguaauuuuggagaacuaagaauccaaaagauaucccaagagguuccaguuggauucuguucagcuucuucuucuucccuuuuuuuuuuuuggggggggggggauggaaucucauucacucugugccccaggcuggagugcaguuguacaaucucggcucacugcagucuuugccuccuggguucaaggcauucucagccucccaaguagcugggauuacaggcgcgccaccaugcccagcuaaguuuuuuuuguuuuguuuuguuuuguguuguguuuguuuguuuuguauauuuuuaguagagacaggauuuugccauguuggccaggcugaucuugaacuccugaccugaaguaauuuggccgccucagccucccaaacuguugggauuacaggugugagccacuguaccuggccucagcuucaauuaugaauuaauucaagccuccuuaggugacucuugcuagaagguaaagguagacagguauauuaggucuuucuggccucuugucuuagaauuucucaguguggguuccagaccacaagcagccaaaucacugaggguuugcuaaaaugcagauuccugggcucacucuagacuuuuggcauucaauucucugguggugcgccccugaaaucuucauuucuaacgugggguuguucugguuaaaauauaaguaugaagaucauuggccauaguuguucuagcuuauuagguguuuugugauuugguuuuguucuuugauuuuaaaaaaucaauaaagcuauuuauuaauuguuuuauuaaaacuuguauuuagauagcuuuuggucucuggccauggagcaaguaggcuuuuuucccaccuuaauggccccuaggugccaggugcuaggcccaaguugucuuccuugguggugugcuccauguuuccagcuuaggugcggcagggagccucauuucugucccugagcuguugccugguucuaaggcacuggccagcucuccaguggguggaccuucugaugcauuuggucccguuaaaauuauuuuuaaaauucagguuuguuucuguuacuuuccucccagaagcaauucuggaaugaucaaaauucccagcguuuaauguuuguauuuuccuccccucuguucacucucuaaauaaaggccucauguuuuaauagacagaauaacaguaaaauuagcuugauuagacucuagguggauuuaaaauguaaccuaauggcagcucugucuggcuuggaaaucaugcguuuuauuuugagcagagaauguugguauuugcaaugacugguaagggauuaaaugauuauugaauuaaaguggucaaauaauacaagcaucccuuaucuuuagauccuguccuggugguuuugccuauuguauuuuuauuuuuuauuuauuugauuuugagacaaggucuuucucuguugcucaggcuggagugaaguggcacaaucauagcucauuguaaucuguagcuccuggguucaagagauccuccuuccucagccucccaaguagcuggggcuguaggcaggugccaccaugcccaucuaccuauacuguuuugagaaacuugggcccucagcuuggaguuuuaauccuaucugccuucaguccuuggauuaagaguuccuggguaaugccacaagagaaagucaacagaguugucuuucuuaccucuguuccuuccucuggucuaugagcccucuagguucuuggaaagcucaaaaugugaagcaaauuguaguuuaacagccuugcgccaaagcauccacaacuggccagcucccugcuccccaaaauaucccagcacauacuuuauuuuuauuuuuauuuuuauuuuuuuuugagacggagucucacucuguugccaggcuggagugcaguggcgcaaucucagcucacugcaaccuccaccucccggguucgagugauucuccugccucagccucccgaguagcugggauuacaggcacacgccaccacgcccagcuaauuuuuuguauuuuuacuagggacuggguuucaccauguuggccaggauggucucgaucucuugaccuugugauccacccaccucggccucccaaagugcugggauuacaggcgugagccaccacgcccagccccagcacauacuuucauuaaauaauaauccccuacacugagguggugcaguuccuuuuguucaaaagcuuuuacauccacccccuaaaaggaaaguaggggcuuuauuaggcuauuuaccaagaagcgggggaggcagagaucacccaaccaguuauuacugagcccagucuuaucuauggcuugcucuuauucagcugauucuugccugugugcuugguggcacaccaggugugagaaaagcaaggugaacaguuuuggguucuuaggaccaagaguauaugcaguauaugcucucggcuuauuaagaacccagaauauuugguagagaguuuugggaguaggggacagacucauuagcugauggucauggcugcuucauguuggaaccuuuaguuuaagcuucugagcauuauuauaagcauagcccaggagguaaauguaaaaauaauuuucuugccaguuuuuccugcaugguauccuagcgacgauguacuuucuguccuuggguguuggggcaccaacuggggccguaucaaagcuugcagagggaaggaauaugaagggcauggucagucaccccuuuaaaagucaaggcauaguuucuuuuuaguuuaucuuuuggagaguuuuuuaaaugcaguuguuuuuaagcagcauuuuauguugugauuaccaaaguacuauauguuuauugucugacaacuucagaaacacagaaaauuccaaaggaggaaguaaaaaucaacuguaauucugacauuguuaacauuuugguaaauaucccucuaguagucuuuuauuuauuuauuuauuuauuaacugaacuuucaaacaaugauuagguucuaaaauuauaguguaugguaaaaaaaaaucucauaaagucaaauguacccuaaacuaccauggacaguaauuuuuaugcacacuaaaauuaggcuuaagagcaacaaaaaucuacaugagggccaggugcuguggcucaugccuguaaucccagcacuuugagagggcagggcgggaggaucacuugagcccaggauuugaaaccagccuggacaacauagugaguccccaucucuaaaaaaauuuaaaaaaaaauuagcugggcaugguggcacaugcuuguagugucagcuacucagaagacugaggugggagaaccacuugagcucugggaggucgaggcugcagugagcugugauuguaccacugcacuaacaugauggagcaagaauacugugucucaaaauaaaaauacaaaaaaaaaaaaaaaaucugggggcaaaaccaaucuaccuuuaagauuacuaucaaaccccuaauggugaguagaugguaguagaaaauugaauucuguuccagcuugccuguaagguugauuucauucuguuuuuuuguuuuuguuuuugagacaaagucucacuccgucacccaggcuggagugcaguggugcaaucauagcucgcugcaaccucaagcuccugggcucaagagauccucccaccucagcaaugcccaaagugcuaggauuacaggcgugaaccgucacauucuguuuuaauguuaagguucuucuauacuuuaauauggguugauaaauuuacuuguugugaggaugacaugccauaguggcaucacauuuuaccucagauaguagguucugagucaaccaguaagaaaaauaaacacaggugcuuaccaccucccuccccaacagacccccccuucccccuccacacacaauugggaugauuuguuuuguaacauuuuguuuuauucaacaguaaguauuuaaaauaucauuuuaaaaguuguauguauuccaucguaagcauguaccacaguuuauuaaccaauuuccugucguacaauuagaucauuuccaauuacuugcucuuauaaaaaugaugagaugaacauccuugcggauaaaucuuugugcucauccacaaugaaguauucuggauaaauucuugguugcggaauugaugguucacaggauaugagcauuuuaaagccuuuuaauucauauugccaaauuguccccaaggucauugcaugcuuccuucaaagugucuucuugccaacauuacuggaaguuauuauucaaaggagucuugcauagcaugccuuuuuuguuuuuuuggaugacccagggcuucuauucauugucuggccaauuuauccuggaaagaguacaugaaacgaggcuagagaugauaagugcugguggcuggguugugggggaggguggggaaagauaacagaagggugggcuuuggaggccauuucuuuacucuggccuccaagcuaucuucagcagacaucuaaaaacagaauauugcuuaauacuuaaagggcauauauaguuuuaaaaagcguauucacuauuauaauuuuugauuuggaaaauaauuuggucaccauagaagaaugggaauggcauuuguauauuuauccaaaaggaaguaugguuuaaaaaaauauauggagaaacaauguccuaauccaaccucucauuuuauuuuuauuuuguuuugagacaagaucucgcuuugucacccaggauggagugcaucacagaucaccgcagucucaaauuccugggcucaagccauucccucccugcccccacccccgccucagccuccugacuagcuauggcugcgggcuagcgcuaccacgccugacccaaccucuuauuuuagauagagacacugauaccagagaguggaagggauuucuguauggccacacagcaaauugaugacugaguuggagccucaagugaagguucccaaauuccuguacagcgcucuuuugcagagguaggacagccauggaucagggagagaugagaaaacagacauaagggccucuuuggacagauagccaggcucucuucuagggccugggagccacccuaugccccaccuggauaaaagcccagaugugccuagcauggcauuuccacuucugccuaaucaucuccaccugugaauggaagcaagcuuacacuuuaauacccagugguuuugccugaacuuucccacucacuggguaacgucucagcuuugucaaguaucacuucgucagggauccuuucuugacugccaagacuuaaggcucccuggugcauucuuauaacaccucuguaauccccucgcaacaaugguaauuaccuuguucuguauuuaauauaggucucccugacuagaguagaagcacugugaguguaggaagauuaucuguugcuccuggcauauacuaacccuuaaauguuugcaugugugaauauuuggacgggugcuaaugaaugaauuagaagugugugugggcugcugagaggugcuguaguucugauugccugcaggaccaggagagugaucccuuauugccaagggcauugagaaaagagagaaagaaaagagacauaguugagguugcgagggcagagacaagccagaggguauggucuccuucgcugggugccugauagcggccuccugggcgaugaggucgcagucacauccaaccaagucuucauuccuggcuugucagaauccguucccgcaauuuaccagggauuguuagaagacuccuugaaucauuguggggaagagcauucaaggucaggacucuuggaggggagacgacagcaacccgggucuccugcagccuggucuucccagccgaugggcacuugcggcaacggaugacaggucugcuggugucuggcuagacgccagaacagcgcaguucugaggccgcagguccugccccuccgcccuuuucccucccccuccucagccucucuaccccucccacuugcagcauccucuacgaggaaaggaaugugcugggcucggacgcgccguccuggccgaacggcagcaccuggggcgcgcucuggaccgcugggguccgcugucuggcgcugcgccacgugcuuugaucggugcugaugucaagugggugugggcuccucggaaaggccccggcgaggaggaggagggcgcgcgaugcgccgcgggcgagcugaggccccggcgcgcuccguagcccagcgccgcugaccgguggcccgcccgggcucgcgaagcagucgcauggagccgcggagcuguccucccugggacgcgugccccgccacgcugggggucuggcaggagcgaccaaggggggccugcaggugugugugcgcgcuguaacuuucggggggucugcggguugucgagccgacagggcgcagggugcacgggcuccuuuugggggugcuuugugucugggcgcgggcgugacuggagccggcuaguccccggccagccaugagcgagggagccguagcuggccgcuggaguuucugcaagagaauucauugagccggcgcccggcuuuggguuacuccucgggaaggacgccaagggagccguuguuguuuuuaaaaaucgggucuccaaguacagacugcguucuuguuaacaggauuaccucagcagcagagagcgccgcuucccaaaaucggcugugguuggggaccccacggccccgcaggcgugcgggcugcggggacagcaacuggccagcaguggagaggguggggaccgggaggugggcaaaggcgaccccgccaagcguuccgccaagugugcaggggcgccugcccuuccucuacacccacacuugccaggagccggcuacggaggagguaaggggucagcuucucgccugugacagcucugguuucagacacaccuucccggaggaaugcagaggcuuuguuccaggcgcccgucccagccccgagcccugaagcccgcgggcauagggcugggacuccggugccauuacucaucuuuuauggcaacgccggcaagcuccuagguaggcaaguuaauuauuaaugugucuaagcuggagagaggaaaucugaaaaugagauugguggguugcaggccucccccuuucuuuuuuggcuuuggcaaggcaagguuuaagcccaagguguugcagucuauuucccuagaaggauaagggcauucccccaaggcaccagcacugcccccgaaggguuccccuuucguugucggugggacagccccaucuccucccagagggcagaaagggugcaucccucaguuuuuaaucuacuuuagaacccgucuguaccccuccuccuuugccuuccuaaaugcaucucacucccauccccuuccucaaggcagcuuccagaccagguguaggagaccugaguccucucagcagguagagucugaaacauucugaaaaauagaaaaauguugcccugucccagccauggugccugaaaaccuccuugcgugcuccgccagugcccucggguguauuuucaggccugggggcugugggcagaggaagaggugucugucaggugucaccugacuugucucucccaggccccucaguaggaggggagcagaaagguccaggugggaaauagagaagguggagugaggcuccucccucaggcaguuucaguuucccuccuguccuuaucagagagagggugggucuaagacugauaguuguacaagguguccuguuugugugcugggguauuucuggguggggcccuaaugagugggaguggaagggcccagccuuaaauggagggcuguggaccaggcugggcucuggggaggugggagggacggggguugguuagagacagaccugaggagauuuuuuaccccagccagggccuuagaauaguugugaaacucagccuuccugguagcauugugccuuagagaccugggaagcuaugugcuggcuuaggauagaguuuucaguccuguuaacggaaggguggaaggacuggacuguagaguaagugcgaugaggaagaugagcaugucuuggaaguugacauucuggggagugcaagaggcggcugaguuuauguaaggcggggaggggcaaaggcaagaaguguggggaauagggugggcuuacugcaggcaaggagcgcaggaaggcagauuuuagcacugggugugggcuguguaucagagaggugcuuccagacaggcugcugugcucccucccccuccucccaauuuucuauccccuuucucagugacuugguuugcugaguucgccugccucucugcucugcucuccaugggcugggcugcuccagucccuaccucacuccagccuuccagggagaaaaugagugaaggaaggcuugacuuuaaagaggcuguugacucugaaacccugguuuguuggggaaucagugccaccugcccugccaccuggguuugcgguguguacacuccauggcagcccuccccuaacacacagggcucuugcuuguagagugccaccuucuccaacccugcccugagcugcugguacucugugaguugaggauuugaagauggccuugauuaggaacaagguuuuucuauuaugaaaagucugcucaagccagccgucuaacgucucaccuuuuggccugcuggccauggcugcauauuuguggauaauggcccagccaagauggccuggggcagcuacuacccaaagugauucccggaaagaguagguggguagcggggucccuagggcacugagagugagagggcaucagagguuauagguuagggggaaagugaggcagguaucagacuguggaaugguggggugaggaugucauggucacuauggauugugaggucagaggacugaguagggcuagcuuggaaauuccccaugugucuugcuccuaaugucugcacuggauggagcaggcuauggugaguccaacaucaguggaggccucuguccuggggccugacuccccuugcucucaggggaaaggggcagccugucucuccucugcaccagcuccuuagcuugucuucucucuucccucuuaaaagagguacuugguugauggugguuacugaguuccucaguagcagcuguggcagggagccuuuaccugggauggguggcaggagaagcucccuaggcuaagagaagggugcucugaugguuuguucugacucaggcaagaucgggaggagaaauagacuaaagacccuggcagcacuugcagucuugguuugcaaaagcacaaaguuccaaccuaggguuuguacuauaucuggugaagggaaaagaagccaguguuccaggccuauacccugugaguacccaggaaugaggggagagagaaugagggguuaauugaagcaguguggcaauuucuuuggaggcuugggcucaaauucagucucugcuacuuacuagcuuuguguccuucagcuucucugagucucaguuucuuugccuauuuguuaaguagggacaaggccacucccccauccucaggacaauugugagaauuguaugagaugauuguaaaggauuuaaugcaguacuuaccaauugauagcuauuauuuuucauuaauuaaggcagcuagagaguccuuggaucauuagcugagagguuuuuuuguuuuguuuuuuaaauguagaaaauaagaauguauuuugugcugcuaccagaggccauaccugggcuccuagguucagaugagacaacuguccuagaaggguuucaucugacuuccauaucaaaccuguuuccagccuccagauauucaaagaggccuuggagaacccugaaucucugacgcaggcauacagcauagcugaacuggaaaggucaccugcucaaacuccugcugaagcagccuucucugguccagccaggauuagggaauauuaguccuaagagcaacuggauaccugucacauuuuagcugcgugacucuagacgaguccuuuuaucucuuugagccaguguccuuugagaauaauaaaaccugccucacacaguuguucuuaugcucaaacaggacaacguaugcucaacuguaaugcagcauugcauauuauugauagcuaacuagauaccagacagugaucucaguauguucauauauuaucucauugaauucucacagcaaguuaugaugcaacuuaauuauuguccacauuucauuaaugaagaaguugagcuguuagggauuguaauuguuauuguuggauagcugacuccuuacuggaagucaugcaucugaagaccuaucucccaaaguaggaauaaacuaaaguuccuacaaauauguuugcaugcugccuuucuuccacugaccuauucuaauaucccaggcuaagucugaacauaaauuuguaaaauaaguuugcuauuuuugugccccucucugcccccucauccauagggucuguggggcugauggacacagugccuucuugucugugacuuuuaagcaucacuugcaugggauuguaacccuuuuugcacucacccuagcuaguaguuccuuuuaagaaagagguugcuaguuugauuugaguuuaggcaggggaaauguuuggucuagagaugacuguuaggcucagaguuuucaaggucccaucuuucuuucugacgcaucugguaagcuguuuugcucuguuccagaugaucugccagugaacagaggucugaaguucucaauguguuagaaaaaaaauguaaaaggaacaacaacaacaaaaaaacgcccugcgaaaauaagggcucccagcuggugguguuucagacacaggcauugcucauuaacggaguuaugauuacagccccgaauucauucucauuacuuuuguagcauguuuauaagauuacaaaaaggcugucacuuuguggguuauuuucucuuuuuauuacaugaacaacauuuaugcaggugugacaccaauaaagcaauacaggucugguuuggaauaaaaagugagauaccacgggugaggcucuaggugugcuuaagagauucuagggcucugguuagcaaagaaagaguuuccacggcauggagcugugcacucugcuccuguagcagccugcuggugucgucagagugggcauaguuccugucacuuuacuggaacuuggagugacacgucugaagucagguagucagauauguaauggcagagacuggacuccaggucccugacuuuucggacucagaggcaaguggucuuauuuguccugacaauaauuuaaauaauuuuuccuauuauguacacuuugugggaaauuuagaauauuauacuacaaagaagauggaggaaauuaaggaccaagcaccaaagacaaccacuguccauauuuugauggauuuugaaaaaccuuuucucuuuguuuuguuuguuuagaaauggggacauuuguuuuugucaggggagauuugcuauuugcuuguuauuuauacaucucugggcauaucuaauuuccucccuuggaacaggcauucuuucuguaagcuuugauucucuacaaauucaggugaagcucuuuauuuuauguaaagcacugugcuaggcacuguaggggaaagagaugagcaagccauuccucucuucggaauuuacaauuaagugggagaggcagauguguacucaaccaauuaguacagguagaguaguaauaacaaacauuucugauagccagcccuuuccaugugcuuuauacaaguuacucacauuuaaucccccaucaaccuugugaaggaggcauugcccauuuuauaauuguagaaacucagagguuaguuugccuaaggugauaaaacuagcagccacccaagcugugauccaaauccagguugucccauuacaaaaguaaguguccucuguuaugaaaaacggcugguaucacaaaucccagagaagggaagcucaaagucaaaguccuuugugaagaaggaagagaugguacauaucucuuugucauucccucucucauccuuucucucucucugauucuaauuauauugaguaauauuuguugucuuuuuuuucccugcuuagaaucuuuuguuuauuugggucauuugauaauaaaucugaguauuggaacuggaggggaauggaaagguuaucuagacuauccuuuuuacuuucuuuuuuucucaaauuuuuaauuuuaagagaugaggucuugcucuguuacccagacuggagugcaguggugugaucauagcucacugcagcauccaacuccugggcuccugacucagccccccaagaagauaggacuacaggugugagcuaccaugcuuggcuaaguguuuuucuuuuuuuagaggugagaucucacuauguugcccaggcuggucuagaacuccuggccucaagugauccuccugccugucuccugagaagcugggauuacaggcaccagccacugcaucugguucuuuuuauuuucuuacuggagaaaacugagucucagagaagagaagugaccugggcauacagaauaguuuuuaguuaagugaggaccagaacccaaguuuucuuuucaccagaguuucccaaagugugcaaugauaugggguaauacaggggugaaucuuucuuuucuuuucuuucuuuugagacagaguuucacucuugucacccaggcuggagugcaauggcgugaucucagcucacugcaaccuccgccucccagguacaagcgauucuccugccucagccucccagguagcuggaauuacaggcaucugccaccaagcccagcuaauuuuuuuguauuuuuuaguagagaugggguuucaucaucuuggcaaggcuggucucaaacuccugaccucaggugauccacccaccuuggccucccaaagugcuggcauuauaggcaugagccaccgugcugggccuaggggugaauauuucuuaauaguuuuuuuuuuaugugaguauguaauguuuuucauguguguuugaagaaaaauauaacuagaacaucaaagucaucauuuggcagcuguuaugcuuaggauauagcuagaguccuuguggucuauuuaaaggaaaaaaguggaaguacagguuggacaagauguggcagaaauuacagaggcggugugagcaaugugugguuaauguuagggaaacagugcauuuacaccaguuuacacuuccuccuaauggauucaccugccuggccagcuuuauuauuucaggggcaaguagaagggagccaacccuuagugaaaaccuacuacuugcugggcauuuuaccagcuggucaguaucaacgggcucauuguacugauguguauauauugagaaagcucagagaaguugauuaacaagcucaagguuacagaggauagguuggagagugaagguucagaucccagcuugggcugcuucaguugccccuuauagccaccugcugccuuccacaaggugagugagccuaggaccuuucuccuccuaggucugacuccuguugggauuugaagguaccaggcucaaguggaaaugaacgugguuggguugcuagguuguugcuguagccugcuaauuuaaggcuugauuuugauagaauuuuaaagaaugugcaguauuuaucaaaucugacucaugcuauucagugacagaacccuuauccugcuucuguccguguugugaugacgccaugugaauugugagccccaggaagauguagauugugaaugacucuugagauugagucaucuauccauacuuucagaguucagagaaucaacuaguaggcauuuaccuagaguggagcuguggaggugagaugugggcugcuuccacguuagcugaagaaaccuggagcuguagguuauagagagaagaaugacuuucagggccccuugugggacauuuugucuagaacaaugggauccaagcuuugggucccuccuaaaccaaccaagaagguucaacuucuuagugcuuuaggacuacauggagcauggccucuugcacaaggcaaacagucacugugcaucugccaugugguaagugcuaugauaguggagugggccagaugaugggcuccuccaaaagauguccaugugcuaauacccagaaccugugaauauguuaccuuauaugggaaaagggacuuucggauaugaugaagggaaggacuuugggaugggaagaucauucuggauuaucugggugggcccauguaaucagaaggguccuuauaagaucagaguaagggaaggaaauaugaggaggguaguagagguuggagcauugugcccuugagccaaggaaugugggcagccucuagaagcuggaagaggcaaggaauggauucugcccuagggccuccugaggagcacggcucugcugacucuuugauuucaguccaauaagacugauuuuggauaucugaccuccgaaaccuuaggaugauaaauuuguguuguuauaaguaccuaaauuuaugauaauuuguuauagcagcaauaggaagcuaauauagauagacacagaagaugaacagugaauacagcauaucucugccuucaagcagcucucauucuaguggggaagacaggcaagucaacggccaauuuuuuauuuuuuauuuuuuugagacagggucuugcugugucacccaggcuggagggcaguggcgugaauuuggcucacugcaaauuccaccuccuggauucaagugauucuccugacucagccucccaaguagcugggguuacagguaccugccaccaagcccggcuaauuuuuguauuuuuuguagagacaggguuucacuguguuggccagguuuguuuugaacuccugaccucaauugauccacccgccucggccucccaaaggguugggauuacaggugugagccaccgugcccggccucaaaagccacuuuugauaauagugguaguguccgaauagggcuauuaauccaggauucugugggaccuaauccagccugaccucaggggugccacugaggauaaguuggaggaaggugggcagggaagagccuuuauggugggaaaaaaagagcaucaaugucaucucagucagaucagaaaacuagguggagcuuacuggcaguccuugcaagggagaaagcugguuccaucuaaauuggugcagucucuguggcuguuuucagacuuaagccuuuugggccuugcauaauuggggagauagguugaaaaguccuguuuccucuucaggguugugugauaauagaguugauuguuccaggcacugccguggcuuuuuuacacauuguccgaucuaaucuucaaaacaauugccugagguagggacuguuuuccucauccuaugauugagggaaaugagacuuaaguuaaucaggcccaacagcacacagcuuguaaguaguggggcugagauucgaauccaggucuuuaggugucagagcccauguucugagcaugguuuucugcgguagaaaguccacuuggcgcuucugcacagccaaagaaacuaccaucagagugaacaggcaaccuacaaaaugggagaaaauuuucgcaaccuacucaucugacaaagggcuaauauccagaaucuacaaugaacucaaauuuacaagaaaaaacaaacaaccccauuaacaagugggcgaaggacaugaacagacacuucucaaaagaagaccuuuaugcagccaaaaaacacaugaaacaaugcucaccaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuaauggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauauaccauggaauauuaugcagccauaaaaaaugaugaguucauguccuuuguagggacauggaugaaauuggaaaucaucauucucaguaaacuaucgcaagaacaaaaaaccaaacacugcauauucucacucauaggugggaauugaacaaugagagcacauggacacaggaaggggaacaucacacucuggggacuguugugggguggggggaggggggagggauagcauugggagauaugccuaaugcuagaugacgaguuagugggugcagcgcaccagcauggcacauguauacauauguaacaaaccugcacaucgugcacauguacccuaaaacuuaaaguauaauaauaauaaauuaaaaauaaaaaaguccacuuggccagauaugagaggaccugaguucuaguccuaggucugcuucuuauuagacuuagagcaggucaaccuacuuaccaaucuguuuuccugucuguaaaaggagauaagaggccagccugccucagagauguugugaguucagggcaauguugccugaaggcaacgugucucagacaccucuggagagggccuugauagugaaccccauccccuuaagggucauugagguggguuggggaauucggccacaggggaucauugagguguccacauggggcuauuauauuugcaucuguggguagugguggagauagaaagugggcaagaaacagcagaguggccugucucagggcacugggagugggguauaagucuaggagagagagguguggccugcaucauguuuucuccaaagacaugaaugcuggaggcugcugaggagaaaaaccuuucuugucuuggggucaagugacaagcauuuagucccagcccugccacuuaaccaucugugugauuugaggcaaguuggcuggaguuccguaaccuccauuuucucauauguaaaacagggcuaaugauucccauguugcagagcaugugaaagcauccugucccuuuccugguaugcaguggacauugauaaauaguggugaacucuagaucacuuuaguauuucccgggguuaauccaauaagucccaauucuuugcaggauuccacauuucucccuugccuuucagacucacuuaggcacauuguaguuggaugugaaggaaggucuggccauagaaugagacccccaugaauuauugagggggaagacccugugcuuccuggaaggagaugcugaucaguguuuuucugguggcugcaguggguacgcagggccauuuuggaagcgagaauguuugucuugccaaguacgagauugagugucaccgguuugcuuucugggaauaauggcugugccgaugaaauagauuuauggcgcugagguacgucacagaugagacugauuuuuuuuucccacuuuaaaugucgauguuuucuaauuauucaaauaaugugcuuauuuuagaauauugggaaaguaucaagaaagaaaaaaaugucuacuucuaaguccaggggugauuacugcuaacguuuugguaaauuucccuuucuucuuuuuucaaaugcacauaagcuuuuuuuuuaaauaugcuuuaugcacuuacgauaucauguguauuucccagaucauuacauauuccuuaagaacauuuuuauuugguacauaacagucuguggugcacacaugccauaauauucuuaaucauucccuguuccauaguuaggcauuuagauugcuucuacuuuucuccuaaaauacauaaaaauauuucacuuuuuaaagaacgauuuucuuaaauuccuggaacugggauuccuagaucaaagaauaagcacauuuaaaaguguauuuugguggacucuucuauuuaccuuauauuaaaaagcaaaaaaguuaugguguggugaggcggcugcaggccagcuugggugaggucccugcuucugaccauugugcacagaaggcugccuccuugcugcucacuugcuuccuggcggacaguacaaucagccucuugugguuugccagugaaauuuaaguacugggucagccuuuccagugcuucucucucugucaggaaguucaucugugaaucuaaccuaaaucucaucugcugcauuuuaaauccucaccugcugucgcuuccccucaguggaguggaacagagcaaagcugcgcacugucugcaggcagccuuguucaccucucucccgugaccacugcgacgccagcugccagccuuauguuacccuggaggaaauuugagggucucuggcuacugcugucgagacugggagggcaguccuugcaucgaguugcugcugauaacaccagguaggguuucugaauccuagagugcccaugcugugcgggccagcaucucccgcgcccucugcagaacuugugggggcaauuagcauucagaguggcacucuccucuggaugcugugggucuaucagauucauucuuugggggaaaaaaaaauguggcuggagcagggacuaauugcauuucagccccaauugcauuggccaagcgguaaauguacagugaaggaagauggccaggcaaggaggggcguuugagaacauucugguaauaggaaauccggcugucauugugggagggaaaggucccacccugggccucccacccuuggcauaaagcagcugugcccucuaccagaacagccuuggccaccuuucuuagcguggguccauuguugagagcugacagcuuuauuauggagcaguaggauguuaauuuggaagagaaaugaauauagcugcaacuucaugggcagcaagaggccccuuguguccccucacuuaggcauuuuagagcuggcuggcaauuggccagcaggguggagcgagucacacaggaaagagucugggaauugaguccuugcagcaccugugagaauaucugagcauggcuagaagcccagaggagauggagccugaagccucccggggacccagucugggcugacugaccuccagcucccugcccuccccucuaucacagcaccuggagauccugccuuaauguuaacugcuugaugcucccagcuuguccuuggaaguucuacacacguaagaugagaugccuuguuuuacacuuugcuauucccuccuuccgugucucguacaguguaggucuugauugaaaugaagucagcauuuaagaggcaaaacccagugguuuugggcacucaguaaagaagcuaguucucugcucuucagcucccauuuaaaauauccaugucagaguauuauucauccuuuugaagaggggaagcuuuuucugucucccuuuauaguuauaccaaauucucuuuggugcugaaugucacuguacuuuuagcuuaguggguugaaguuggaggccaaaguccccacugcaaggccuuagcccagugagugccaccccuggcugcacauuagaaugccuuggggagcuuuuaaaaaauaugucugggaccuagugccagagauucugauuuauuuggucuggacuggggcucuggcaucauuuuagaaacauuccacugaauaaggaguaaggugugucugccauacccuaucagcaguuucccuuuaugggaagauacauaguagaagccugugacaucugcagcaguagguuacuccacauccuuuuuggaagcagaaaggguaaagugccaaaugagagcauugcaucagggcuuucaugugagggauuggcuugaugggaagccuccagagauguaucuugugcccauuucuguuaccagggugugcucuggcugugucgcucugcuugguaauuaagcaggugccguggacgggaugaggaugcuuugguuuagguuaaagauaaaaaggaagaagcaggauaugagugugucucuauuugauucaucagcacagagacuggauuaacuuuuuucucaagcuuuuggagcaggugggagagcguggggaaagagcucugagugaauugaggauggcuuuucaguuugggucuagaagacaggucaaagaggugggugccugcagugaguguucaacccugcauggcucucuguuauccccgagaccucacuucugccaguuuccucuugaauguuguagagaccucuuuacagaggagucaauaagggacaagacuacugccaugagugaauaagcaccuuggcuguguguguuuggauuuggccguggguuccuuuuugugacugagaaagauugcacuccuuuuuggcuaaugcacacgacuugauguccugagucuuaccccuucuccgaugcccucugggguguuugugguuggagcuuuguuccaagaguagccucccagguugaagggcuguuuuugugguugcagcugccccuuagcuucugucucauggcuggccugcucccuggcccugucagccuuagagaaguugaagcucccuugagagaaccccuguaguuuucccacaggugaggaggccugcggguuaacaccuggggugcugaugaugccauuccccaaacuggcaaauccugcuuagaaaaaagauacacacauuuugauuuccucgugcuguuucaaacugcaauuugcuaaucaccuauaacagauuccucuugggugcuuguuaaaaaugcacaaucccugggaauaaaaccgaggaauuugcauuuuagccaggaugccaagucaucagauauaggaauguuucagaaucacucaguuaaaaaaugucacaucacucuugcuuuacagucgggaaaugugacagagugguuaagugacuugcccaggaucacacaguagauuacagcuggagccaagccuggaagaacucaaagccaaguccagaauguuaucuccacuucauauuuguauggagcuuuguucuuugcaaaguguaguccaucuuucugcuccucuaguuugcuuagauggagaaugcccuuguugauuuugggccagauuauucuuuguuguggggggcuguccuguauauugcaggcuguucagcagcaucccuggauuuuacccccuggaugccaguagugcuucccaguugugacaaccaaaaaucucuccaggcauuaucaaauguccccuggggggcaaaauugucccaguugcaacccaguugucccaguugcuuuagugggggaagccguguuccagggauguucccuagugguaucccaugacauuuauuuuuauguuuggggacuuguaaaauuugcagagcuggcuucuucccagcuucgcuaauaagcuggauuacaaacauaaaugaagucacacugaauauaagcucucuccucaucuuugcuuuggcuuacagagggaaggcauaaauaagcuuggaaagaucacugacuuuggacuccaaucugcaauuugccugccacccugggcuuucuaggugugugaucuugggcaagucgcuuaauuuucuggaacuccuuuccuuaucugauuaugauagaaagaaauguuuguugugaaugagaauuaagugacaccuuggauguggaaguguuuauaaaacauuacucauauauuaauuggugcugauaaaauucaggucuaauuacuagcacuugagauuuucucaaauuuaaaagugcagaacucagcacagcaauucuagacuuguauuuggccaaguauauuauccuugucaucuucccauaaaguuaaucuuccccucucccacuuuaaauuugaucuaccucuucuugguggccauugccguaucucuuuagggucauugucucugcaagauuggccauuagguuauuaccucuggcaacagcugguuucuuuuuauggugagguuuccgaagggcugucagaucuauuauaaaaagugaaaccaugacacuuuauuuucccucauugccagcacccagagaggagcaugguuaauucauacaugaggccugaaugugggcagugaagcaagcaucaggcugcaaaaagaugcagaugaacuuaaguaucaaggucuuugggcucuuuggcacagccaagcucagcuagugcagugcuucaguuugcagaggaggaaacugagcccagagagggagcaugacugaggugucacaggggcagagugagaguguggcccaggcucuccaggagcucaggcucucagcacaguauuugcaccugucuaggcugcugccuuggagagugugguggggagcaggcccuacucuguaucuaggguacuaccgcugccuucuguuuuccuucagauguugccaugcaggcccugugaaacugucucuuucugcucaguaauuuauggauagaauuuuaccagaauacacauaguacaagaugugguugucacugauuuuuggaauaucuugaggggaaaggcaaugaacauuaagaggcuccuguuucugugugaacauagaaagacugagaaacugaagcuuguuuuguuccucaguaaccucaaacaccaccucuuggucacacauuuucucccgcuaggaugugcuccuauaucacuacuaauauuaauuauuaguguuauuaauacuuggcugcugaguacuuacuguacgucagugcaugugaaguguucagcacaaugcauguaucauuuaauccacccagaaacucuacaaagaugguacuguaauuuucuccauuuuguaaaugaggaaacagguuaaggucacagaguaggggggagaacugagauucaaaucccuccaauuuaugaagccuaaauuggcuuguuccagcucuguuguacugauuucuguggaggugauuaccguaaaccccaccugccugcuccucuucuccagccaaauuugaagcauuugaugucccuguguuagucugcuagggcuggcguuacaaaauaacacaggcuggguagcauuaaugauagaaguuuauuuucuuggcugggcgcgguggcucaugccuguaaucccagcacuucgggaggcugagccggguggaucaccugaggucaggaguuugagaccauucuggccaacguggugaaacaccaucucuacuaaaaauacaaaaauuaccugggcaugguggcacaugccuguaaucccagcuacuugggaggcugaggcaggagaaucgcuugaaccccagaagcagagguuucagugagccgaguuugcgccacugcacuccagccugggcuacagagcaagacucugucuugaaaaaaaaaaagaaaaaaaaauuauuuucucagucugggagcucgaaaccugagaucaaggggucggcagguuugguuccuucugagacuucucucuuuggcuugaaggcugccaccuucucacuguauccucacauagucaucucuguguccaauuucccccucuuaugagaacaccagucauauuggaugaggauccacucuaaauaccucauuuuaacuuuuuuuuuuuuccaauuuucuuuuuuuuuuuuuuauugaucauucuuggguguuucucgcagagggggauuuggcagggucacaggacaguaguggagggaaggucagcagauaagugaacaaaggucucugguuuuccuaggcagaggacccugcggcccucugcaguguuugugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacauggcaaccauccgauuucucaaucuuuuccccaccuuuccccccuuucuauuccacaaaaccgccauugucaucauggcccguucucaaugagcuguugaguacaccucccagacggggugguggccgggcagaggggcuccucacuucccaguaggggcggccgggcagaggcgccccucaccucccggacggggcggcuggccgggcagaggggcuccuuacuucccaguaggggcggccaggcagaggcgccccucaccucccggacggggcggcuggccgggcggggggcugacccccccgccucccucccggacggggcggcuggcugggcggggggcugaccuccccgccucccucccggacggggcggcuggccgggcagaggggcuccuuacuucccaguaggggcggccaggcagaggcgccccucaccucccggacggggcggcuggccgggcggggggcugaccccaccaccucccucccggauggggcggcuggccgggcagaggggcuccucucuucccaguaggggcggccgggcagaggcgccccucaccucccggauggggcggcuggccgggcggggggcugacccccccacauccuucccggacggggcggcuggccagguggggggaugacccccccaccucccucccggauggggcggcuggccgggcggggggcuaacccccccaccucccuuccggacggggcggcuggccgggcggggggcugacccccaccucccucccagacaggguggcugccgggcggagacgcuccucgcuucccagacggaguggcugccgggcagaggggcuccucacuucucagacggggcgguugccaggcagagggucuccucacuucucagacagggcggccgggcagagacgcuccucacaucccagacggggcggcagggcagaggcgcuccccacaucucagacgaugggcggcguggcagagacgcuccucacuuccuagaugggauggcggccgggcagagaugcuccucacuuuccagacugggcagccaggcagagaggcuccucacaucccagacgaugggcggccaggcagagacgcuccucacuucccagacgggguggcggccgggcagaggcugcaaucucggcacuuuggggggccaaggcaggcagcugggagguggagguuguagcgagccgagaucacgccacugcacuccagccugggcaccacugaacacugagugagugaacgcgacuccgucugccaucccggcaccucgggaggccgaggcuggcagaucacucgcgguuaggagcuggagaccagccuggccaacacagcgaaaccccgucuccaccaaaaaaauacgaaaaccagucaggcauggcggcgcgugccugcaaucgcaggcacucggcaggcugaggcaggagaaucaggcagggagguugcagugagccgagauggcagcaguacaguccagcuuuggcucggcaucagggggagaccguggaaagagagggagagggagagugagaggagggagagggagaggaggagccuuuccaauuuucuuucuuuccuuccuuccuuccuuccuuccuuccuuccuuccuuccuuccuuccuuccuuccuaccucauuuuaacuugaucaccucuuuaaggaucuaaucuccaaacacaguuacauuuugaaguucugggauuaggacuuugaauauuaauuuugaagggaacacaguucagcccacaacaguccugcuauuugucagauggccagcuggaacuucuagggcuguccugaugugugacagcugguuaggcugucaccugcccucagcagugccgagagccugaaugagaagagcugucccucacuccagggcccuagagggcugcuaucaaggaaagcacagccuucagagacuaaggccugaguuuuggcugauuggacuuaaccuucuagagccucaucuuccucagcuguaaaguggaggugauuccugucuuaaauaaauuaaacacuucauauugaaaguguuuguagcuuugaguucagauggggucgugagacuaaugauuacucagcgccuaauccauuacccccauuccaggggaugguggagugggagcuuuggggaagaaugcuuaagggaaugaaauacagagacaguugaaaaacaaacugaucucccucuccagucauuucugaggccuucuuacccagcuuuucaccuucuagcaauaccauggcacuguguguggcugagguucuguggcuccaccccagagggccucauuuugcucuucccuggggcucugcugcaaagaagucagcuuggagaggggcugugggcucagcuugcuuaaagagaaauugccugauauacaguuuggguuaucaugaccuugaggaaaguauagaauuaaaaaaaaauucuuuuauacuaugaaggucauauaacugcauuacauaaaaaaaugggauaauagacaaaggggaaaaacagccauauucacuucaccuuaauguaucuucuggauuuuauagaagaguggggaaauaacauuuauuuuauuuuaauuaauuuauuuuuaaaauuugagacaggaucuuccugcucugacacccagguuggagugcaguggcaugaccauggcuuacugcacccucgauuucccaggcuccagauauccucccaccucagccucccaaguagcugggaccaugggugugugccaccacacccagcuaauuuuuguauuuuugguacagaugggguuuugccauguugcccaggcuagucucaaacuccugagcucaaguaaucugccacuuuggccuuccaaagugcugagauuacaggcgugagucacuguguccagcccugucuuuuauuuauuuuaaauagguguacaugauauggcauggauuugacaggguacaaaguagugagaagucuuuuuacauaacaugcuuuuagucauauauaugauuuugacuuuuucaguuaacauugcguuaucuuuuuaugucuaaacauuucuuauucuuccccauuuugaaguuuuaaaauuugaaagcaauauaugcaaaguauauuuaugaauuuuuauucuuaaauaauggauagcaaaauaccaaauuaguaacagugguggcauauuacaguuaauuuuuauuauguaugcuuuuauuuucuaaauuuuccacaaauaagcaguaauauucagagaaauaugcagaagagauaugcauaaucuuagaauuaacauuuuggcuuauuuuuauccaauauucauuccuugcauuuuguaaagauaauugagauuauauuuuauauaugaugugguugcugcuugguuuucauuuaacacaaagaucuguuaagcuuagauucuuuauaaacuuuauguuuaauggcuguacaauguuucaucaaguauaaacaccuuauuuugcucaaccauuacuucauaguuuccaguuuuugacuguaaaaauaaugcugugauggacaacuucagaaauagucuuuggaaguacugacccugaaaaaaaucuguuuggagcuuagaggagcuauauucccaauggauggguacagagcaggcacucagauguugcuugugcauggagaaugaggugacaugugugaaggaauguucuguaaaugauuucaauaaaugauagcacguaagaauaacaaauguuuuaagccaaugaaggccugucaagagggagcccaaaauggacugcaaaaucgaaaccugucauacucugauagcuugaagguuuuugagaggguucuacaauuuuggcugugaaagaucugagggaaagauagugauuugcagaauuguacagcaggaauguagagcaggcuguaucuuuguaccauguugaagaaugaaguugcagcgauccuuuuccagucucugaaggaagagaacauggcaagaaggacaaaaacugaaaggccuguuugcugucugacugugugcugccccagguggcugcugaaacuaaaucaauuuguggaaggcauggaagaguuuucuuaguuugauuaugucuuuuggaauugaaugggcaaauagaauuucuuugaaagaugucucuauuucugccuggaggacucuguaauuuggacguugugagaagagccuaucuuuauuuugaauuuggaaccauugacuccccuuucuuuaugcugugaguuauuuauaugccaagaagcacaguggaggccuuuucaccuucucaugacuuuaagaaauacaggaaaacagcauucucuacaauccauaaucccugaguguuggcaacaaaaaaaugaaagauauucuaauguaggcgucugugcaauggugauggguuauggauggucaaugagaaccuuggcugccaguccugggaacugaucucagccuucccugggacccucuggaugaggggauccucauucaccuaacugagcaaacaucccaaacaugcucuguuugcccauuuauucauuccauucauuaauguacucauugauuccauuugguucacuucagcuacugaucaccuaauguuauaugccaggccgugugcauggcuguaauuauagagcugugacuaagaccuuccuuccuuccuguucagucaggguucaguagcaguagugagaaguuauucucgcuuuucuaaacagaaauggauuuaauacagugaacuagguguuuacaucaugauuggaagggugcaggaguaggcucuaggcugaccuuuggcaaugauaacuaaaacaagacugugaaaauggcccauaaguaauuguuuucauuuuccuuuuaauucaacucuuuugagcuccccuugcccuuugcucccaacuucucugucccagaucuuaggcucucuccuuaugggaagagcuguuucaaagcauuuauggauuguaaagugugaauaaggguguuguuaauaauaacugucacuugcugacuguuuauugugugcccagcugucugcuaaguccuuuaccuguguuauuucaauccucacaucuguuggguaguuaauauuaucucuacauugcagagaaggaaccugaagcuaauaaaaguuaaaugacuugccuaggauaauucagcuaauaaguaacauuugaauucagggagugucucuguccagagguacuugcaguuuaaaagacaagcugggccaaagaagauacacaaaugaccaauaagcaaaugaaaagaugcucagcaucauuagccaucaaggaaaugcaaaacaaaaccguaaugaaauacuacuuuacacacccuaggauguuuauauuaaaaaggacagauacuuuagaagugcuggugagggcguagagaagugggaacacugaugcacugcugguagaaguguaaaaugguggagccaccuuggaagccagcugcacguucucaaaagguuaaacguaaaguuaccauaugagucaugaauuccauuccuagguauauacccaagagaagugaaaccauguccaccuacacaaaaacuuguacgcaauucauagcuacaugauucauaauauccucaaagugaaaacccaaaguccgucaacugauggguggauaaauaaaauguggugugucuauauaauggaauauuaucuggccauaggaaggaaugaaguacugguacaugcuacaacaagaacgcaacaaugaaccuuguaaacauuaugcuaaaugaaagaugccagucacaaaagaugaccuagugucuaagccuauuuauauggaauguccagaauagggaaauccagagagauagaaaguggauuuauggcugccuagggcuggagcuggggugaucgcuagagaguaugggacuuccauuuagggcaaugaaauguuuuaaauuugauuggggugaugaucguauaacucucaguauacuaaaagccauugcauuguauacuuuauuuuuauuauauuuugagacaaggucuggcucuucugccuaggccggagugcacugugugauuuccacucacugcaaccuccaccuccugggucaaaccauccucccaccucagccucuugaguagcugagacuauaggcgugcaccaccauacccagcuaauuuuuuuguauuuuuuguagagaugggguuuugcuauguuguccaggcugggcuugaacucaugagcucaagcuaucuuccggccuuggccucccaaaaugcugggauuacaggcgugagccaccaugcccagcuacacuguacacuuuaagugaauuguuugacaugugaauucuaucucaauaaagcuguuccuucccacccccgaaaaaagagaaaagacauauugggaaggauaaugcuuaccuaaauaaaugaguugcuagugguggaauuuagaggagaaaggauaaacccccaugcaguuuucucaaacuuuuggcuuauauuaguuugucuucacuauaguaaagugaaaaaauggauuuaauuuagcacaaaauuaaauauugagcucucagccuauugucuggcuggugagccuagagcugauuuauuuuuucuucagcucucugcuuuccuagacagcuuuuuuccauuuuucucuaaggaguauauauuauuuuuuauaaguagggaaccaaaaauguuucauaaaauauguaucccauugggucauacaaaaagaacaucauggcugggugcaguggcucaugccuguaaucccagcacuucgggaggucgaggcaggcggaucaccugaggucaggaguucgagaccagccuggccaacauggggugaaacccugucucuacuaaaaauaaaaaaauuagcuggcugugguggcgggcgccuauaaucccagcuacuagggaggcugagcaggagaaucauuugaaccugggagguggagguuacaaugagcugagaucgcgccacugcacuccagccugggugacagugagacucugucucaaaaaaaaaaaaaaauaaaaaaucaugacuuccacauguuaugccacuugagguaguuagagauuuucuguccuagaaaaaagauuuuuugggggaaaaaagugagagaucucaugaguguuuguccaugaacugaacugauguuggaauugagccauuccucaaagccuccucccuuucauccucucauuucuuucuugcccuuugaguuuguucaaggaccacccaguuguuaaugaucacaauguuguauacaauuuuguguacaauuuuauuuaaagggaaaagaucuggaaggcagugaugagugcuuaugucaaguugaauaaaugcaaaaggaagaaauauaauggggugucuaugcuguaggucauuuguuccauuuuauuguccaaguauaauugcuuaugccagaauuucauagucuacuuguaaccuaguaaaacaccucaugaaaguuacaaggcauuaacagaaugaaaauucacucuagugucuuccuuuccaccugagcuaaggacagacugaaccaugcauauauuuuuuuaaacaagauuuauggaucagugaagugaaauuuauugaguuccaacuguauguuugagagcagaauuugcugccaugcaaucagaguaaagcugaggauuuacagccugugagagccuuaaauguguagaguuauuuucccauuacacauuagguuagcaacuuggagugugaccuggauuucucuggcuggacagugacaugcucuggggcuuaaaggccuucccauuaacuaugugcauuuguguuugucugcaaguaagguuuaggcacccucccagcuaaaggggagagagaugaggagcagcaccaccaagugccugccccccacaccuuauccaggugagcucacugacacuucccugccuaccccuagcaccugggcucccugcugacaccugggaccaguaagagcaggccaagaacagcucacaaguaugguauaaagcucaaagagcaaaguucaguucaugcccuuaccacuuauaagggaucuuugccuuucagcaaaucacuuauccuucuaaagguuuuccugcccuauaauggaaauaaugcuaucuacuauacuugcuugugaugaauauuaaaugaaaaucauaugggaaguacauagcacagugccugagacauagcgggccuucaguaaagaucauuaccucuuucccagucugcuuuucuuguuugcuuucccuuucccaggccucauuccuacacugaguuggcagagaaaauuacccaguuuucuccacucauaauuagaagucaccuguuaguauuuuuauuaacauauuuucuccuuuaugcaaaaguuuuguuuugagauggaguuucgcucuuuuugcccagcgcuggagugcaauggcgugaucucagcucaccacaaccuccgccucccagguucaagcgauucuccuuccucagccucccuaguagcugggauuacaagcaugugccaccacgcccggcuaauuuuguauuuuuaguagagacggggguuucuccauguaggucaggcuggucucaaacucccgaccucaggugauccgccugccucagccucccaaaguguugggauuacaggcgugagccaccgcgcccagccauaugcaaaaguuuugucuauauugaacacauuuccccagaguaaaacccauugaaucaaaauauuguuuacucuagaaaacaccauccaagagcucuuggcuauacuuguccuuuugcuuuuccauuuagauuuuaagauccguuugcaaagauucgcaaaaaacccuaugagaucuugauugguuucacauugaauauauagauuaauuuagggaagaauuggcaucuuuacaaaauugguguuuuauagcucucauuuaggccuuuaaaaauguuuuucagugaagccauaguuuuccccaugaaaguccuaucagaguaucagagguucaugcagagcagagugaucagcauagguuuggauuuuagaggagcaguugggugaucugaggacagugaacuagggggaacaaagucuagaagcaaggaggccaguuaggaggguguuggacuaguccacgugagagaugauaaaggccaggauuuaggacugugagaagguagaggagccaacacaugccagaaacacuuccuaggaaguguggacaaggccuucuuaauucuuucagggcaaaauaaggaagaauaauaauacuugcugcuauuauuaguagcucacuauggacugggcagagugcuaacuuguuacauucagccuugcuucuucuugaaaugcuccaaaguaggcacuauuacuucuguccuccagauaaggaaacuaaaucucagagagguuaaguaacuaacucaaagucacacaggauuacaaagcagguauucaaguccagaucugcuccuuuccaaaggccacugaacacucaaaucuaaucuugggcugucucaguuuauugaaaauacuuuaugaaaauauaccagaccuuuugaauuuuaugacugaaagaaaaaugacuaaaauccuguucucaaucauagucagaaaauugaauuggaauguuucccuaguuucauaauguuugauaaaagauccagacagaucugaauuuaugagaucuauaaaaauucgaguuguugaaagagugggagaaugugggcuuuggggaugccgggauggaucaugugacuucauggaaagcagcaaaaauauuuuugaauucugaaaguguuccuggucauguauuucuggguaacguuuuguggauguuuuucuuccaucagucagaaaaaaaaaggaauggccuuaauuaaaauuucuauugucuuugccauagaggaaggaagccuuuuggugguugucauggugauaucugaaugacacuguggaaguggguagugauugccacccagagcccugaaaugagcguuugucauuuuccuuguccccugagaggcuugcagcaccgaacugcacauuuccuuaaucgccuuuuacauucacauuugagccaaaugugugugugcaggcaaaugcucuccgcugcagcuaguuagagucauaaagucugaaaccuuauuucuaauugcuuuguguuccugaagcaaaauggcauaugugagguguucaugaaaacucucagaaaguaauuaggaacuaccagccuuucacguggcacagcgggauagcuugcaggccuccucccccucacugccuaauacaccuucucugcggguggcccauuuaaagccuuguguacuuaaugcauggcaucucuaaaagcugccacuuaccaccaguccccugcucccagccagcacacuggagccaucauguuacaggcuggcagagugcagcuguuucugacaguaagaguaggcucuuuugcuggcuuugggguuucugcacuauaugauugagguauaggaaggaaaaauggggaggaauggggcugugcagcuggguaaugugauggguuucuuggagcucagucugaaggagacaagaugaugacgucucucgcccccaccuggaugucuguucuguagccuuuuguguagagugguauuacgacaaagaacaaagaauuugcuguaaaagaaccugguucacuucuuggcucuacccuuagcuaacuauuuuuuuuaacuugggcgaaagacuuaaccucuucuguuaaaugguaauagugucaguacuaccucuccaggucauugcauugcaugagacuuuggcaacugucagggcguuauauauauguuguacauucuaauccacuggcuguucauuaagccaauacuguauacuaggcucugugauggagaaucagagccaacagagaagcaggguaagcacaacaaccacaaugaggcaguaaaaguucucuccgugugugcacaaacaagcucuuaccucagccucauaucguggaaggcuucuaaaggacaaaagccagagagauaaggacaugguccucaagaaaagggaacagugugugcaaagauacugagacaccccuggagccuggguauccauguggggguggugagccaugaggcagggaacagguuuaagaaguuuauccuuuuuccagaagguaaugggaacuacuggaugauuuuaaggcuggaaauggcacaguuuauagauuuagagcuauuuacaggcaacugucuggaggaucguagaaagagaauugggaauaugugggugggugggugcagagauaggaugaugggcuuagggacuguugcagccauucuacugaguggcuguggggauggagaggaugggccagguuggggauauaggaaguagaguuaacuagucuugcugacugauggggagugaggggaaaagguaggaugccuuccagcauuucuaggugcuaugauucuuggcauuuggggagggacagcuuuucauugugcgggauggugguguuuagcacucugggcuccuugcccuucagacgcccccuccccaaguuguugugaugacagaaaugucacagccauucuuccaagugcuccuuggugaccuucaccaagauggggaauaaaagaauagaaacaguuuaggaagauggcaaaggguuccacuuuggaauauguugauuuaauggugccuagaggacaucuuggaagaagugucuaauagacaguuggauauagggaucugggacucuagagaguggacggaacucagagagacagcuuuagggucauaaccauggcagggcaggagcuuuccuggggaagauauuuagccugaaaaggcaagugggcaccagaaccuuggggaccaucguguauccuguuuagucuucugagcuggggagaacugaugguauucuagggcuguuuuauaggggagaagagacugacgcuugucaagagcaaauuuuuacaaguuucucucuuaaucaauuuuggcagauucucuucuuggcucagccaguguccacaugaggcuaaggagaaguagauuuugccccuuucaggugaggguuuguuuauuguccacuuuguggccagugggaccaagugucucaaugacuaggcuguuacuaucaccaccuccucuuggauuuagaagucuuugugcauuaguaacgaggccugauacaauuugcuuuuuucccugcaauggcagauuguuccuuggugcccucuguguucuugguucacugauuaauagacacuugaggaauugcagggagguguuuaacaugcaucagaaaccaucacuagcagagaaaagugauucacugagcucucucucugcugucugcaucccucccugcugacacaguuugacacuagggaacugagucuggaucuggaaaggcgcaguauaaaugugugauucagagucagugaugugcagcuguugccaaaggaggaagugcucugaagagguggauggugcagucgaggaugcuuugugcucccauuucuuuauguuaccuucuucagagguaggaguuauucuggguuaaaggucaguagcaaguucgggguucuaaccugcagguuuccagccagucaguguccaugccugauugcugggacuucuagacacaaaugaggagggccagugauuuauuuucagaggauggaggccccuaauaagauagcuucuuauauuaaacccuuacccuguacuggaguuuucuucuugccuuagaaauguaaggaaucgguuuggccguguugucuucauggggaauaguucaaccuuugacuccaccucuggagucaaaaagccuggauuugaauccuggcucuguuccuacuagcuguguaaacuuauauaaaucccuuaauuuuucugauccucaguuucuucaucuguaaaauggaaauaauaauaacuaccuccuaggaugguaauacgauaugagauaaugccugcagagugccuggaguguaauauguuaugaugugauuuguauauaauaugcucacugaaguuaucauuauggaucucucucuuuuaccuugugugguucuuuaucuacuccccuccccugcccccaguuuuggauaucugcaggagaagucucgugcacugggauggcgggcucucuguuaggguuauggggagucaguagguuuucuguggggagaaggggccccaacaagaacauguacccuuaccauucaccuucuucauuuugggcacuauuuaggagauauuuuacaaagcuuacacuacgaguguggagcuaugauuggaaccuaguucaggcuccaaagccacacucuuuccacugacuauuugauaccucucuccugcucacccugccaucuugccuugcauccugcaaaaccaaaaagaaaaagaaagaauaaaaccagaaacaucugcugggauauuccauuugggcacaguggugugcucacuggaaacuccagguacgugggauccugugggucaggagccuucuuccugcucuguuccucuaacugggacucccuuccugaaugggcaucauuaggaaauugaagaggaaacugguuuggguggagaauuuccgaaaucaucccauuuugcccuuuccuagaagugagauagugagagccccucccugauuagauguccagucugucccccaaccccugaugcugggauggucccccuucucugggucauggagugaugaugggcaggggaggaacgaagucucacaggaccuuggcaaccucccccuccugagcuguugggccucuggagucccuagacucugguauuccauugcuagaggaccaguagaaggggcaguuggaaagaggaggcuuugccuagccagagguccccagcagggugggcugaaggaugcuuccuaaccugauucaguacagcaucaacacuggaagcaucugcaagaggcugcuuuacuggagccucuggaauguggccgggcuacuuuuucuuucacacuccauggauaacuuaaucuuuuccaaacaaagacacugugcuuuaacuccucauggacaucccuugggcuuugggcacugcuggcccucagaucugugugcugauacuuuacagcacaguccugguuuacggaguaagaguaagcgcuacaugucaggauuuaugugggucauuccaugcugcacaccugcaaaugagcucauacagcagacuuuuugccuguucuugguuuucuccuucuguuacugcucugaccucaaggcaaugggaaaaguuaccagcugugucuuccuugugggggggcggguacuagagaauuacagccuucucugucacuacuuucucagccccaacaguguggaggugacacugagagaaaaggaauccaguaacauuuaguugcagggcagcaccagggugucagagcuguaagagcucccuguguucaucaucucccaucuuuucccauuuuauagaugagguaaaugaggcccagaaagggaaagccacccguuuccuucccacuugcuugguauuauuguuuaccuugaacaaacuaaaugcccacaguaggguacagaggaaauaccgugaugcaggagaacaguuuggcuucuauacuuggauuccaaugggaauccuaaacucuuuugaaauguguggucuuggacaaaugauuuaaccuauccuaugccugaguucccugaguuaagaugauaauaccuuguaguguugacauaaccguuagagauaauacaugcaaauauuacaagcaguuacucacaagugguuuguuaggggauacuggccauauuggacgauaagagcuacaagagaaagcuugaagggucgagcccucaugaaugggauuagugucccuauaaaaggggcccuagggaacuuguuuacaccuuccacuaugugaggaugcagcaggaaggugccaucuguaaggcaugggcccucaccagauaaugaacgugcuggcgucuugaucuuggacaucucagccuccagaacugucagaaguaaauggauguuguuuauuaaauaaauaaaacaaaguucaacauagauauugucaauuucaauguuaagauuccuggcugggcacaguggcucaugcauguaauuccagcacuuugagaggcugaggcagguggauugcgugagcucaggaguuugagacuagccugggcaauauggugaaauccugucucuacuaaaaauacgaaaaaaaaaaaaaaaaaaaaaagaagcuggaagcugggcaugguggcacgcaccuguggucccagcuacuuuggaggcugaggugggaggaucacuugagccaguaggguagagguuacagugagcugagacuguacuacugcacuccauccugggugacagagugauacuuuaucucaaaacaaaacaaaacaaaacaaaacaaaacacacacacacacacacacacacacacaaaauaaaacaaccucuccugcauggcugugaccaccuacucuugcugcuaggcuucugggaguuggcuauaaguuuuuagccauugcucuguacugggccuuggugcucuuuucccaccauacauauuucuucaugcucaggaucuccauauccuacccacauguuucagauaucucuugacucacauaguugucaaaugaugcauuuuauggauucauagauucacagagcucgugaggagcauaaggucaucuuggcagauugcaugcuugggguuugcauucuuccauuaccaacauccuugccagaugauuuauuuggcccaggcuugaaaacuuccaccaauggaaggcaguuggccagugugauguucagagacucugugacauuguugacacucaguuccuugaaaaauaugccucccagugacuccacccacugauccuaguucaaucauguugaaccucagggaacaaauuagauuacuucccgucuugauaauccuuuagugaugaagacagcaguuguguccccugaguuuuuugaaaccugaaaacuccaguugcuucagugauguggugguguuaacccacuuagcccuucacagcccuggucugucucuccuggacuuccuccagcuuucuccucuggccugcagguaugauuccuagaagugaacacauaauuggguggagucugaucaguuuaaaauugaauaacauuuuacccccuuguuuuggacucuauacuauuauuaagugagucccaagguccuaguggcccuugugauagcuuuuccaugcuguugacuaauuggauuuguaguaaaucaaagccacuaaacuaauacagauucuguauucacuugcuguggcugcuauaacaaauuaccacaacaguaguauaaaacaacagaaauguauucucuuacauuuccagagacaagaagucgaaaaucaaaguguuuacagaguugguuccauuccauaccucucuuugcuucugauggcugccagcaauucuuggcauuccuggccuauagaggcaucacuccaaucuccgccucugucuucauauggcucucuacccuuuguauauuuuauaugccacucaaauccaggccacugauacuggauuuccacaugaggucucuuggcugcacacagauauuccaagcucuaaaauauauuuuuugagucuggguggcucaugccuauaauuccagugcuuugggaggccaaggcgggaggauugccugaguacaguaguuugagaccagccugggaaacauagcaagaccccaucucuaaaaagaauagaauagaauagaauagagaauaauagucuagcaugguggcacugcaucuauacuagcuacucaggaggcugaggcaggaugaucacuugagcccaggaguuugagacugcaguaagcuaccaucaugccacccacuccagccugggugacagagcaagauccugacucuaaagacauuugaaaaaagaaaaaaaauguauauuuuuacauauuuuuaagcaauacauauauauauauauuuuuucauguuaguggaaauuaaucacuggaagauggauuuuaaggcaggacauuaauuuuaaaacaauguaugauuuuuuucuuaauccuuguuuucgggaaccuaguguuaauuuaugguucaguaauaacuguuaccucaaucaauuucuuaaccuucccaggucucaguuuccucaucuaugcaacaaagagacuagaugagguaagcucugagucauuuucaguccuacaacucuuaauacuguggaauuaauuucuggaaagcaagaguuaccaucuaugauaaaauaggucucaauuuguuugcuuuauuuacuguuauugauuuaaagucuguuuuaucugauauaaguauagcugcucuugcuugcuuuugguuucuguuugcauggaauauuuuuuuccaguccuuuacuuuguaaaugucuuuaucagcgagguggguuuuuuguaugcagcaugugguuggaucuuguuuuuaaauccauuccaccagccuguaucuuuuaggaguauuuacuccauuuauguuuaagguuaguauugcuaugugagguuuguucuuguuauaauauuguuaccucauugcuuugcagucucgauuguauaauugcuuuauaagaccugugaguuuuauacuuucauguguuuuuaugaugaugaauauugcccuuuuguuuccauguuuagaauuccuuugagcauuuauuguaggggcagucuaguggugaaaaauuccccuaguguuugcuugucuaggaaacauuuuauuucuccuucauuuaugaagcuuaguuuagcaggauacaaaauucuuggcuggcauuuuuuucuuuaagaagacuggaaauagaaccccaaacuuuucugguuuguaagguuucugcugagaagucauuuuuagucugaugggauuuccuucauaggggauuagacacuucucucuugaagcuuuuagaauuuuuuccuucauguugacuuugaauagucugaugacuauaugccuuggugagauucuucuuguaaugcaucuuccaggaguucucugaacuucuuguaucugggugucuaggcaucuaacaugaccagggaaguuuucuugaauuacucuuucaaacagguuuuccauauauuuucuucuucucucucugaaucaaccuauaacuuguagguuuggacguuucacauaaagccaauuuucucagaagcuuuguucauuucauuuuauuuauuuuuuuuguggggggugguguugacuccugucacucaggcuggagugcagugacgugaucacagcucacagcagcuucaacuuugcaagcucaggugauccuuccaccucagccucccaagcagcugggacuacaggugugugccaccauggccagcuaauaguucauauauauauauauauauauauauauuuuuuuuuuuuuuuuuuuuugagcaauaaagcuuuuaauucaccugggugcagguggacugagucugagaaaggagucagcgaagggagauggggaagggguugcuuuauaggaguuggguagguaauggaaaauuacgguaaaagauggucaucuauuguuagcagaggaggaggucacaagguacaugguggggagaucauaagacuuauuauccagaagaagaaugucacaaaguugauugaucgguuaagguggggcagggacaagucacaaugguggaauguuguaauguugguuaaucaguuaaggcaggaacuggcuguuuuacuucuuuugugguuuuucggcugccccagacuucuuggcuccuucaggccaucuggguguauaugugcaggucacagggguuacaauagcugagcuucagcucagaggccugacaaucaccacacuggcuaauuuuuuuuuuuuuuuuuaauuuuuaguagagacaggguuucuuuuuuuuuuuuaucuucccccucuugaauuuuguuuuuuuuaauuuuuuuaauuuuuauuuuuuuuuaguauuuauugaucauucuuggguguuucucgcagagggggauuuggcagggucauaggacaauaguggagggaaggucagcagauaaacaagugaacaagggucucugguuuuccuaggcagaggacccugcggccuugcgcaguguuugugucccuggguacuugagauuagggaguggugaugacucuuaaggagcaugcugcugccuucaagcaucuguuuaacaaagcacaucuugcaccgcccuuaauccauuuaacccugaguggacacagcacauguuucagagagcacgggguuggggguaagguuauagauuaacagcaucccaaggcagaagaauuuuucuuaguacagaacaaaauggagucuccuaugucuacuucccucuacacagacacagcaacaauccgaccucuccauccccuccccacauuucccccccgucuacucaacaaaaccgccaucgucaucauuggcccgcucucaaugagcuguuggguacaccucccagacggggugccggccgggcagagggucuccucacuucccagaaggggcagccgggcagggacugccccccaccucccuccuggacggggcggcugcuggguggaggcgcuccugucuucccagauggggcggcugcugggcagaggggcuccucacuucccagagggggacggcugccggguggaggggcuccucacuucucagauggggcggcugccaggcggaggggcuccucacuucucagauggggcggccgggcagagacgcuccucaccucccagaacgggguggcggccaggcagaggcgcuccucacaucccagacggggcggcggggcagaggugcuccccacaucucagacgaugggcggccgggcagagagcuccucacuuccuagacgggauggcagccgggaagaggcacuccucacuucccagacuaggcagccaggcagaggggcuccucacaucccagaugaugggcggccaggcagagacgcuccucacuucccagacgggguggcggcugggcagaggcuggaaucucggcacuuugggaggccaaggcaggcggcugggagguggagguuguagccagccaagaucaugccacugcacuccagccugggcaacauugagcauugagugaacgagacuccgucugcaauuccagcacuucgggaggcugaggcuggcagaucacucgcgguuaggagcuggagaccagcccggccaacacagcgaaaccccgucuccaccaaaaaaauacgaaagccagucaggcgugguggugcgcgccugcaaucccaggcacugggcaggcugaggcaggagaaucaggcagggagguugcagugagccgagauggcggcaguacaguccagcuucgacucggcaucggagggagaccguggaaagagagggagagggagaccguggggagagggagaggcagaccguggggagagggagaggcagaccguggggagagggagagggagaccguggggagagggagagggagagggagagguugagguuuauauuuuuaguagagaugggguuuugccauauugcccaugcuggucuugaacuccugggcuuaagcaaucuaaaauucuuucuucugcuuggccuagccuauuguugaagcucuuugacuguauuuugugauuccuucaaugaaauuuucauuuccagaaguucugucugauuuuuaaaaauaauauugcucuucuuucauauccugaauuguuuuucugauuuguguuguuuuucaauuuucucaacuuggcuuaauaaacugauaaacugagaaguuauagcuccuaagacagguuaucauuugcuaaucugaaucagaaaaacuguuauuuuguucaucuuuuggcaggauauauagaaacuaagcuguuacacacccuuaacgccccuaaucccucuuauugauuacuugccuuucauguguaagacacuaggggauuggcaucuaguuggcucucaaauauuuguuaaaugaaugaagaaauacacuguugucacauguuauuguugggggcaaguaaaucaauaucauucuggucugaccauguaguaauugugggcuuuuuuuuuuuuuuuuuuugagacagagucucgcugugucacccaggcuggagugcaguggcgugaucuccacucacugcaaccuccgccuccuggguucaagcaauucuccugccucagccuccugaguagaugagauuacaggugccugcuaccaugcccugcuaauuuuuguauuuuuaguagagaugggguuucaccauguuggccaggcuggucuugaacuccugaccucaggugauccacuugccucagccucccaaagugcugggauuacaggcaugagccacugcgcccagcaauugugugccuuuuaagauuucuuuugaauaccuagcugaaucaauuauuuuuuuuaaaugguggcaacuuuuugcaguugcuuucuggagcaguuuccuuaucuaugauguggacaacuguggagagcugaacuccagggccugugcuauaaacaccacaguagacuauauuuuucaaguugggagaggucugugaucuuguuccagguggcaucugguuagaugcuuuucuuuuccaggagucucugccuacugccaguggccucuuuggguggccauuagggcugcauccacugguaccacucuuccuuuggguucuauagggauagaauugguggugguaucuuucuggauuuuucacucuguggaagaaacagucuguuggcugguuugggguuuaccuuuucuuucuuucuuuuuuuuuuuuuuccgauggagucuugcucuguugccaggcuggaguggugcaguggcgcgaucucagcucacugcaaccucugccuccugguuucaagccauucucuugccuaagccuccuugguggcugggacuacaggcaugcgccaccacaccuggcuaauuuuuuuuguauuuuuaguagagaugggguuuuaccaugcuggccaggcuggucucgaacuccugaccucaagugauccgcccgccucggccucccaaagugcugggauuacagaugugagccacugugccuggccgggguuuaccuuucaaaagcucaguuagagaagguuaagagugaguccacuguuggaauaauuuuuuuuuuuuaagauuuuugugacagggaaaauucugggccaauuuuugucaucuuccuuuaguucuuuuuuuuccuccugccucagucucccgaacagcugggauuacaggcuccgccaccacucccagcuaauauauauauauuuuuuuuaguagagaugagguuucacuguuuuggccaggcuagucucaaauuccugaccucaagugauccgcccaccucagccucccaaagugcugggauuagaggcaugagccaccacaccuggcaucuugcuuuaguuuuuacuuuuacauaugaauuuuuuuuuuuuuuuugagauggagucucacucugucgcccaggcuggagugcaguggcuugaucuuggcucgcugcaaccucugccaccugauuucaagugagucuccuuccucagccuccugaguagcugagauuacaggcaugugccaccacaccuggauaauuuuuguauucaggguuucacuauguuggccaggcuggucuugaacuccugaccucaaaugauccaccugccauggccucccaaaguauugggauuacaggcaugagcuaccauggccagcaagaaaucuuuauuucuuaaaacagaucuucuucaugaaaagaaggucuucucuggaaucagugauguugguacaaaguaggaguuacaaacucagacgucuacagaggcuuagcagauaacaaaaaggcagccugugguguuuaugcucuugaauuuguuuuugaaguacuuauaacacucuguuuauauuuacagaaauuucuuuacuguaaaaaaauuagaaauguuagaugugaugauaaauaacacuagguguucacccucaacacugggaagcagcagggaguguugaggacugcauggaaauaaaaaggucauucugccucuccuuggggcccagaguugcgacaguuuuuguuuuuuuuuguuuucuaacauaaguucaauuucuuuuucuuuuucuuuucuuuucuuuucuuuuuuuaaacauagucucacucuguuguccaggcuggagugcagugaugcaaucucggcucacugcaaccuccgccuccuggguucaaacaauucuccuggcucagccuccugaguagcuggaauuacaggugcccaccaccacaccuggcuaauuuuuuuguauuuuuaguagaaacaggguuucaccauguuggccaggcuggucucaaacuccugaccucaggugaucugccugccuuggccucccaaaguguugggauuauaggcaugagccacugugcccagccuaagcugaaauuuuauaugaaauuuuucuguuuuuaaacuuuggcugauuuuuuacaaucugaguagcucaaauaaaacuaguuugggggacaaauugguuuucaggucaugaauuugaagucucugaugcauauugggauagguuggcauaugggaugggccuguggaucaucucucaaaggacuggaguggugugggaguccuagggaaaccuguguguggagggggcuguuuauguucauccuuguguauggauauggaggaguccaagauauauauguaaaguaaaaagcaaguuauagaaugauauguacaauuuuauucuauuugugaauuuuuuucuaaaaagauauauauauaaaauuuuaaguucauaaaaauuuuguaagugcaaaacccgaaaaggauauacaagaaacugauaaagguaguugccccugggauugacacugaauuggaggcaggaaaaggaacugcuuuuuaguucauacccuucuguagcaugcaguacuuaaauaauuuuugaaaaguaaaaugaaaagagcuguugggaaguauaauuccucuauguuacaauuggggaguguugcuauauauuaauacugaagaguguaagccuucagugcuaagaauguugaggaaggaggaaauuagaguggucuggcaugauuaggaagggcuacuuggaagagaaggagccuugaagauugggcagaaauccuuagggaaaaggacagaaggagccaaagcccagagguagaaaagaaaggaugacuuggggacuggugggcaguuaaaguugacagaagccaagaguaucaggaagcagugagagauaaagaggcuuuaacaugaggagccauggaggguguuugggcaggagauaauggaacaagagcagugcuccagcaugcuuaaacugguaacaaggaugaggaaauuuggagacaaagccacaggguggcagccucucauguggccccugcuggcucccaagauagcugucacuaauuccugcuaggguguuuccuggugaacaaggauuauuucuauauaacugaugaauaagcuccucgcauuuccuguuccuccacucuuaagagugugagucuucgaagcuugccaacuucugcuggugcccgaugugguuucucuaccuccaaagccaguguaucucccaagacauuuuggagguucuauacagcaacuagccauugacugacauguagccacuagaaacaagcccacacuuuggaguuaggcagaucuggacuuggauuuugaccuugccacuugcuuguuauaugaucuuagaacggcccuugacuccuuugggccucaguuuccucuuuugugaaaugaagauaauauaauuuaccuucuaggguguuaugccuuuuagguugauacauagcaaguaggucugcuuugcuuuucuaugacgacacccacucugaacucuguguguguguguguaugugugugugugaauauguguauauacauaugaaauauauauuuauauguacuuaugaccauaucagucuauucuauuggauuauaagcuacuauucugugggggugauuaugaucuaaucauuauuuuucuccaaagcacucagagggcuaagcaaauaguugggcuuuaauaaguguugaaugugugggguuugugcucuuaaaccuaauccagucuuuuuagugauggacuugugauuaauuaggcugugucuguaggcuaggguauaccucuucugugaccaaaacaguucuguccaagcaaaugcccuuguuaggauaauaugccagcauggcuugugagucauucauucauucugcuauggcaauucgguauuuuguagggcuugguguuuaauaugauaguuuggggagcuuucuuuaaaaauacauaaaauugcagaaagcauguaaacacauugguagggcucuuccuggggccuggaggaggcuugugaaagugaggggcccuaaagcuugagcuucuuugguuuaacaguaaaucaucuccacauuuaaagauuuauggaacauucacuacagguaguauuaggaguuaugaaggauauggagguuucuaaaagggaaaagauggauacgaguuuuaguaauacagucauccuaaguggacucaggacaaaaccccuuguauuuuuuucauucaaauauuuguggaauaccuacuaugugccaggcacuaugcuaagcccuggaacauagcugugaaaacacuagucucugccccauggagcucauauucaagugucaccugcacugugacuuguagaacuacguagcuugcaaugaaaagagccacaguguugaucuuucacuuuggugccugguuucucuuuuuaaccccucugcccuucucguuuucagaccuguucugggagugagugccacaugguuaaaucggugcugagagaaccuuagccaucccaagcauugaggaaagaaucauuguuaccagggggaguggguuugcugaccuguaaccacucaaaccuuucccugcccugacugguaugaaauauugauaaggagccauuguuucuucaccaaagauaggcucuguuuuggggcugauuucagcucagcaugguagggcaaaccugaaugagcaauuuguucugacuccagagcuguagauagggguguuucuuuauguccugguucuagaggggcagccaaccccacggucucaaagaacggaagaauuggauucuagagacaugaagugcuugccugguugauuaccucuagccacugcuccccuuggccacaguggggcagugacucagagcuggaacuguguuccugccugguugccagauuuugugugggggguggagaggaacgagaaugaaugagcaggaacaaguggcugcuggauuuguaacaccuugggaggcagcugcucaagaaccgaaauugagagacagcaggcaggcugggagucucccucccugucugaccugaaccuaagauuuaauaagguggugcagcuggggaagacacuauccgaacguggagcccaaagggagggugaguguguccccugccuuuuccgguaagaacaagaaagcagguuaguccuguacugguuucauagggauucaguuugcugugguauauucugauucaugaaagucaaguaaugacugagagaaagggaguuuucgaugguugggagcaccuacaguuaaauaaaaacaaccaccauccaauguaauugggcauaaauaagacauaaguaucauuaacuacaccucccugauguuauuacagaguauuuuguuggcaagugagguuggggaggacaacuggucugccucugucucuguguuugcaguuguguguaguguuguuacauuucagucuguagcucuguggaugacagucugagaugaaccgcagcaucuuaaaaugcuacagcuggagggaacauccuggaaacaucuccugcuccagccuucucauuuuacaguuggggaaacugacuuauuuaaguguacuaaauggaagcauaaaacuggguguucuaagauuaaaaauguuucacaggacagguuugaaaacuucuauagaaugcggcuuuucucgggccgcaguuucugaaccugucggggauggaaguguggcugguggaaggugccucuugaucuuaaaccacuuugccugccaggugaguucuuuaaauagaaauuuaaacaggaggcugggugcugugccuuaacucaaagggaagaaaagaaagcguguucuugagccucuguccuagagcaggcugaacaugcuggagucugcaauguggaaaaaggcaaaacaacucuauuggagugcaguuuuagaguuagcagaagauaaauauagcaggcacugaagguugaagugucuacugugggcugggauguuaucaguguucuuuauaacaacaaugcagagucggaauuaaucuuuucuuuacagauaaacucagaaaagccacuaacucgcucaaggucaugcacuaccaguguguggcagagcugggauuugaauuccaguuuguguggcucugaucugccugggcuuccugcaggccuguguggccuuucuagauggagaaccuaccugcaccccccauuuuacagaugaggaaacugaggcccagggagguugaguaguugccugggcuguagagcuagcugguagugacaaagcugguacucagcuccugucacauugccccucugccaacuuccuuaaaaaagaaaauuaggaaagggcucucugaguuugauuugcucauucuaucagaaucuuggcuuuaauguucucauggcugcugggauccugugaaaucaaaauuaaaacuuucuauucaccaaguagcaaccccaagucauggggcuccaugugggaacucaggggccagacagucuugcgguguuggugacucagucagaagaguacuuugcaaaaugaauuggccauugaguggaucugcagaacucuggagaacuuaagagaaccuaaugaaauguagagguuugcaaaucaugccagaagacuguuaaaucuagagcuuggaaaagacggacuucccucuuugcaaguugugagggcuuuaaguuugcucaguuaauuuugugacucccucaugcccagcucugccugugccaggcucuguucccuuuggcacauuuggacacugaacacgguuacuaacugccccucagguggggggucuggaguuggacaggguuuccaugucgcugcccacauugguauggagugugugccagauguggacgguaugggaauggggaaggucuagaguugcccugcucuaugcucuccagggcugguggagucuucagagccuguggccuucugccuccccguaucuuugagggcucugugaugcauggugcugcugaaaucagaaaaugacaucgguucugcacagccucucccugaaggugaugugucugugcucaggcuguuuugaaguaaagggguucaagugccuacuccaugaauauucuucuuugcuguaggagauaaguaaggaguaaggaaugacuccucccaacccuuggaucuuacuugaagggaggggacagggaggagaacaaacacacaugaaauaagcagagagcaauacuagcgaggauauaaucagucaccaaauuguagguuucaugccaaaacacucucccaguucacgcaaaggagauacaggugauguuuauauuauccuucuguguguuuuuaaucacgcaguaauuuccuaucagguguuugcauuccuuucuuugauuuucucagugggguguauuaacccuccuuuacaggggaguugaggaaguuguaggggagggcuaauuucuccaaauuauauuguaacacaguucaggagagccaaggaugaaguguucuuggcauguuggugucucauccuugcacuggcaguaagaauagaagccaacugccuucugauggcugaugaccauuagguucuugucucuguuacuugaguccagauuucuguagggcuagcuaguucauuuagaggcaaaauuagcugggcgugguggugcaugccuguaaucccagcucuuugugaaguggaagagggagaaucgccuugaaccugggaggcggaaguugcagugagcugcgauugugccacugcacuccagccugggugaaagagugagacuccaucucaaauauccggaggaaagagcauccaggcugcaaggacagcuaguacuaagacuguuaaguaggaaagagcuugguguucaaggaacaaaaaggccaguguggcugggccagcauggacaaggggaagaaugguacuagacgaagauggaaccaggcaggagucaaggcaucuuagcauuuuguaagcuaagguaaggagcuuauuuuuuacucuguguguaaaguagagcuaucguagaguuuaauggaggagggugacauggucuagcuuauauuuuaaaagauccaggaggcauccagugaggagaaugggugcaacagaggccaagguagaagcagaaagagccgguaggaggcuguugcaguaucuaguuaagagaugaguagggugcuagcuguacagauggagaggaguguggaugaauucaacguauauuucguagauagaggcaauaggacuugguucugugugccucacauauuguacauggagguuaaagaaaggaguaaaggaugauuccaaggucauagugauguuaauggaaauagggaagccuggaggaguauugaguuugcggggaagggaggcucauucuauucuugcccuguuaaaauguagaugccuguuagucauugcuauagucaagguacaguuagguucaacaaacauuaauugaguaccuucuguaugccagacauuuggcaagguucuuucauguauguuccuucauuuuaucaucacaacaaccuuuuggagggacauuuuuauccccuauuugcaaauggaagaauggagccucagagaggugagguggcuuaucugguuugaacccagaucuucugacccuagggcucugggcugacuuguugcuuagggcagauguugaaggaagcugauuaguguuauguugauaucuucuacuuaaagagaggauuggcucaucaaggccugauucuggaagaagggccugucacaggaaugccuaugugcagugagcuguugcaaaucuugauauugucaaaauagugcaagcuugaaagaccauuucaguagauucucaauccccuuagaaaugccacauuaaugaugaugcuuugcauuaagugagcaauuuugugaaaauguuaaguaaaauuagucacaaggagcuuaaaaaacaauugaggaaacauagagaugcuguuucaaaucuugauugcuaccucuuuauuguggggcccaaauuggagcugaaggugaagaagaggcaauuucuuguauucucagaguuucaauuuccaguuuugagaccuaacuaggaacauuauuagguuauccagaauccuugguuuucuccagacacugguauuuagaacaaagauaguaaguggcuuuacaagccugggggcagugcugaauguggcugcaggccugcaggguaacgcuuuuacaguguucugggagccacauugaggaaccagaagguccagaggggcagauacugcugagcauaccaaugagaagaucuuuaauagagucccuccucagacuuuuaggccagauacuuuucuuacauuuuaagcuguuucuucuccucuuuauagccagauaagagcuagugcugacggagcagauuugucacacucucagcauaccaacaccacuacugucagaaaaccagauuuaucagggugcuccgacccccacuguucuguuaagcaucacucacauaaugccagaacuucuugccaugccaaaaaaaauugcugugccaaguaauuggaaccuuuauguuuaaccaacaggagucacugcucauauuacaaucaaaauacauacgaauagaaaauuaauauggaaaaaugcugcaagaaaccauaggaugcauuuacauuuugacuagccuugucugucauuguagguugacugucuuacauugaacuuaaaucagucuccaguucucuaugguccucacuuuauucucuuaucaagucuuuuguauuugcugucagacuucuuuagggcuuaacccaaguacuuccuggcccagggcuugugaagacaugcuuauuuauguggaugguuacccacagccugcuuucacgggaaucauccuucccugccaucuucuguccauguucccugguccuuuccuaagugagacuggcugccauucaacuucaaggggcugcuucugggaggaagagcgggauuugaaaauggaggcuagcuuguguuuaccucauuugccaaauuacuuucucaguagccugaagagaaacagaagcccuuguguggaacagagagaguuuuuguucuccccugaaaccagccacuuggcucucagccgggccaucucuauacuaccauagagcaagguagcaauucaggucuaagaacagguauuucaggggaugugucugugccugcuaaauacuucuugagacacagugauaggacaugagacucuucauggguguuagaaucaggaaauggagcugacugagggcuuuuguggcgggggagccagggacagcgaguaaagccagaggacuuugcaaucuccaaauggguuuggggagccagcguuuaauaggcagccuuuguuuggcaaggaugagccuggaguaguggaaagagaucaaaagggugguggugugcggggaacacaggagcugacugagguuauagguaaaucaccguucuuuagggaccuuacuuucuucauuuggagccugguguggugauaccuaaccugcccuuuuagguauuugugaauauugaauggaaucgcccagggaccucacuggcaucccuuugcucagagugcugaaccagaagcucugccauuagcaagcugaauguguuugaucaaaaaugaugaaauuuaggccgagcacgguggcucacaccuguaaucuuagcacuuugggggcccaaggggguagauugcuugagcucaggagauggagaccagucugggcaacauggugaaaccccaucucuacuaaaaaaaaaauuagccgggcaugguggugugcaccuguaagucccagcuaguuggaggacugaggcaggaauguugcuugaacccaggaggucgaagcuacugugagcugagaucguuccacugcacuccagccugggugacaaagugagaccuugucucaaacaaaagaaaaaaaaaggaaagaaauuuuuaagacuucaguauucagaagccauuacucugguucaucucuuuucucaauguaugagucuuuuugaaaaaaaaaaaaaauuuaguauucuaguaacaucccauaaccuggaaccucaguuuccuuauguuuaacauggggauaaaaauaucugcccugcuuacaucauuggguaguuuggaggggcaaauaagaugaugaauguaagcauaguuaaagcugcuuaguuaaagcuccuuguaaauugcaguaguuggugguggugaugaugcugugacugacaacucuuuuggcaaagaaggcagcauccauauuagggaaaaaaguuugaagaacugucucuaggucugaucaaaugacagcuauuuuguguuggcuuuuuaaaaauuaccuuucuucuaauguuagaauguaaaauucaucuuagugccuaaacucugcagcucaagauucauuuacuuagaacccuggguuuauuuaagcugguacagguugggacggggagcccaggaguugcuauuaagauugugcaguguauaugaagugguggucacuggcugcuggaucugccccaggcacauagaagauuugcucuuuaaccucaucugccagagauccaucagcugaucuuaugguagaacugaaggcuguuuggggacuacugagugccacacaagugcugucacucagaacuuuggcccuggacaaaagaggaaagggggagauaaagaaugagagggaguggcagcugggcugugcuucugaugccuugugucuuuagggcuuucucaucauggccaggaagcugccccaauucagacuccuaagagaaagggaaagcagguuaucauacagagaacauauaauuuagaaauagaagaccuggagucauguuccagucuuaucacuuuuuuguuuguuuguuuuugggacagagccucacucugucaccuagguuggagugcaguggugcaaucauggcucacugcagccuugacuccugggcucgggugauccucccaacucagccucccaaguagcugggacuacaggugcgugacagcaugccuggcuaauuuuuguauuuuuuguagagacaaaguuucaccauguugcccagguugaacucaaacuccugggcuuaagugauucacccgccccagccucaggaagugcuaggauuacaggugugagccacugcaccugugccaugucccagucuuauaauuuaucaacaaaguuaucuuguacaaggcacuccccccauucaccucucugagcuauucaccucucuaaaacugcaaagcauuuauagagauaaucacagauagugguguuaaugcuuuaugguuauuuccguuaugagcagggcuuuuuucccuccagguggaaaugaggcagguuuagauuuaaaguuugcauuuucagauucucuggcaaguggagauaagucucuagaaaaagcugggccaggaguggugggucaugccuguaaucccagcacuuugggaggcugaggugggcggaucaccugaggucaggaguuuaagaccagccuggccaacauggugaaacccugccucuacuaaaaauacaaaaguuagucaaaugugguggcaggugccuauaaucccagcuacuugggaggcuaaggcaggagaaucacuugaacccuggaggcagagguugcagugagccgagaucacgccauugcacuccagccugggcgacagagcgacacuccaucucaaaagaaaaaaggaaaagcuggguguaaauaaagccuaacccuugaacguggugcaaggauuuuuaaaacauguguuaagaaugccugcuucugcuucuuguccuuaucuuagaugcucagacuuaacucugcuuuuuugggaagacuagucugcugucugccaaaugaggucauagaauuccacgggcuugccugggaccaggagcagggaauucagaggcuggcuaugguugggaagggugacaguauggugaggugguacacaguugcaggacuaaggaacagccuggccucauggcuggcuucacauuuggcuuguuaggguucaggcugcucuaaccuucagugcccaguuuaccccagacaccuggacaucagagguucugaccaggcauuagggcagaguaaaaaaagacuuuguaggccuagagaguuuuucuuuuauaaccuuugugcuaugcugauuuagacauaguaaucucuagggaggcuuagucucaauuuggagauggggcuaauauuuuaacaauaccaacugagaugaucuauugauuaugaaagcauuuuaacucucuguacuaggaaccuuaaaaaaugaccaugcucuuugauucaguaauuuuaccuuugagacuuuaacccaaggaaaaauuugaauuggaaaauucaaauuacauugaaagagauauagauuauaauagugggggggaggcaccuaaaauaucuagcauuagaagaguauaaaucuuucuagaauguaaauaccaugggauaaggacuuuuuguucaccuuuuauccccaguaccuaaaggagugccuagcacaugggugcccaguagacaacuuucugagugguuguaugaaaaaaaaaaauuacauuuggccaggcauaauccuaacgcuuugggagguaagccugguggaucacuugagccuaggguugagaccagccuaugcaacauagugagaucucaucucuacaaaaaaacccaaaacuuagcugggcaugguggcauguaccuguagucccagccacuccggaggcugaggugggaggaucacuugagcccaggaguuugagccugcagcaagccaugaucaccccacugcauucccaccugggcaacagagcgggacccggucaaaaaaauuuuuguuuacauucauaugauaagacuauuauucagcuauuucaaauaaagaagucuuaauaauauaggacuuuuucuauguuaauaggaugugaaaaagcaggacagauuuuuauauacacuaaaaucacucucaauagccuaaagugauucuuuuuaaguagaagaaaauuuaaaacuuggaaggggaacauacccggguauaucuccacauagagaggucaugggugacuuuuuacuuucuacauuuuaaaaauugucuacagguggggcacgguggcucaccuguaaucccagcacuuugggaggcugaggugggugggucacuugaggucagagauuugagaccagccuggccaacauggggaaagcccaucucuacuaaaaauacaaaaauaagccgggcgugguagugcacaacuguaauuccagcuacuugggaggcugaagcaggagaaucacuugaacccaggaggcggaaguugcugugagccgagauugcaccaccgcucuccagccuggguaacagagacugucuuaaaaaaaaaaaaaaaaaaaagucuacauuuacuaugauuuugaaagaaauuuaaauaaaucauauuuuguuuuuaaaagaggaggguuaguuuaguuuauuuguggagcaaaccaacagucucuagagccagcuccuccucccuuucaaagaaccaagcagccuuuguugaugcacaaaacaccuacacacuuugugucugucagcuugguguggaagcugauccuuccuaacuucaaaagggugauagaaacuccaccgugcugaaauugugcaggucguguugcagagacaugcccauacauuuauaucccaucacugaagugaagacauuuuguaguagggagaagaauuuucagaagauagauuuuugugggugggugguuaauucuuagaauucuuuugcuagauucauggauuuggaagcugucuuaagugucaucugcuuuccuucauucuuguuuuagcucguacugucuuaaaguguuacuuuuuguucaucgucucaguuugcuggaguaaguacuucauggaaugucucuccaagaugcaguauucucuuggagccaagacuuccuuagaagucucccugucucguaggugggcucuggcaccugagcuggaaauucuugggcuuuucuuaguguggcgggguucugacagacuaagugugucucagaggaaaggcccacauuucucccccugugaaaucuuugaugaccagggucaccagacauugcugacugaccugucgugucuguacuccuuccauucacacgaauucucauccaucuucucucuuucucuuuagccauaaccagcagaccacagcauucaggcauccugugacgggacaguuuucuccagaaaauagugaauucauucuucaagaagaguaagucuuuuuauguauucuccuuaucugggcagaguaugggagacuaaaggcauuugcugaaaacaaaacuuacuggacuguuuucucugagacagaggggcuuggggugaguggguugguugauucaaacaggaauaugagaagaauuuuauuuuucaaccuucagacuucuuucaguggcaagauauggaagaggagaguugauacagggaugugcuaugauggguauugucagagccucuuuaaaguucccuuuccccugaaugaacccuuucuccugcuauaucuucuggcacauuagcccuguuugaagaggacccacucaucugggugaaaauauagcuggcacacaccuguauuaccagauacuugggaggcugaggugggaggauggauuugagcccaggaguucaaggcuaacaagaccccauaucuuuuuuuuuuuuuuuuuuuugaggcagggucuuuuugucacccaggcuuugucacccaggcuggagugcaguggcacaaucuuggcucacugcagccuuggccucccugggcucaagcaguccuccugucucagccgcccaagucgcuggaacuacaggcaugcaccaccacacccagcauauuuuuguauuuuuuguagagauaggguuucgccauguugcccaagcuggucucaaacuccugagcugaagcaauccuccugccucagccucccaaagugcugggauuacaggcaugagccaccacauccugcccuagaccccaucucuuaaaaaauguguguguguaguguguguguggggguggggguaggggguguacccucagacugagcugaaucagccucccagggaagccucaaauaggaguccaaagagaggagagcugguaauccccaucgucccuggacauucugaguucuuucuguucucuuuuccuaacaugggaacuuuccugcuccucagcucaguuucagcagggcucucaggugcucaggugggcucuaccacccagggcuugucuacauaaaaauacauguacagcccaagcaggauguguuuucccaaaaaaggaagguaagaaaugugcacagguggcucuguccccuuccauucaucugagacaguucuauuugaagaaaauauuuguguuuuggaaaguaacaaauagauguuagcuuuaaagguuuuuuucuucuucaaaucauuuuuccucuguuuaguuacauagaccaaauaugaucuuaaaauaaacucucaguauuuauauuuuuacagcauuucccucccuuaguaucuacaccuuuaaacuuuuuauuauggaaaaaaauuaaaauauacaaaaagagauacgguaauaaauucaauauacucauugcccaucuucaacaauuuccaaaacauggcuaauuuuauuuuaucuaucccuucaccuucauccccuagauuauuuugaagcaaauuccacacauaccauuucaucuuuauaguauuuucagcuuagaaucauuaucccacaguacguuuaaagcuagaaagcuauaauuauggggaaacugacauccuugcacauaugcucugugccggaggcauuacaugcauaucucauuuaauaggaucauccugagagauagaccaucaccauuuuagagaugaagaaccugagacccaaagaagugcccagagacacacagcuuaggagagccaagaugccgucccagguuagccaggcuucaaggccugugcugccuuugcgugguguucccuucaucaaguccaacuccugucacagucagaggccacuuccuaaguuauuuugauacuggugguccaugggagaugacagucaggggcugggguugggaaucugacuuuggaagcauuaauacuaguaaagagagugaguggaagguaaagauugucuugucuccuagauugauaaagaacugcuguguaaaaagagccaggauauguggauuccccaaauuccgcucagaaugaauuuguuuauagaauccugaaggucagaagcucuugggagguuauugaguucaguccucaggcaucccggagacacaggugccuguuguuauuaagucuggauggagaguccgucagaaccuuuagcuugggaaguuaccaacuuccauaagagcugcaggaaaaugcagaccuaccauuacaaaacacuugucacacacaauuccuuuugcucucauucuuaacagaagacuuugucuacugaccacuucucuucagaagguagccucuuuccuacuaccgaaacaucccuguaguuaauuucaauuccauccagcuuccaaggagaagaugcaccuccuuuuuaaggcuuacuuuuuuccucuagaucccaucuccuggaugucauggagguaccugcuugucucaggugguguguggcacugauuggccagacauuccuugcaacaggcagaauaugcuauaggcauugagaagaagggaggauuccugcacuuauacauuaaauaccuagugaguacuuacauugugucuggggcugugcuggacucuacagguacagcagcaagcaacacagaugugguccugguggugaggagcuuacaguugaguagggaauuugccugcucuuauuggugugaacagauacaucuccccacuguuggcagguaggacucaccugagaugcuuggaauaaugugugcaugccccucaaaggauaguuucucauuuuacagauuagaggcauggagaagagaaauaaugugaaagcuauaaucugaugguuccaggggacaugaguucugaguguucuaauuccugcgucagucguauagaaucagucaggauaggcuagggucugcucugguaauaagagaucacaaaugugauaaauguucaugacagaggaaacauaggguucaaugggaauugauaaaggggacucuaaccuggcuuagggaccacagaaggccuccucaucugggaagggaugugguuuaaacugauaucugucuagucaaggugaacaaccugggcaaagacuuagaggggaaggaggguagagcaugggggaucuacaccaguugaguuuaagugaaaaaugaggagcacuggguggauucuggagguacuugggaaguaaaaugaacagaauuuggugauugauugacuaugauagggaugaaagaggggaaagacuuucuugaagccucuggccuuaaacuggaggaagagggaagauuuagauaagggaagauaaguguguacacgugcauguguguaggugucauucacagcugaggagaguguguccagccuugguggggucaaagugaaagaaggcugacuugcaguggagguuugugaaggggagugugcagauacgguugaagaggggggcugcaaccaauuaccuaaauugcuuccuccuaaaugaaauacacuuagauuuaccuccuggggaagcucuggagggugagugaggcaugaugucuccucacagaaacaguuuuuauaaauuaugcaaaugaaugagauucuuguuuuguucccuuagaggagcuuaauuuuguuauguaguguguuaugucucagacuaaugucuuggguggaaaaaggaaaacuggcuccuuucuuuuucuucuccaaagagaauccacugaggccaagcacuggagaguuguaaccacauugacuccucuugccagagccuccacuccccaguuucuuguagguaauucuucuggagcagcgguucucaaagugugaucucugaaucagcaucaccugagaagguguuagaacuguaaauucuuggccccaccccaggccuacugaaucagagacucuagagguaggccccagcaaucuguguuuucacaagccuuccaguugauucugaugcagguaagaguuuaagaacuacugauuuaggcaacuugcucuuuucaucccuucuaaauuacucccuaguucucuucacccccaggugucuucccacuucaccccccacccccaaguguccauccauucucugggcugcagugacaaucuuagguagauuuuagucacauaaucuugaguuucuucuucuaugggaauaaaagaaaagaaaaaauuuaaacccaucccauggugacuucuccuagggcauuauuggugugaacagauagaucuccccacuguuggcagguaggacuugccugagcugcuuggaauaacccauccaugccccuccaaacgaugguuucucauuuuacaggucagaggcauaaacgaaagaaauaaugugaaagcugugaucuaauggggccagaggacaugagcucugaguguucuuguuccuguaucagucauauagauucaggcuagauaggcuagugucugcuguaguaacaacaaacaaaaucuucaugauuuaaaacagcaaaggcgaauuucucauguuugcuucauguccaucauaggucaccugauggacucugcucugcccucuuuuuuguuuuuugagacagaguuucauucuuguugcccaggcuagagugcaauggugcacucucagcucacugcaaccuccgccucccggguucaagcgauucuucugccucagucucccgaguagcugggauuacaggugcccgccaccacacccagcuaauuuuuguauuuuuaguagagacgggguuucaccauguuggccaggcugguuuugaacuccugaccucaggugaucugcccgccuuggccucccaaagugcugggauuacaggcaugagcuacugugcccagccugcucugcccucuuuacugaggguggcuucauuucuguaagggaacuuguaaauugggcacuggcucuuucacuuacauuucuucagcuaaaguaaguuacgggaccacuucaaacuucaaggggagaagagaagcacauauuuauuauguuccugagaagagaaucagaaguauuuuuugggcugggugcaguggcucacaccuguaaucccagcacuuugggaggccaaggcgggugggucaggagaucgagaccacccugccuaacacaaugaaaccccaucucuacuaaaaauacaaaaaauuaaccuggugugguggcgcacaccuguaaucccagcuacucgggaggcugaggcaggagaaucacuugagcccgggaggcagagguugcagugagcugaaaucaugugacugcacuccagccugggcgacagagugagacuccaucucaauaaauaaauaaauaaaugaaguauuuguuggacagcacuaaucguuacccuuaauaaaccacaguccagauuuaucaagggaagugggaccuuuugagucucacuaagaagcugcuuuugcuguaugacuagagugcucauuucuuuucuuuuuuuugagauggugucucccuguguugcccaggcuggagugcaguggugugaucuugggucauugcaaccucuaccuccuggguucaagugauucuccugccucagcccaccaucacacccagcuaauuuuuguauuuuuaguagagaugggguuucacuguguugcccaggcuggucuugaacuucuagccucaagcaguccaucugccucagccucccaaagcgcugggauuauaggcaugagccacccgccuggccuagagugcuaauuuucucauuugaccuuuucuguuaugcuacccaguuuuuuguuacacccccugaggggacuaggcaucagucaauggguucuguagccuuguucccccaggggacacuucccaagccaguagguuugugaaaaugccucaugggagagcuaauacaagcucaggcuguauuaauaaaaguacaaugcauagagaaagggggagaauaguucuguuacaucgugguuuuugugaaacacuucauucauucauucaauacaaauugauggaguacaaagggcaugccaagcuccaaacaccauguucuagauacuaaauuuuaagagagguguugagcaauugauauuccccugaggagggggaccauuauggugaggguucuagaagcccuauccugugaccuauugugauuaaucugcaggagagaagauggaggaugugguaaaagucuucaagaagggcuagcaaguggaagugggguacauuuaucauguggugggcaaaggcaggugucagauuaaugggugaaagcuauaggcauacaaauuucaacccaguccauaauuuucuaagaaagacacuguauuagucuguucucauguugcuaauaaagacauaccugagacuggguaauuuauaaaggaaagagguuuaauuaacacaguuccacauggcuggggaggucccacaaucauggcggaaggcaaauaaggagcaaagucacaucuuacauggcugcaggcaagagagugugugcaggggaacuccccuuuauaaagccaucagaucuugugagacuuacucacuaucacaagaacagcaugggaaaaacccauugccaugauucaauuaccuuccacugggucccucccaugacaugugggaguuauggcagcuacaaauucaagaugaaauuugggugggaacacagccaaacuguaucagacaguuuauagcaucccuuguuucaagaucuagaauuuccucuuuaacauuaaaugaaguauuuuaccuccuagaauaagaguugggagcuuuuaaaauaaauaauauuaauaguauugcuaguauuauuauuauuuuuauagcuaacacuuagcacccuuacuauuagcagguacuuuucuaagugcuuuacauauauuuaauuuucacagcaauccugugaggaagauaccauuauuaucaugaauacuaaggcacagagagguuaagagucuugccaaaggucacacagagaguaagugguggagucaggauuugaauccagauagucugguccuagaugccaugcuucuaaacacuaugcuauacugcuucucauuucagaggucuucuggggacaaucuucuuccuuguccauacucagugcgcugagugaguaggcuacugcugcagagagauuguaauuguauuuguagcaaugaaauuucaucuguaauaacuuugcacuuguuugaaagaugccaagccuccucaguagucuuuucuccagaaaauguucucaaaccuuuuaucuuggggccuaauuuccaguuauuggaucauuuugcucccuucuaagccucuuuccugauucucagugacuuucuugaauugugagcuugaagccagacccuuucuggcuaaaagagccacaugcagggccccuccuaaagggguaguccuugacacagaacuuccaggacugugguuuugauguuuggugcccguguacaggaguguuuucuccucagugcugggcugcccagggagccacugacgaaugccucugcagcucucggggaagaggagagaagcguucccgagcagugacgcuagcauuugacugacagcaggcuguguacaccgauccccaggcucugccaagcauuugauguugagguggggccuaagguugagagaagacaguaugcgcuuaggaaguucaggggcccgcuugugugcugagacgccagcugcaaggcaugcaagaucacuuuggaggcuccaaaccuggagggugcccuugcuugaccugccuuucccagcaucccagugaguuuagcuuguuguuuccauuggggucugagcagccuucaguuuucucauuggauuauuuggaaaagaaacacaaguuggaauuuccuggaauguugugagcgguguuuggaggauagcacuuaaagaagauacugucuuuccaaagguaagaauuaucuuccagaucuuugaccucuuugcuaaaggcgguucauuuugcagguugcagggugagacucaucuauggcaugugcugauuauggguucgggggcgggguaucacuugcugcuaggagauggcugucuccuauuccuucugcagcuacaaguugguaaagcuggcgugagauuuagagcacuggagaggggaguugcuccuaaacucccacaggagucuguccuguugcucaucugcugagcccugggcugugaggcugaugcuuugcugucugcagcugacauagccagcaccuugucucuagaugcuggcagucuugggcuagcuuugccuguuguauuugguugccaugguagcagaaaaaugaggaaaaauggaaacaccuggcaagcagaugcagaaacuugacuguucaguuuucuucccuggacuaggagacagugucuaugauagucgcacguaggggaagagauggugauggggucuuuaguucauucaaacaccuggguguuggcugggccuuugguauugcuguuuugaagggcaucagcacuggggaugcagucauugccacacagcaaccaugucuuuggcucugucuuuggcucugucugugcugggcaaaaaugcugcagugguggcuuugcugugugaggaagggaagcugcuuccuguaaguaguaauuuuguuucuuccugugacuucccuucuuguccucuucuuuuaccuccugcuagucuuggaugugcucagaucuccaguaaaaaauaucauuauguaaugagagaaguagcugcuuguuaagcuaggaggagcagauaggcuagaagagggcucaccaaaggcacugguuagaagagacugguccagggucauacaacagaaaaggacuugugccagguucggggcaauacuccgauuuggggaacaggcauggggagguggggauggcggcacacagugcuuauggguuauuuucaugccaagugagaggcugcuguuugggcugguuucuagcuccugggguagaguggggugaggaacugcagccuguguucaagaaaggacuugagggggaaggagaaggaacacaauaagccauaguugaguagugagaccacaguugcugaaugaaaacccgugucagacagccucccccaggcuguugggaguuuacagugagcguuggcggucugucugugugugucucuuucucugagaagaggggguguggagggaggugucugccuguuugggauaagagcuuucuuuuguuuccuaguuuucauugugcauugcuuuccccaaacccuuagcugauggguguaagcuacuaaaaaaaaggugcugguguuugugaauguguccucuucucauuuacuuuuccucuauaccaguaguuuuagccgagcucucuguguguagauuccuugaggacagagcaugacuuugggggccagcuuucccaggaauuaaugggauaaaggugucauuuaauaagguguucucaguaaaagauuuguguuuccuuauagcuuucuaaccucccaucauaguguugaugacuuauuuauuuaaugaaugagagcaagccuugcucugugccaaggcuggagugaagugacgugaucucggcucacuacagccucugccucccagguucaagcaguucuugugccucagccucccuaguaggugggacuacaggcgugcaccaccacucucggcuaauuuuuguauuuuucauagagacggggucucauuauguugcccaggucuugagcuccuuagcucaagcgauccgcuugccuuggccugagauuacugguguaagccacugcgccuagcugauuuuuuuuuuuuuuuuaauuuuaauagagacagagucucaagaccagacuggucuugaacuccuggccucagaugauccuccugccucagccucccaaagugcuagguuuauaguuauggagccucuguuccuagcccuugaugauucuugacauuacuguucuccuggggaaagaaugggaacucaguccuccagacacagaauuacugugcuuuaaacaauuuauuuuuauaagaugcuauugggauguuuguaggagaugacuguuguuuagaaguuaauuguuuggcaccuugagcuuucuggagacauaugccuuggaaauaaaguguagcugggauuuaaauucuggggucuucacugguaacaguuccaaauaaugcuuuguaugucaugggugcuuuaugguuuucagugucauuucaauccacacaacugcuuugugagaugagaggugguuuccacuuaauuugcaaaacuggacaccaagguccagagaacugaugugacuuguggaggagucaguaagcugcaggacuuggcugagauccaguuauucugggcucuugcucuuuccaccaccacaagauuuccuugaccuggggguuggucuuagggcugaaaagagcaaaagccugcuucucucagaccuugggaccugccauagggucuuucuguggcaaagcccagguuuuggaguccaauuucuaucucgaauaaguuauuugucucugugagccuuaguuuccuccucuauaaauagagauaccaaaacugacuuggcaggguuaagugagauaaugcaggccaagugccuggcaugcaugcaguaggugcucaacaaguacagccuaaucccucugcuugcuugacuuuguguaccuguccugaagagguggugaucauugucuuggugaccacuuguugcagcaucauagacaucuugcucugauuccuucauucuacuucagcucacaccguugauugagagccucccauuaaccagaucucauugaccaaacccaccuaauuucagacccaacagaaaaaaaauagcuucuguaucuauaaccucucuuucuuacuacaucugucaguuauaugcauuuagugccaaauaugcaggaagcagaagcacuccuuuuauauauagggacagagaaagugucuuccuguucaggcucacuucacacauccuugacaaaguucagaggaaaaucaagucacuuuccagcugggcuucuccagacugauuuugucuaguccuaaguucuuuuguucauuucagaugggaggagguuggguucaaacucuagcucacuguuuucaucuucagcccacaucccuccagcaaaauaaucagcauucauguagcccaaaccagggagagagaagucuuuguuaaucaucccauuguacuuugggauuuccgauaacacagaaaccuggcaaacaggcuuuuaagucaauagguuuuauuugaggacagcagcagucugcgugugcagguuuuugggucuccucucccaggggucugcgugacgcagugugccugagggcaugcugcugggaacugaaugccuuucaagguugcucagcucgggggcacaggcucuucucugggaagagaaguugguucuuagaugagacucgguucuuaggugagacucaucagcagaguacacucauucugaggaguugaggacaaaucauugucugccccaccaggcucuuaaugggaaacaugccugugggauguaacuggcugaaacaaauguaucagaauguccucauccaagugaaggauguuccuuucaguguugucucuucgggaggcuguacacaugcacuguugaugucccacugcucauuacccauugugguaaaucaccacuagaaguuuccaucagagccagguuuucagccaagugagaaaauuguuuuugagacuuuuuucauauggauaacaaauggcauccccaagcacgaccaccauuuuuuuuaacuaguuguuauuccagauaacuuguaguuauuuccaaaagucauagucauccuuagaaaaccugagagaucauguucuacguugagagcaucaaagaaacauccucugaaggcugaucuuguuacuuggacaaguggguagcugugugugccuuguccuuucaaagagccaggucagggacugccaaguaugaauugagucuauuccuugaguugggagcugucccugcucauggggggccuuggugaagacauccucccuguuuguagacaacacagucccuucccuggggcauauauaguuugaacuuuagucacauuuccuaauaggcuuucuauggguguguuugagcgguguagaccaugaggagucaagcugucuucauguguguuuuuguauucuuuccgcacuccuugccccucacugccccucacugauguccagccagcuagcaucccagaagcuaguauggggaggagacguggaguuagaauauguggguuuggggggugucaaguuaaaugucaagauuguaaggugcuuuauacugcacuggugagaugauuuaaaaaucuuuuuuuagguugggcgcgguggcucaugcuuguaaucccagcacuuugggaggccgaggcagguggaucacuugaggucaggaguucgagaccagccugaccaacauugugaaacucccucucuacuaaaaguacaaaauuagccaggugugguggcaugugccuguaaucccagcuacucgguaggcugaggcaggagcauggcuugaaccugggaggcggagguugcagugagccgagauugcaccauugcacuccagccugggcaacaagagcgaaacuccgucucaaaaaaaaaaaaaaaaauuuguuaaagauugcaaggugcaaaaauggcaaaaguagcuauuuguccuggauuuccuggccagucacaaauccagacggucuuuucuucguccuacagagguggaauggcacaucuaaaguugauggaacgugaugcaguuauuugaaaugauguugaacuggcuuaaacuaacggagaaaguguuuacauuacaauaacguuuuaaaaugaagaugugaagucacauauauaauuuugaucauauguaaacaaaacacccuuuuucuccccaccuccuuccccugcagaaaacccaggcauauaaaaagaauggaaguaaccauaccaaguguuacaaaugguuuuccuuucaguagcuggacuaugggugauguuuuucucucaguuuuuucuuguauuucucaaauauucuguaauaagccuaaaaugucuuaagugggaauaaauuacauuugauaaaaucccaaacaggccaggugcuguggcucacaccuguaaucccagcucuuugggaggccgaggugggcggaucaccugagguuaggaguuugagacaagccuggccaacauggugaaacccugucucugcuaaaaacacaaaaaauagcugggcuugguggcaagcgccuguaauacuaacuacuugggaggcugaggcaggagaaucacuugaacccaggaggcggaaguugcagugaacugagaucgcgccacugcgcuccagcccgggcgacagagcgaaacuccaucucaaaacaaacaaacaaacaaacaaacaaauucaaacaaaucuuuuuugucguuggaccuuguguccugaauuuuagcuuagagauacagcugccauaacugaagcaaccugagagcucuuuuuccuugucucaaccuccagaagucugaagaguuagacaagaccagguuccaggauguuuuggacauaguucugucuggagaaaggggauggacaaggccgccucuuggagccucuuccugcuccugaucagcgguuaucuugcugcacacagccucugccaacagcaaauguggugacauucucccucccaguggggagcagcaacaaaagucuggcuggguuggaggcuggggguguggaaucuggagugagugucugagcugauaaggagccagugcucuuucugccugguaggacuugcaucuccugcugccaagcauccgacagggcccagcccuuugggaagcuggugccuacuacagugguccugcugcuggcauugcuuggaaagugcaguagucacggcuacuucugcagagaacuucccuugugguguaggauauugggcucugucuccgggcacagaaaggaucacuuaucuuuugagcagcagggucuucgaagaaaacaguauauuuccaugguggaaacuaggauguucccucauuguaucacucuaaaagugucugugugaaggacuuuaugaguguugcuucgucagcugcauccugccuggguucucuagcugcaucuccucaggguccuugcccaggccuccaaagcagauuuucuccacucuucaggcaaagagccucaguuuucugugaucugcuuggucuccaaugaccuggauucuguugccuauuggagcauuggacagagcguggagacuuccacuuugaggaaggcuugcugauccuggacuuugcagggucuuggcaucaggcauccagcuguccagggauagguacuggauuuguguggagggauuugucaccgcugccuugaaagacuggcaaaugcuggggaucuguggaagcaggugagaaggacucuucaguggcucuugagugucgcacugagaugcucccagagaguuggcccucccagggcagcuccuuggugggaaguuccauguuucugggaugcugauggggaagcccagauauucuuacugggggcccaaggcuuauuucauuucuuccugcucaccaggcaagcacaagggguuaauaucucugauagcucuauuuuggggcaaauggaguguuccuagaauaggacucuuuguugaguagucuauuuugggagacaagccccacuggcauuuauguaagggauucucuguguguagcugggggugugguugugugcgcaagugauuucuuguuacuaauuauaaacagcuucuuuugggagccagggaaauggaggugugugugagggcauggauugcucuugcgugcugagaagaguggcacaucugugcaugcccaucagauggggcaguugucacagacaccugauuaagagagugaguguggggacuuccagacaacagcagggaugacagucuguccuccuuuguuggggugucaggcuguggagaugugccuaucugucaucuugauuccuugaaacacaugggcaggcuggacauugcggccuucuggcugcagucuggagucaggcagccuccaaacaaucaggguuggguuguucuaaggcccaacaaccgauuccuaccuggaacugaucuuacugcacuuccuacucuauagcucggcuuuuacucacuggaauccccugucuccucacaggccgaauccacauaugucgaagcaagacagaaaccaaagaccguccagcauggucagugaaacauccacggcugggaccgccuccacccuggaggccaagccuggacccaaggugagcuccuggccacuuguuccuuccuucccuucuuuuauauuuugccaagccccuuuguaaccagaaguccauuugaucuucacuauaguuuugugagagagacccauaagaaguguucuccccaaaugacagaucaggaaacugaggccaagagggauaugucccuuguccagcagaacaggugauugcugacagacccagcacuggugucuauagguccuugagcauguucuucacuuuccucgcaugguugggagggccacguuucuauuuacauguagcuguguguuaaagcaagccuggagagauuuggugacaugaggcccugagaaagggugcccuugggaaggacccagaaguuucugugcuccagguguagaaacacuaaggaucaggguaaagaaccagcauugaggagaggaggagagugcugaggguugaacccagauaggagggguaaauaucuggaaauuggcaaaaagcugugaccaaaaauuagcuuugcuccagaaagccauggaacauauuacagccaacagcugcugcugaaaguugauugaaaaauuccuuuuaauuuuuuuuuucagugacccagcugggagguuugccaggucuugggcuugccuuuuaauuagaaugcuguggccaugugcacgcccguucccugucuucuggcuguucauuugaucaaagggugcugccauuuagagugaggcagagagagccgacgguccuccuaacauacaagugcuuuuuugugucaccuuaaauucccuguugcuaaaguucagucugcuuuuucauagaucauaaaguccagcaguaaaguccacagcuuugggaagagagaccaggccauucggaggaaccccaauguucccgugguggugaggggcuggcugcacaagcaggugaggaagccgaggagugagaauccuggaggaaauggcucuggcugaguucucuccuuucccaggcaccaggaagcuagggaugggcacauaagcuuucuguuccugaguuugucugaggcagcuggauucuaccugcugcacugcauuauuugccguuuguucuuaugaguggacugucugcucaaugguuacagcuucucucccaaaacccacuugaccacuuuggccccuggugcuauuggcuguccuggggcccaggccgcagugugggugggucagcuugaauccagccuuccuaccaguucucuaccagcacuugccuuccuggugucaaagagucuuuguuauuauuuggcugaaaauuuucaucuuuuccucucccccuugucuagcaugcauauccaccuaacgucucaaauuccaaaucagccaaacucagcucauuaucuccucaccaccuuggccugccauuuccccaagacugcuuuuuccggaucuuaguaaugguaccaccauucucccaggcacucagguuagaaaccucagcacuaucaccagauucuccuuccccgacaugcauucagucagaaagcccugucagcucugucggcugaggccauucuucauuggaauccccacugccaguugaccugccugggguucucuguucauggcuggguugugaguucccagagcuagagacccugucucuuuugcucuccuucucuccuugccagucauucauucauucauccauucugcaaagugccugccauguccuaaguugcuaagagcaaguaucaagagaaaguaacgugguuccugcccucgaggaacucaucagcuaccaggagaagcagauagcauaucucucacuugucacauugucacccagcccugucucucaccuagcauagcaucuaaaaauaucagagcagcaauguaaguuuuggugaagcuuugugggaagacagaggagggcauuacauugaacagcacacaggagaaaucccaaaaguccccuuaaaaucuucuucugcagcucuggccccauggcagcugcaacagcucccggccucuucuguuggacacuccugguaccaccgucucuugugcccacuugccccucacagcccugucgucccucucuuuucuuacauuugcccuugucuuuuucucacuugagucauuuaacccucugacuucuuccguuugcaucccuguccccauuaaacaaaggaugccccuuugacauauggagagagagggaaguauuuguaaauaauucccagcaccuaggccaggcccauuggcugugcuguaaccauaacagggaucugugugcuguggacacacaacagagaguggcuauacugggggguguccagaagggcuucccggaggaagugauauuugaaccaggcauggaagcauagauaagaggucuccaaacaaagcaaauaucaugugccaagaccuuauaaaucaucuuguugauuugcagaagaugaaacagauaaauaguugaaaucaucaaguuacauuugcuuuuagcauuuuaguaaguggaggaggaacaauccuuaugcuguauuucaguuuagaaauugucagauguuuuucaagcuugucaaaaacuucugcagaaggaagacaauuuaacagccaucucuauuuuuuaaaugaaaaaaaaauuuuuuuuuguacagcuggggcaucacuauguugcccaggcuggucuugaauuccuggucacaggcgaucuuccugccucagccucucaaaacacuggcaguacagacgugaacagccaucucuaaaacuaaaagaugcucuggggcauuccuagguuugagagaaaacucaccccaaaacauucuguuuuccugccuuugccauguuuuugaaaaauauucacaguaauuuaaaacauuauugauaaauacaaacauuuacauuucagaugaguaaagacagauuuuucuuaugagacaauuugauagcaaagagaauccaaauucuuuuauauugaauggaaggaaaacacaacagcagaauacauccuauauggcacagaacugagcauagucuaaugaaaacuuugccucacuuaauucauuagguaacuuaaacucuuuucaauaguucaguguaaauucaguuuuccagucagcauaaaugaagguauuuuauagcauagccaccuaaauaagaaacaaacaaacaaaaacuuuuuguuaagaacugauuccuuucuuaauuuacuuucuagaagaaagugacuuauaauauuauauauuaauuugcuucuaggagacaaaaauaaaaacccugcuuucuuaggauaaaccaucauuuaauccaaguucuaauguccuauucaaagaauggcuguucaguaaaaugguaauuuauuaaaacaaagagugaauaugggcaaauauuugguucuggaaucagguugugcaugcuuggaaagggacaacaguaugcucagauauuacccugacuaguuuucuuugcuuugcaggacaguucugggaugaggcuguggaaaaggaggugguuugugcuugcugauuacugcuuauuuuacuauaaaggugagcuaacaaguagccuauuacccugccgaaguguucaguuuuacauauguggaugguuggugacuucagguuuaccaguccuaacacaggaaguucaaucuguuggguuaaaauaaauagaauccaguuugccugcuacuaagggucucaggauucagagucauuuccguuucugucccauuugggacauagguccaccuuugagguacucuggagaggugagaaguguggaucauugauuguguuuuguaaccugucaucuggauuuauugaauguuggaugagcaacuggugaauugaauuggccaucugagcuucuguggagccccagaacauaaaguuagggacuauguguuguuaagagggagucucaaaauguggagaaagagcuuacuuuuaagauaaggcuagacugcuacuggugcuuucaaagcaguucagggggccugagaagugaauuccaucauuggagaaucugaggaggcuucuuagaaggagagaagagauaggcuuuuaagaauggguagagcuggcugggcacuguggcucacaccuguaaucccaacacuuugggaggccgaggcagguggaucaccugaggucaggcauucgagaccagccuagcuaacauggugaaacccugacuccacuaaaaauacaaaaauuagccaggcaugguggcgcaugccuguaaucccagcuacucaggaggcuaaggcaggagaaucgcuugaaucugggaggcagagguugcagugagccgagaucaugcucuugacuccagcuugggcaacaagagcgaaacuccgucucaaaaaaaaaauaaauaaauaaaaagaauggguagagcuuugccuguguguggguugugggaggauggacauuacaaggggaggaaacaacuuggcugaaguucuggaagcagugggacagaugagcccagggaaacugcccagaagguuguucugaugcauuuuuccauucaaagacagccgagaagaagcgguccucgggagcauccccuugcccagcuacgugaucucuccuguggccccugaggaucgcauaagccgcaaauauuccuuuaagguacugccccugcaccucuaaugcagccauucugucuaagaaacuguguucucaaaaugucuucauaaaagcaguugcuuuugucgggagggggaagaagcuagagaguuucagauuccgguuaacaaaguuguaaguuauuuaaacaagaauaauaucacaugaccgguacugucauuugacucuaagcuuuggagucgcccagccauguucaaguauucagaccccuccuuccugucacugccagucuugugguuaccugucgaagcccuucuugagcugucuuaucaccguacucagccagccuaacuagcauccagccauuucaugcaacuggugaccccucauaguggguuuauauccauuguauuaugaaaacucacauugaagguuaggggccugcguguuaaagaggcugucagcuuuguccacuuuguuuaucuuguugaaaagcaauuagaaugaaauuugguuuaucuucuggaucauagaagauuuccaggcagaucccuuuaccaguaaaaccccuuuccuacuuggucugugucuguaccauuugggcugagugaggccaugauaauuaaugguaguuuugcccuguagcaccugugagguccaguguggaggcucuuggaagguguguuuaggcucaagcauggggaguccugaggucuucuccauugguggccuccauggauuuccuucacugcagguguuaagaucuuggguuccccagggaagguaaggaugggguggauugaagauccacuuuacuggcaguuggaguggaaguccuagagagcacugaagcaagcagcccuuggugccacucaccacagggcauggcccucucuuggcugcuuaagauaugaggcaaugucguacacgucaagcuggaguaggggcuccuguccccacuacacuuguugcuuggccguuuccauguuggaggcacaagaugaacacuagacaguaggucauaaaacagagauugaacagaagucacgcuuuccagccauagauagaggaccacgggaaagcucaagguaagacgccugccauucucuggaaggguuaaagggaaguguuggucugugguguccauggugugagcagcugguccuucaucugugaggggcuugcaaagugagagucucuaucaacaccuugaucuggagccauaguggugcuggugguuggaaagucagucucaucuuccuucuaccuuuccuuccuaaggaggcacagaacugagcugaugcuguggcuuuacucaucaacagguuugaguuguuccuguguuucccucgagugacgcuacugucacuccagaauugcuauggauuggugauacugggauagugcucugugucauguugcguggaauacuguugccuuauaucuuuaaaacaugacaugggaaguacuuugauacaugugaccucauuuaaugcucauggugagggaaggauaugagagcuuaagaaacuugcccaaagucacaaagcuggaagaugacagaggcagaacuuggcccugaauucuguucucuuucaguuuucuuauagggcucccacuuuguauuauuuucucuucuuccuugcuuuucuuccaugucuuaucuuggucacuugcugcacagacaucgcaggagguagaaggugguuugaauugacauuaauuguaucauuuuagaaacuuauuccugacucugaaaacauuuuguucagugccuuucagauucauccuuuacagccugaaaaaucuuccuuaggaaacccucuuuucuagaguugagcacugcccaguugggcaaacaauugggauagugauguugcauaugauguuuugggaacaacauuuggcaugucuuuaaaguaacauaucauaacuauauauauaauuuuuaucuuaacacuucauuggaggugugaaaguagauucuaggcaaacaucuuuaaucugucuuagauuucuuuucuuuucucaacauuuuucuuggaaagacuuuacuaagagaguucccuaaaucuuuugucugagagacagaaggcaucguguguuugggagaggucuuugagguccucaggauccgagagcagagaaaagcuacuacagacagaucuggugguguuuagaugguucuccagaaagggcaaugguuccgugagucugaaagaguuaucuuuucauuugaguugcagcauccuucuuuuaggggccagaggguaggcucugggggcagcucagggucuauauucuugggcauaccaaggaauacacaguguuuugugauuggccuugacaccugucuuugauguugguccuucucuguauauagagcugaaguucucagacuggugcuaggguaccuugucggagacaguucagaguauccaccguacuuggccuacucuuuaaccuuuaacugaaauauaacaucucuuucaguuaagaaagcaggucacaauguguaucagcaguaccugugacuuggucaccaguagaaaccauagauaucuucauaacacauuacaguuguugcagguaucuugaaauaucauuuaugcucaucaccauuuuaaaaucacaauaauuauuacaucugccaccagauccauuaugcaguacguuaguaaacaaacaccugcaucgcuagaccacacauuuaaaaaauauuuuaagaacuauauuucaauauaauagauuucccuuauuuugcaugcuuaacauucuggaaaagguucauaggauuuaucgaacuguugauguccaugccacaaaaaauguuaaggucccugcucuagauucugaaggcaugccaagaggcaugguuuuucacuuauguaguucuguuugaaaacuucuguugcacacucugauugucuaugggguaguauaacagacgcuagggaaacagcaaugaauaggacaaaauccuugcuuuuuuagggcuuauauucucaaguuugcaucagcauguguauuauuacaggaugagaagacaacaagaaagagcugccuuuuuucucucuccuuucaauuuuguucuuuguauaucuaucaaauucaucuccuccucuccacuucugcugccacuauucugucuuggccaccaccaucccuucccuggggagcacacuguagagcaggaccuaguauauaguaagugcucuguaagcauuggcuguugcugauucagccuuggaacuccucugcagccuacaguucauccucuauguugcuccuaaguugcacccuuguucagguuguauuccuaccauaagcccuucagugguuccccauugcuuucaggauaaagccauuuuuuuuuuuuuuuuuuuuuuugagacagaauuucgcucuugucgcccgggcuggaguacaauggcacgaucuuggcucacugcaaccuccgccuccuggguucaggcaguucuucugccuuagccuuccgaguggcugggauuacaggcaccugccacugcgcccagcuaauuuuuuuuguuguuguuguauuuuuaguagagaugggguuucaccauguuggccaggcuggucucaaauuccugaccucaggugauccaccugucuuggccucccaaagugcugagauuauaggcgugagccucugugcccaucugauuaagccaauugugauucacgaggccccagcuuauaucucuagccacauuuuuagccacuccugucuucugucuuuccucuagucauauacaguugccuaaggccccaggacauuucuugccuauaggccuuuacuuaaacuucagccacaguuggccgggcgugguggcucaagccaguaaucccaggacuuugggaggcagaggggggcggaucacgaggucaggagaucgagaccauccuggcuaacacggugaaaccccaucucuacuaaaaauacaauuugcugggugugguggcuggcgccuguagucccagcugcucgugaggcugaggcaggagaauggcaugaaccggggagacggagcuugcagugagcugagaucgugccacugcacuccagccugggcgacagagcaagacuccgucucaaaaaaaaaaaaaaaaaaaaaaaagaaaaaaaaaaacuucagccacagccuggaaugcccuuuccccaacucuuacuuguccuucaguucucugcucagagucaccuugucugggaagccuucucugagcccucgggacagguuaaguacccuucuucucuacuuccacagcucugucucacugcacuguaaaugguugauucacccacccagaccuuucaccgggaaaacugauuuaucagcuaguucugcuagucccauucuguagacagagaccacagggagcauuaaguguaauuggaaucguggccagugacagugcuuauaccucccaagauaugguggguucaggcuuacuuguauuuuguauuuaguucccuauaaauuugugauggggagggaggaagaagagucuuaaaguuuccagaaugcucuuucagccaaccucccuagguugcucaagugacugcuccuucaguaacaucaacugacaucuuuugagccuuacaaaugccaggcugugcucuaagcaguguaugucucauuucauccucacauggccuuauaagguaaaugcuacuuuuacccauaguuccauuuuaaauaugaggaaacaagcaugaggagguugaguaauuuacccaggguuacccagugggcaagaggcagaguccaccuuggaccucaggcugauucuaagagcccaaguucuuacccuguucacugugcugcuuggagucagccuaaagguuggacgugagaaguuucguuucuuuucucuucucuucucuuuucucccuuuccuuuccuuuuuucuuuccuuuuugcuuuccauggagucuugcucugucacccaggcuggaguguagucgcgugaucuccacucacugcaaccucugccucccagguucaagagauucuccugccucagccucuugaguagcuggggcuacaggugcccaucaccaugccaggcuaauuuuuguguuuuuaguagagacuggguuucaccauguuggccaggcuugucucaaacuccugagcucaggugacccacccgccucggccuccaaaagugcugggauuacaggcaugagccacuacacccggccucuuuucuuaaucucaauaaauggucgccacuaccucugcaaguuguaaacuugagacucuuauccuuuauaccugguguucucucuccucccauauccaguccauugccaaggccugcagguauuaccugcaaguucucuccagacccugucugcuccuccccuucucugccuccaccaccaucucucucucaccugugcuccuguaguagccuccugacccaucccccccucaccuguuucugcugacucgaaccucuucucuguacugcagccagaguggucuuuccaaacaaaaucugagcacaucauuccccaguuuaaacccuuuaauaaggcugggugcaguggcucaugccuguaauuucagcacuuugggaagccaagguggguggaucacuugagcccaggaguucgagaccagccugggcaacaugaugaaaccccaucucuacaaaaaauacaaaaauuaguugggcaugguggugcauuccuguaguccaggcuacucaggaggcuggggugggaggauugcucgaaccagggaggcgaagguugcagugagcgaagacaguaccacugcacuccagccuggcaacagagcaagaccuugucucaaaacaaagcaaagcaaaacaacauaacaaaacaaaacaaaacacucuuuaauaguuucucauugcucuuucauuaagacaaaacccuauaugaucugcaaggcccugguggucuggcccugccaacuucggcagccucucuucaugcuguuuuccccuccauuccucugugccagucaugcuggccucauccuugaagaugaacacacugugggcacguguccuucauggggugcuaccuagcuccucccugcuauuacuuaaauggcuaccuacuacguagaaggcagcugcaaugucaauuccucagggaucaagcugggcuccccuguucuccucacagcauccugaccuucuugaugacacuuaauacagcuguaguuacuuguccauaguauuucucuucuauguggcuauaaacuauuauggccuuguuuaaggcugucccuccaacuuugguagggugccuuucacauaguaaauacucaauaaaugauucauuauuguugagcaaguuccagaaugagccagucaguugaugggcccuggccuuuugggugcuccucuauuuuccacugagguuucucuauucuaaaggcugauguugggggcuugaaccaugaggcuucuggcuccuucaccagugcugugucuagaacugagguccaacagccaggagaccaaccauauccuaggggcaucaugucuuugagguaaguucuucauucacauccugauuuccuuuaggcauagcuuguuuucuauucaguuaugcaaaguugcuucauaggauuauguuaacuggaaagcaaagagcagagaaaacaguaccaucugaguugagacuagggcaggagugagaagauucacaucaucuagguccuaggcucaggauacuuuggacuugggucacuuggccagaugaaaagaaaacucccuguacuuuuugccuucacaguuaauccauugaauaugcucucacacaggcagaauacaguuggaaucugcucuucagagucaagagcagcugggcacagcaccuucugguuugauuagugaccaggguuauauuugcaaucauguguaacuccuucguaaugguggauguaacucuuaagacucauucgcaaauagacaugcaaacccaugucugcauguuugaggcaugucccauguugauuuccuggacaaggcuggcuccaugaauuuuuuguacagcagggaucuguugucuuuauuguaccuuggagggcucccuaugcuuguaucuagugggauaggcaccugucccagaacccucuauggcugggcacaaaaggcugggagagugugucagagaucuugugugaucaugguccaggggauauuuuccaagaauuucugcugauuuucaguaagacaugcacagguuccuucuuauccuguuuuuuuguuuguuuguuuguuuuugaggcagagucucacacugucacccaggcuggagugcaaugguucaaucucaacucauugcaaccuccaccuccuggguccaagcaauuuucaugccucagccucccgaguagcugagauuacaggcaugugccaccaugcccagcuauuuuuuuuauuuuuaguagagaugggguuucaacauguugcccaggcuggucuugaacuaacuucaggugaucuacccgccuuggcuucccaaagugcugggauuacaggugugagccccugugccuggccuuauucuguucuuauuggcacauuuccaccuugcuuaaaauagaaggaauccuuccugugauagugaaugauagcugauacaugcaaaggaaggauaucagguuugcuucagccacuauagggauccuuggcugcaggccaaguuugccuagacucccuuggcacugagccagauggacucagauauguaaaugucagaagcaggcccauauuuacuaugcauuuuggaucuggauuuuaagagggcagggaggagaaguaaaugcugaagguucauuugagagguuuucaucuaugaccauuagugauuccagaagcaugucauugucuaguuuuucauugguucucauuuuguuuucucugccugguccuugcauggggucugccuuucaugcuggauucagaguauugaaccaguuaucuguguaaucacccucacuucuggauagaaccugggagcaauauacagagaagccuggacuuggagucagaccugggcucuaacucuucguucuuucaacaaauguuuauugagcaucuacuaugugcuaggcacucuuccuggggauauaguagugaacaaaauagcaaaguucccacucucguguagcuuacauuuauagaggaaggagacagaugauaagcagguaauaaacaaauguguaaaauaaauagcaucagguaaugguaagugcugugaagaaucuguuaccagguguggaaaucucggaaaguuacuuaacaucucagagcuuuguuugcuacaucuguaaaacagagauucugucuccaccucucaaggcuguuaggauuacaaugagauuaaaguuguggaaguaccuaggagacacauaguagguacucaguaaaucuuccucuuuucacaucaucuucuuauguagauuuggugagauuguuccuugcaaauuuaaaagaugggucucugguuuaucagagcacaaggggaaaaacugguguugucucugauuugcaaaucuucccagucauuuuucaguggucauucugaguaccuuuuuuugagauuuuuuuuuuuuuuuuuuuugcaaggauacaugugaaagcaccuugaggcagaaggacacaguagguuugcaagaauauuuaguuaacuguuggucaacucuguccaccucuguagugccucuuuugagagcuuguuuggagguucuagcaggggacugcagcuacuaguauacccuugaccgaagaccgguccuccucucucagggauggucuuccucuucgacuggugugcagcuucaggagggaugcacauggagcagugagggaggaaggggacacccgccuagccagccagaucagccgacucaacccuggcgaucaauggggugacagaugucgcagccagauugcccucacauccuguagugccucuuuuggagagacagaacagcagcuucuuugaggagcacacaucacacuucaugccuaagcagugaagcacagugaacauccacaucaagccaccugcuguugcagccaguuuugagucaauucuugucugauuauagccaaagcaggaaucacaggcuucagcaaaaccaaaacagggauucccaagagucugccucuaugaaaugaggguuuucugaaaagccuguuucucacauaagccuugacuuugugcacacucccaacucccaaagcaggaguaagauaaauaggaaacaguuacagcugcaggcuuuuacuuuggggaacagacagcugucacugggccuggcugcacuaagaaagagaaaucuagccuaugauguuuucuagguguggaaacaaguuggguggugcuugggcuuuuagacuagaagggccauagugccuccuugcuuuugcuccuauaaaggaaaugugugauaaccucccucugaccugcauucugccuucaugcuacaggcugugcacacggggaugcgagcgcucaucuauaacagcuccacagcgggcucucaggccgagcagucaggcaugaggaccuacuacuucagugccgacacccaggaggacaugaacgcuugggucagggccaugaaccaggcugcacaggugcugucucgaucgucacugaagagguuaguucugauggagggucccugccacagcaccuccuacacuaggauugggacccagauagguccucuugggugccugagauuccauuuacucacuuguauuaagcauugcccucucuuuauaaacuuucuucauuaaacaaaaacacuaaggccuggaagggugaaaugacucccugggauccacagccauggaaacuggcaugugugggcuucucaguuuuucuucucuuauguaugguggaagggaagaccuugggguaccagguagggagaggacaggcaagaaaggucuugcaaacugaaaaucugcuacagacuaacugccauguugcugggagcugaccugggagugaucuuccgguugcucccucucugaaauaguucaaccaagcauauaaucagagaucuugaaauuccugagucuguuggcugugggugauucccugagagaaaacaagaggaauaugaguggagucgagggcucagagagagagaucagaguggcccugaaaaagucuggguauaccuuuaucuggccuucaucucacauugggcccauucuuuccuauccugacacuuugcucuuugacaguguucuuucaaugaggccucaaaacucaaguguauucucuuguaaccuaaggguggaacuuuuuagugacuggaaauggguugcgcugguauguuuagcuugugaaucuuuccacuucacauauaugugguuuucggaauucgugguacuuccuagcuuuaugaucucuuucaugcaguguacagaccucauuaaauauaaauacagcuauaaauagugaccuccaucaagaggccaggguauagucaggcccuacucucuggagcucccauagcacuucagucugagcauuuuucacacuguuuuuguuucccccuucugucuacuuuucaguauccuaggcuuaaagcagauaucaucuuuauaucuugguuuuguuuuguuuuguuuucagacagagucucgcuuuugucacccaggcuggagugcaauggcgugaucuuggcucacugcaaccucugccuccuggauucaagcgauucuccugccuuagccucccgaguagcugggauuacaggugcccgccaccacgcccagcuaauuuuuuguauuuaguagagacgggguuucaccauguuggccaggcuggucuugaacuccugacuucaagugauccacccaccuuggucucccaaagugccgggauuacaggcaugagccaccacgcccggccugucuuuauaucuaaaugcacaacaucugacacauaguaagcucucaaaugucuggugagugagugagugagugagagauucgaugaaugaaugaaugaagauguugaacaggacaggaccaaagacugcccuaggagcuuccccaugggcccugaaucaguaacuacgucaauuuuggcucuacuuccagcauugucauccagccugcauuuuucuauuguuuccauaauaaugaucugaaagacucugccaguagccugcggggcuuaccucacagugugguuggcauuuccccucucaccccaggagaaggaaacuggguagauuugacacaucuuucuccccaacacagucuagugcacagucuaguccccaacagucacuguuuccuggucuuuauuuuucauucuuuuaauauauauauauguuuacaguauauguauguagucauuccuugguauccauggaggacuggugccaggaagccccacagauaccaaaauacucagucccuuauauaaaaugguguauuugcauauaaccuacgcacauacuuuaaaucauuucuagauugcaagauuacauauaauaccuaauacaauguaaaugcuauguaaauaguuguuauacuguauuguuuaggcaauaaugacaagaaaauaagucugcauguguucaguacagacaaaaccauccuuuuuucccucucuaaauauuuuuaauuugugguugguugaauccauggauaugaaacccuggauacagaagaccaacuauguauauaugucuguguguauauauauguauauauuuauaauuaaguauauacaaauuauuaaauauauauuaaauguauauuuaacuauauaauaaaugaaaacauucuaaauauaaaaaugcaaaaacuguaagacgaagauaucccaaaucaccuucccaagguaaucucuauaaucagguuaauuggcuuuuaaacuauuuucuaugcauuuauauacguauguggacuuauagaaauauauaggauucuuuugugcuuucugaaagcaugaauaaugacaucugaaggaucacucaauaucaguauauaugaaucaccuuuaauuuuuacucauaugguauuucauaauguagauguacuguaguguauuuuuaaaaccuguauuuaaaauuuuuguauuaaccuucuacaagccucugcaugugugagucuuucagauugcuggguaaaaguauaauacauuuuuaauuuuaaucaauaccuccaaacugcccuuuaaagaaagcuguguggccgggugcgguggcucacaccuguaaucccagcacuuugggagaccgaggcggguggcucaugaggucaggagaucgagaccauccuggcuaacacggugaaaccccaucucuacuaaaaauaugaaaaauuagcagagugugguggugggcaccuguagucccagcuacucgggaggcugaggcaggagaauggcgugaacccgggaggcagagcuugcagugagcagagaucgcaccacugccugggcaacagagcgagacugucucaaaaaaaaaaaaaaaaaaaaagaaaacuguguauuucacuagugagugugucauuuccccauaucuuugccaauaguugauguuaugucuuaauuuuacugaucugauacauaaauaguaucugauuaucuuaauuuaauguauauuuccaugaugguuaggaucuuuuauauuuauuuccacuuuuuuuuuuuuuuuuuaagacacagagucucaaucuaucacccuggcuggagugcagugguaugaucauaguucacugcagccucgaacuccugggcucaagcaauccucccaugucagccucccuaguagcugggaccucagcugugggccaccacaucaugccuggcuaauuuuaaaacauuuuuuagagacagaggcucacuauguugcccugucuggucuugaauuacuugccucaagcaauccuccuagcucagccucccaaguagcugagaugacagucaccagccaccaugcccagcucaaugggcacguguauuuccuguuaagggaauugccuguaucuauccucugcccauuuuucuacugaguuguuugccuuuucuugcugccuccuuuccugugugcucugaaaucugccagguuaacauugcugcuuagccucuugcagagguugaugauaggcuauggaauuuguuuuuccucuucuuugaaaaucagaaugcuguuugccaguuucugauagucuggucuuuucccccuucccuuugauuccuuggagaucacccaauagguuucucaagcccaauuucccuuaugucacuggggcaccaccgauaguugggccuggagcucaacuacaggagaguagggcuuccuguucuuccuccccaucguggacuuucaggcucucuuaaccagguuuguucccuuuuuccuggugaagaucauucuucuuaaugaaaauguggaauuaaacccagaagcuggagaauucugccuucucuguuuaugcugggucaucuucccuaagcagagacaccuacaucucuuuuuuuuaaacccccauguauuuuaauaaauagaaauuuuguuuuuguuuuguuuuacuuuaaauaaacaaacagcuccuucuagacuuuacuuuuucugccauuguucaugugggcccauuccacuauggauuugugccccgccuuccauuucuuauacauguccuuuuauaauuugagcuucaagaguucccuguguuauuacacuagagauggcaaaauggguuucuucuagugucccaacuuugcucaauucauuguggcugacuaggaugcuagaugagagagaauuugagaacgagauugaacuuuauaggaaaaaaugcaugauugaugaaugaugucuggcuagaacccuugaggauuaaucuagauagcugagauuuggguauuuuuuagcaucagauuuugguguuggaagggcuccuccccuuucccuagucucaggccauuguaucaucccuaguuuuucucugacauugagauguauucuuauuaugcucuuaauaaacucuuaaaacuccaugaucauguuugcacaagguuuugucccuuuaaaaauaaaaaacacaggccaggugcaguggcuuaugccuguaauccuagcacuuugggaggccgaagcaggcggacaacuugaggucaggaguucgagaccagccuggccaacguggugaaacuccaucucuacuaaaaauacaaaaauuagcugggcuugguggcggguuccuguaaucccagcuacucagaaggcugaggcaggagaaucgcuugaacucaggaggcagagguuucagugagccaagaucaugccauugcauuccagccugggcgacagagugagacuuugucucaaaaacaaaacaaaacaaaaaaaacagaaaaaacaaaaaaaaaaagcccaggaaacuaaaacaaaauaaaaaacacaaguuuuuccagcuucugagucacaauaaagacauaauagcauuucuccauaaguuucugagagcugaaauuuucagccaagcgaauacagacuuauuaaauguucuauuuuuccagaauaagauguucagacauuugguugguuaaaauuauucgucaggcagacuaaaucuugccugucuuccaguuugguguuuugccuuggaaaagcuccaucucuguaaguggguggccccaacaguagcauuucauucgcucccucugugauucucacccagaggcuucucucuuuauucauacaggcaggugcuuccuuuauuaguggugguauguauuaggacuguugacugcagaugacagaaaauacagagaaauuuaccuuuaaaaggagggaauuuauugguucaugucacugaaaagcucaagauagaccuggcuuuagaagcaaugggguucaaggcucagacaguaucacuagaagucauauucucagacucugggcucuucccaccuguguguuaaauucagucuugagcuccacgaggaggucccuggcacaucuagggccugguggcaagauagcugcagugggcccaaacucauaucaucaagguuaaaauccaguaggaaagagccagagucuggucuagaagcucugagauucauacugauuagacagguuuaguuuacauuuauguccccgaccaucuuccauggccagggacaacaucaugcugauugcagaggccugaaacacaugcgucacuucugagaaccagggguggagcccuauccaggccgcgaggacugagagugagguggugcacauucccaaggaaguguuagggauccaugggcagaggacuaugggcagaaauggcuuacugggacaugguaaagagggcaucaguaaucaauguccaggccagcugauuuaucccucacuuccuguuauaccuauuucuuuugccuuagguaucuccucccagugcuuagucucugaaaucggauagaccuggguucaaauccaugcucuacuacuuucuagcugugucaucuugugcaaauuaugcaugcuuuugaaaccuugauuuuucuuaguucauaggcuugcuacaaggauuaaauuaaacaaauguaucaagugcuuacuuaguccagugccugagacauaguaggugcucccuaucagcuguauuaacuuccauaggauuugcuuugacaguaucuucaguuguuuucucuuuacccucuuccaguuucaucauuaauuccuagaucucaaugaugagucuccuauggacaaacugcacucucuucucugccaggauguacucaucuccuagcagugugaguuguucaacaguucagggucccuacagccccaucccucaguccuauuugucuucagcucccacuucccccagccucuuccuauucuucuggcccaggagcagagcuaagaguccucacugcaacucucacuuuuuuauuugagacaaaaucucgcucugucacccaggcuggagugcgguggcaugaucuuggcucacugcaaccucugccucccaggcucaagugaaccucccaccucagccucccaaauagcuaggacuacaggcaugugccaccgugccuggcucauuuuuuguauuuuuuguagagaugagguuucaccauggugcccaggcuggccucgaacuccuggguucaagugauccaccuaccucagccucccaaauuguuaggauuacaggcaugagccaccgcgccuagccuguaccucugacuuuuguucucuuguuuguuacacaggcuucagaauuccaugauagacauuaauuccaguauuuuugagaucccacgccacgugcugugagggauacccugcacuccuggcagggccugcucucugcccccgcccccccaaguaaucuucugccucacguccauauucuucuacuggccaugcuguggacucugguuuuugauucucaacaaccuuuuugaaaucugucuuacugacuuccgccauaauacugccuuuucugucuugucuaaggauguuuuuuccucucuaauaagcuaaagcaccaacuaaggagguuauuuggcauuuacagcuuacaaaacugagaagugacucaggcaggagggcauaucagaaaacaacucaucuuuuuucucaauuuccuaaccucuguguuaucuggaguagcugcaguccugucuugggacuaaagaaacuuguaguagagucaccuuuagaauaaaguccaauuuccuuaguaagucuuuggaaacccugcaugggccuggucccuacaaacaccuuugguucaucucuugccauuucccauucucugugguaugcugaacuucuuucaucaacuugaauuggugcauuuguucaugcauucauccauuuagucuuuuauucuauaaauauuuauuaaggguggccaggcauggugucucaugccuguaaucccagcacuuugggaggccuaggcaggcggaucaccugaagucagggguuugagaccagccuggccaacauggcaaaaugcugucucuacuaaaaauacaaaaauuagcauguuggcacaugccuguaaucccagcuacucaggaggcugagacaggagaaccgcuugaacccgggaggaggagguuguagugagucgaaaccgcgccacugcacuccagccugggugauagagcaagacuccaucucgaaaaacaaaacaaaacaaacaaacaaaaaacauauaucuauauauaaaacuccugagcucaggugauccacccaccuuggccucccaaagugcugggauuacagaugugagccaccgugcccggccacuuuuauuaccuuucaugaaagaaaaaugucucuagcucuguggguuugugugaugauaagaagaggugguaaagugcuuagcucagaguuuugcauuuaguaagugcucagucagugauggcugccgcugccagauuccuguccuuuauuagaguccauuuauuauagguaauccgguagucgugugugcccucagccucucugggcucaguccugaccuugcagaauuguuacagggauugcagguuguccaugacagauuccuagcacacaguagggccuagcauaugguaacaauaaccaagccauggccauuaaaaaaauguaucucccagaacgggagugcugguuucccuggggagguggaaagugagugagcguggugugugcuagagcuucaggguggcucagguugagcugugacugguggcauggcuuacccagguagaagaaagagagaaggauucuucaggcaggaaugaauaaagugaggagggcuggcaggccuggaauagcuuuuuuccucuucuuagucugguuugucaaucccuacaacuuuaaaagggauuuugccaauagcugcucuacugaggcaggaggcagccucagccuagcauucugguuuguuucguuuauucugcagccucgcucuucucugugggagggaggccugaaggauuguggagggugucaucaaagcugucaagcccucuuguuaauuuaggcaaagcacagcaugaaaaguagcaggcuauucucccuccaucccaagggagcugcccuauuuaacucuggggaaaagaagaaacuaacucccuucuccauuucucccuggcuaucuccuuccucaaaugcuaggaacucauucaaaagagcgagccugccuuagggugcuccacauacuuugggcuucuuucucuucagucuuuuguacaagucuauugauuaugcccagaguggguucuggcuuuugagcccacccuauuccugagacugcagaucagugcucaggacccaggaucuguuaacacaggcugagcugguuucccauggcaagacuucaucaucuggccuggcucagauccaacucuccaagacucucaguggccuggguucuuguucuuaggcuccuaguuuggucauuuagguaaggugagcagggagggaucccuccagugggauuacaacagaaaggcuguguuggacaucaggacuaagguucaaucaagccccuacaagcugucauuccucuucccaucucagucuuugaaugagauugaauguguguggggugugugugcauuuagcauuaagauaggaggaaauauuccucauugccugaugagauaaaugauuuggaggcagaauaaaauaauaaucagugcacaguugcuugguaagaucuguuaacauucaaguucuugugaagaaaagaaauaagagagaaguaucgccagucugagguaugugcucuucccacuugcaagggaaaauaagaauuugcucuaaacagacaaauagcauucugugauaugcuagaaaugcuggggcccaaccccagucaaugauaagaguagccccuuguaacaguuaggggucauguuugguugcuagaaauagaacaacccaauuuaagguggcauaaucaaauuggauuuuaguuuucucccauagcaggaauccaggguuagucaguagguugguacaguagcacugugaugcaaucagggacgugggcuuuuuaucaccuucuacccagcuuuuuagcauaugacuugcauccuuauuuuuaucacuuugcaauucagcaaagucuaaaucccaggcaggaagaagagaaggguuagcuaagcuugccuucuuguaaagacuuuccuggaggacuccgccuagcaauuuaugcuuauaucuuauuggccaaagcuauguuauaugaucauccucagcuacaagggagauugggaaauguaaguguuuugcuggguacauugcgacuuucaaaaaauuggggcaagggaggagggaauaccuacuggguagugaagacauuuguaucugagggcauacugugugccagacacugugcugugcuguuucugugcaccauuaauccucacaacaacccaaggagacacuguuaucccauuuuauagaugaggaacuugaaacuagagaggucacuugcccaaggucacacagcuuauaugugguggaaccaguucuugaaucuagguccagcugguucuaaaaccugugccagcuguuauuuucaaaaagugacacauauggccaaaauggccacugagugucaggaauuuccuguguuuuugaacagugaccgguuucagauguucacgaucguagcaaugaccugcaugggaacagcagcccagcugggaaaggcuuguguuuucuuagcuaaacaucucugcuuugcauggccaagcugccugaguaauacagucauugacggccgaggggugcuucauuccuucccaucguugugcuaaaucgagcauugcagaucuguuuugugacaagugucacaaauuugagaggucauguguuaaguuguugggaaugcaaggagacagggagaauaccaaaaaaccuuuuugaccuuaaauuccauaacuuaguaaguuaaauguucaggucugguaaggugggggaguagggaauauuacuuucaccuuucuuaccugcagccacagccugaacauuuugggaacaaaggugcauuuuauguaagucccgggagccaugggaauaaggagcuguucauaaccccaaagucuucagggcuagaaaacugcccaguggcaagcugacugccauucgcucugccacccucuaaagcuuuguuuugcaauaaaugcugguauuaauuuaaagaaaaugauuuaucauccucugucaaauuuauuuccaggaagcacuggcauauauggaaguguauauacucauguacauacauaguaaggacuaagaauuaugguuaaauuagcuccaagcuuagggaagacuaacagacuccaugauuugagggucagguguuuaugggaacaguauucaaugugguuaccauaauuaaguugggcuccaggguugucugacuuugaaggcaaaggcuauuuucuuugcuacucucuuauagucccaggugccugucccagugggggcuguauaggugcuugguaaauacauggugaaugguuagggaaggaagaaaaauccacauuacaauugguuggacugagacauugugcccacaaucuuugggucccagaguugaagaauccuucauuuccucucaauucuaaugucauacacauagguggcauauuuguuucacugucuggcuuuuaugacaaggugcucuuuaucuuuggagugugaauaacaaggagauacaauuaccuggguaucacaauuggaguaaccacuuagaaauaucagagcaagugaaaccaaagcagcaugcaagauucuaaaucuucagcgacuuggccagggugugauccagagggcagcuggagccuucaucaucuccgaaguagccucagcacauccucuauggguaguuuccuggaugugagaaauaauaaagaaaauaggccuggcacagugguuggugccuguaaucccagcacuucuggaagcugaggugggaggauugcuugagcucaggauuucaagacuagccugggcaacaaagaaagaccuugucucuacaaaaaaaaaaaauuaaaaauuagccagacaugguggcaggcgccugugguaccaguuacacaggagucagaaguggaaggaucacuugaucccaggagguugaggcugcggugagcucuguucacgcuagugcauuccagccuuggugacggagugggacccuguaucagaaaaagaaaaaaaaaaagaauggccaacuuaggcaacuugaggacuguugguucaguuuacacuaaucuaguuauggaggcuuaaagggagaaaggaaagacaaagcuaaaaccuaucgugugaaaaaaagaaaaaagaaaaaagaaaccugucauauguacauuguggaacagaguugucccuuuauaaacuuacgguaagaauuacuuuuucuuuuuugaggcggagucuugcucuguugcccaggcuggagcacaguggugcaaucucagcuacugcaaccugugccucccagguucaagcgauucuccugccucagccuccugaguagcuggggcuacaggugcacaccaccaugcccagcuaauuuuuguauuuuuaguagagaugggguuucaccauguuggucgggcuggucuugaaccccugaccucaggugauucaccucccuuggcacgccacugcacccggcugaauuacuuuuucuguaaguaugggcuccugaauauuucccguauuuuccuccuacuggaauuuauagagccacugaauguuaacaaugaaugggcccucacucauuacuaucucaauaugucauugugaaaugauuaauaggcaggaccccuuucaguauaaguagcagaaaccaaacucuaacaacugaaaaagggaauuuaggcccccggcaggguggcucacgcuuguaaucauaaaacuuuggggggcugaggcagguggaucacuugaacccaggaguuugagaccagccugggcaacauagcaagacccagucucuacagauuuuuuuuuuuuuuaauuagcagagcuaauuaaaacaugcaugcaccuguagucccagcuacucaggaggcugaggugggaggaucacuugagcccagcagaucaaggcugcagugagccgugaucauugccaccgcacuccagccugggugagagagcaagacgcugugaaaaaaaaaagaaggaauuuauuuauucacaaccagaaaauccaaagagauaucugguuuacauaugguuagauguaggagcuuaagccaaguuuuuaggauucuauguuucuccaucugcuuuccuuuguguuaacuucauucucaaguagugccuucccacauaguugcagcagcuccaacccaagucccagggcuaacucugauuggccuggaguagucaacuccugaaccagucacugagacuguggagccucagcuggacagggagucagcagcaccugaaccaccuggacugaggguaggagaaagugauucccaaaugaaaauugaaaugcuguuaucagaagggcaguggauacaguguggggguuggagaggaaagauguccucuguuggauaaaaggaguuccaaagaugcauuauuuuuuuccacaaagcuugggguuuccauggaaaagacauugguacgugaacagcgagaagaaugcuugcuuuucucaguucucucuguauauuaguccauucucacacugcuauaaagaacugccugagaauggguaauuuauaaaggaaagagguuuaauugacucacaguuccacauggcuggggaggccucaagaaacuuacaaucaugguggaagggaaagcaaacauguccuucuuugcaugauggcaggaaggagaagugccaagcaaaaagagaaaagacgcuucuaaaaccgucagaucucaugagaacgcacccacugucaggagaacagcaugaggguaaccuaccucaugauucaauuuccucccaccagguccuucccacgacacauggggauuaugggaacuacaguucaagaugagauuuggguggggacacagccaaaccauaucacucugccuaaguuaaaggcaacagacccacacacagugagaagcagaucccauguggaggguuguauuuucacguuauguuggcauuguaacuagcucucagggugaguugcuucugcgcugaaucuguguuguuuauugauagcugagguucugaaguuguugcaaagacaccugggguguggccaccgaaauguaaaugcaguagcauuucuauuauguacucucauguugagaugaaaacgccucuggcuuggccauuuugagugauggaucuuaaggcuaggaccuuuuuuuuuuuuuuuuuaaccauggaguauagcuaaaccagcugccccaucuaaguaaacgucuuuguuauuuuuucuaguccaucugagcugagcuggagcaaguucucuugccucccuaaucuaaauucugcaaagcuuguggagccacuauuguaucccuggugccaggugaucaggaugcagacaacuaggacccugccccaaggaggcagagagaagggcagcuuacagagggagauggaccaugaaagaggagcccuccaccauguaccaaagcuccuccuguagccucaguucacacccugaccuaucaccccuccccauucuccuuuauagcuuccagguuugcacagacacauguggagaggcaguagagcaaagccuaacacacaugggcucuggagucuaccuggguuuaagcccaggcuccacucuguuccagcuguuugaucuugagcaaauaaucgaucuucucugugagucaguuuccuuauugcuaaaaucugacuaauaauacuucacagaauuguuguagauagucauugagaguuguuucuguuugaacuguucccugauaagauagaaacagguugcuauucacauacagugguugcugugccuguucucuauucgccaucuuugaagaguguuaauuaugcuaucauuuguacuuugggcuguguuagacaccagugggagggauccugagcucaggagccuuccauuuaagccccaaauggacaaauugcaaaaggaaaaggcaagaucaguagcacagaguagaauaggagcacaggaguggucuucaugggaaugucacauguauaauuuauucauucucucuugcaguaguaguuacggagugccuauuccauaccagucacuguguagaaguucugggcuuaugaugaucagccaggugggccacuggccgaaaauaacucauaguuuauuugggagcuagaugaguaaacaaaguuaugguucagugcgauuagugugacaguggggucagcauaagauccuauucuaaauuggaaguguaugucaggguggcuuccuggaggaggugguguuaagccagauccccaaaggagcagaaguuaggcaggcagagugaggacaugagcaugaaaggcguucugagcagagggaauagccugugcaaaggccugcaggugauugaguguacagugcauuucaucauggagucuuggcuguggagcaaacugaaugugcugcugucauugcagggauauggagaagguggagcggcaggcugucccccaggccaaccacacagaguccugucacgaauguggccgggugggacccggacauacgagagauuguccucaucguggccaugaugacauugucaacuucgagaggcaggagcaggagggagagcaguaccguucccagagggacccacuggagggcaagcgggaccggagcaaggccaggucuccguacucgccagccgaggaggaugccuuguuuauggauuuacccacuggcccaagaggccagcaggcacagccccaacgggcagagaagaauggaaugcugccugccucauauggcccaggagaacagaaugggacugguggguaccagcgggccuuuccucccaggaccaacccugaaaaacacagccaaaggaagagcaaucuggcccagguggagcacugggcaagggcccagaaaggggauagcaggaggugaguaauagacucaggaucgcugcuuauaacgagcacgauaauguaguggcaagagcugucauuuagccagcacuugcugcguaagggcagccuuaaacucuuuacugccauuaccuacguaaaucccuguaacaacccugcaagaaagggugauauuccuaacuuauagacagaaacugaggcuuggagaagugaaggaaccugcccacagcacacagcugguaaggccagaguucaguccugggucugugagccuccaaggccuccaugcgauuacaccagagucucuucggcuccucagagagaaugccuugagacauucagcauguaaaugauaaucgaucuuuuccuuuugugcugcuacuucucuacauccaaaaaaauguuuauagaaacuagaguaaauacagauucauuuuuaauuccaggcacauacagaagugcguaggcacuguugacauugggcuuuaucagacccauuccuucaagaaguuuuuaauuauuuagaaggcaugcaucucuugcuauuugccaagcacugucuguauuuuauuauaauuucagauuaauuaggacacauuucugaaugugaagaauucagggucacuagcuuccccguuguccccagaagccacugugcuuugucuucauuaugaaagacgugacagauuccccucacuauuuucaggcuucuaaacaaaucacugacaaaagaggagauagcaaagccaaugugcauucagagagcuccccagggauugcagcggaugcgccagcauccagaccaagucugccacaggccugauaacaugcucugaaaggccacacuucauucucccuguuggccaggcccagacuuucuaccuguggacucuggagguggucagugcuccuaggggaauagccuaguccuguuuucaaguauguggguguguuaugcauauguacguugcuguaaccucuuuaaucugguccagcugggcaguugugagaguggaugguggauaaaucacaauggagccuuccuaaguaacugauaagacauuguuguggagcagacuagaagagaaggccuguugugcuguagcuaagacaccuucccauucccaacugagaaugaccaggugucaauccuguuuguucacauuuugugucuuauuaauaaaacagaaagcuacugucugaggacacagggaagggaagcugcucuucuuggugccggccuaaguaggccccugguaggugguuguaagaugacguuacugcugagugagguuggaaaguuggcagggguaauguaauguagguccucauacuccaaaguaaggcauuugaauuuuauuugaaaaagcaauagggaaccacgggaagguuuuaagcagguaagugauaugaucugaugaauauuucacaaagaagguaagagccuaggaaggaggcuauugcaguaguccaggagggugacaauggaaauaggaugaauaaaccaauuugagauacauuuuggagguugaaacagcgacacucguaagugaauucgaaugcgggaugaaggaaacaacaaggaugaugucuagaauuuuaaaaacuuuguuuaauuuuuguggguacaugagaucuuuugauacaggcaugcaaugcauaauaaucacaggguaacugggguguccaucaccucgggcauuuaucauuucuuuguguuauaaacauuucaguuauacccuuuuaguuauuuuuuauuuuuuaaauuaaaauaaagauguaaucuugcuauguugaccaggcuggauucgaacuccuggccuuaagccaucuuggccucccaaagugccgagauuauaggcaugacccacugcaccugaccccuuuuaguuauuuuuaaauguacaauaaauuauuguugacuauaaucauccuguuaugcuaucaaauacuagcucuuauugauucuaucuaacuauauuuuuguacccauuaagcaucccuacuccccccugcccacuacccuucccagccucugguaaccauuauucuacucuaucuccaugaguucaauuguuuuaauuuauagcucucacaaaugagugagaacaugcaaaguuugucuuuuugugccuggcauauuucacuuaacauaauguccuccaguuccaucuauguuguugcaaaugacaggauuucauucuuuuuuaaggcugaacacuacuccacugaguauaaauaccacauuuuguuuauccguucaucuguugauggacacuuagguugcuuccaaaucuuggcuauugugaauaaugcuacaauaaacagaucuauagaauuuugacuugagcaacuggacgguuacugagauagggaaggguaaggaaggaacaaguugggggaaaucaggauuuccauuuuggacauguaaguagggaguuggaguucuggacauggguggaguuggaguuagcauucagauuuggcuugguuaauagguagauauggugcugugcagcagauacaagcauagguaagagacaugagcuuggcgaggaaagugguacuuugggaauauccagguagagaugaucaggaggcuauagggaauguggguacagucuguagaggaauucuagagucauugccuuagagaugguaacuaauacccuggcaguaguugagauuacccaggguggaaugcuuacagccauguuccuuaauccugucugcaugauuugaucauuugaggcccaacgccagagauuuugauguaguugaucuggggugaggucaagguaucaguauguuuuaaaagcuccuuagguugaccagguauggggguugauaccuauaaucccagcacuuugggaggccgaggugguaggaucgcuugaguccagaaguuugaaaccaaccugggcaacauagcaagacaccaucucuaccaaaaaaauuuuuuuguuuuuuaaauuaucuggaugugguggcaugcaccuguggucccagcuacuugggaggcuaaggcgggauaaucacuugagcccaugaguucaaggcugcaaugaguuaugauuguaccacugcacuccagccuggaugauagagcaaaaaccugucuccaaaaaauaaauaaauaaauaaauaaauaauacauacauacaacucccuaggugauuccagugcauguccacagucaagaaacuguugcuaggcugcacauuggaaucaccuggagaguuuuaacauuuggugaggccuugguccccugcgcagaaaucugacuccauuggucuggguugcagccuggacauaaggguuuuaggaagcacauuuuccccuaucccucuucccccagugaucuaaugugcagccaggacuaagaauccucaacugagagagcacaguugcagagggccaacaacagaacacugaggaccccuagccuaagggucaggcaaaagcuaagucaccugaaggagaugaagagaagaugggggaggaaaacuggagguuuuguuggggagaguuucaacuggaaggaguccagucagcagugcacggugcugcagguaaggacuuccaccugggcguggugccuucuuuccuuuuuuuuuuuuuuuuuuuuuuuuccccuaccaaaagcagacacuugagaugugguaccuuucaaggaggcugggcaccccugaaggaaaguccagaaccucacgggucuuuugcucaguaacagaaacccuuuuuccacugagcugcuugaugggcuuagaugggcaaaccugaauuaccaugcuuaacagagcuacagggucaaaguuagcucaggacgcagaguaaaaggagggguugaaaucaguaagacggcauggccagugagaaacucuuuguggcaggggcacagaaaaaacuuucaaaagcugggugacugauaugcagugauaaguugucaguuaugaaaugucuccgcauaacugcuccagcagccuguaaaccauguuauucugcuacacacaacggccugaauuugagaguugggaguggggugugcaccagagaccuaaaggaugagaaguuaacagggaaaugagagguggguggggagggcauaggacuuucccugggaugcaagauggggauuugagccauucuuaucuaaggggaagggagacaucaggucuguagaggagaacagcucauuggcuuuagaggucacugagcacacagugagaggaauuucauuccaguagggcaagcagaucucaaugggcuagaaagugaauaaaagugaagaauugaaggcagaagacagaacagaaaaugcugucaaucuuuaagugagcaaagugucucagucucugauuauccucuuguauuuuaaaaggucugccucuuauagucccagauuuuuuuuuucuuaaagauauauuuguagucucuuacaguuagucauaaauagaucuaggugcugaauaaaggaacuccuccauuuuccauuugaaaauauaugagauagauaucucugcuuugcauaucaucaagacugcuaaucucauuagacugagcacauuaagacauugggaggaagguuauuugaacugcaauaugauccuguauuuuuggcuuuaaaccaacagggaaguauuucuaauuggagauacaaauuucacauuaaacuuuuuuaggauaugguuugugggagacagacugacacacucuuagaaucucacuguauuuuaagagcuuguuuugaaauuuuaggcuuucauuuucccacccugaccucccaguguuuaaaguaaugcauacuuguaaaauagaaauguuggggugagggauagaguuaggaucaggagacucaaacacuacaauaaggaacagaguagaaaauggaaguccugugugauugaucuggaaguuagggugaggaacaucugcugaguaaaguauaauaauuuguugcaaaaaaugauauugcaucuccacaugaccauuucuguaauggcuguaucagaauauccuguuuagugccuguucagugacagggagucccuguggccacagagcaugguauaaggagaccuugagcccaguuuuuggguaagaccggagguuagggggccagcaaauggaucugcuguuaggggcaaagcugcucuggaagcacccacuugcucgcauggggucuauaccucaaccacaguaccaccuccuccugugucccuccuccauaguuaccuuguuuugaccccuagagccagggcucaccauugcacugguaccuuggggucauuccagaauggcagacuauguguaaauggaggguacagguuagaggaugagcuuagggauuugaggugcagcuaguggggcaguggggaggugaggguggacucugaccuuccaggcacuguaggcaggcaaggggagugagcugcagagccaggcaggaagggcguaugggugggagcacagcucugaaaugcuuugcauaguuugcauuuugcuucuggcagaaugaacaaugguuagucaaguccugaacuccccaggggaagccuccagccugguuucugccaccgcuaccaccucuguuuugaggauucaggcacugccccgucucagaggcacauuugugucuaacuuugggagaucgauagcaaacccugccaccuaguggcaggccgacucacuuggcaggcacgacaaguagguugaagagaucuuaaaauuaucuacuguaauggcaaagauagcuuuauuugaaugacaacuauuucaaauccucacagcaauuuucuaagugguucuuacuauccccauuuuguaauaaggaaggugagacuuagagggccuggaugauacuugccugaggucauauagcuaaagugauuaaaugaguugaguuuuaaaacaauuagaacaguuucucaaaccuuacagagcacuagaaucuccuggagggcuuguuaagacacugaugccugggcaccauccccagaguuucugauuagguaggucugagguggggcugauaaccagcauuuuaaaaauauaucuuauuuuuaauugacaauaauuauauguaugggguagaugugauguuuuaauauauguauacauuaugaaaugauuacaucaaaccaauugacauucaucaccuuaccugcuuauccuuuuuggugguaagaacauuuaauaucuacuuuuaguaauuuugaaauauacauuauuauuaaccauugucaccaugcugugcaguaggucaccagaacuuauuccuccuaacugaaacuuugcauccuuugaccaacagcucuucuuccaucucuccucucccucccaaaaccucugguaacuaccucucuacucuguucuucuaugaguuugaccuuuuuagaucccacauauaagugaggucauacacgguauuugucuuuccaugccuggcuuauuucauuaaugugcauuucuaacaaguccccagguggugcugaugcugguggcacacaggccacacuuugaguaguguuggcuuggaacaaugucuggcacaauaucagcaccaaauaaauguuagauaaaauugauaggugaaggcagagucagaauugaccucaagccugucugacucuaaaacuuguucucuuuuuacaacaucaugcugccucucaggcuuaguaaaauuccauacuuugucccuugcuuaauuuuuuuuccuucucagaaaauaaguuggaggcugggugcgguggcucaugccuguaaucccagcacuuugguaggcugaggggggcagaucacuugaggccaggaguucaagaccagccuggccaacauggugaaaccccgucucuacuaaaaauacaaaaauuagccaggcgugguggugcacaccuauagucccagcuacucaggaggcugaggcaggagaaucccuugaacucgggaggcggagguugcagugagccaagauugcaccgcugcacuccagccugggcaaaacagcgagacuccagaagaaaauaagauggcggccaggcaugguggcucacuccuguaaucccaacacuuugggaggccgaggcggucagaucacaaggucaggagaucgagaccauccuggcuaacacagugaaacccugucucuacuaaaaauacaaaaaauuagccgggugugguggcacacgccuguagucccagcuacucaggaggcugaggcaggagaaucacuugaacccaggaggcgaagguugcagugagcagagauugcaccacugcacuccagccugggcaaaagagcaagacucugucucaaaaaagaaaaaaaagagagaaaaaaaaaagaaagaaaauaagauggcuaguugguguuaguuuuugaagucauauccaguuuugugugcuggaguguuuauugaagggcuaauuacgcacaggacuuucuuagacuguggacaauaccacggugugaaacacaguuccugucuuucaagaauuuuucaccuuggccugggaaaacaugucuuggaaguaugaaaagaucacaucaauauaggaccuuggaaaaguuacaggcagugugaugacgaggucaaacagaguuggaucacugagggcuguggcacuacagaagguccacgugggggaaggcaugagccagcauccuagagaaugaguaagacuuggguaaauagagcaaggggagaccauccaggcagggggagggaagaacaguguuauaagaguaagaagggcaggaaggguacacacguuagugaaggaccuucuguguaucagauguggggguugcauuuccuaaccugucucauugauuccucagaagagccuuaugaggcagguaauacuauccuccuguuacaaguaaggaaacggaaggucagagcagucaggugagcugccuagggucacaaagccagcaagugucaagcuuggcuucaaacccagguuagacuccuuuuuccuuuuuccguugcaagauguugcuaagguguggaggaggcugggacgggacuagggugaggcugucaggcaccagcagguguaggggugacccugagauggaguacuuccuucaguuuugggcccuaggcauuuggcguggcccguaggaagagcagugagaaaacagcaggccugcaagguggguguugaggucagcugcuagcgagcugugaguaccaggcugaggaguuuagacuuuauuucagaagggacaaggagccauggaaguuuuugcagcaaggaacugauaugaucagagcacuugacuguggacaaaguggaaacccauuaggagcaucucagaguugucuggagggagauaauuaaucaguaucuggacuagaagaguccagaaaaaagagaacugaugccaaccacuuccuuuaugaaccucuggaacuuggugcuaaggauaccaggcagagagaaaaucuugguaacuuggagaauugugaggccuuuccuauaaauaugcauagccauugaaagagcugacugcuggcagcggagagagaaggaaaagccagguuuaaucacauugcacuccaagugaugggcaugggguagccaaguuguccuggcagaggaaguugacagagaaaaaugguuuuggagucgucugccaaaaggggaagugacugaaguccuggaugucggccuugaucauucuuuugagguucuuacaggacugucccacaugcccagcuuuguggguuuacuuagauauguuccccaaagccugcagaacccucgcuugguugccugacccguucuuacccuuucuccucagucuucccuuggaccagacgcuuccucgccaggguccuggccaaucccuguccuucccagaaaacuaccagacucuucccaagagcacccgacaccccucggggggcuccucgccaccuccccgaaaccugccaagugacuacaaguaugcgcaggaccgagccagccaccugaagaugucgagugaagagcgccgggcgcaccgggauggcaccguguggcagcucuacgaguggcagcagcgccagcaguuccggcacggcagccccacagcgcccaucugccuuggcuccccagaguucaccgaccagggccggagcaggagcaugcuagaggugccccgcuccaucucugugccuccaucucccucggacaucccucccccaggacccccaagggucuucccaccccggcggccacacacaccagcagagcgagucacagugaagccaccggaccagaggaggaguguggacaucucgcugggggauucuccaaggagggcacggggccacgcugucaaggugaggcucgggaagcucugccaggcugcugggucaucaugagggcgccaggagcuuugccugguuugaacacaaauuugaguaauuugggauaauaaugauagcuaauacuuaggcaguacauuuuaauaauagaugccaggcacaguucccaagggcuucgcuuuaaauucucaccacaacccugugagguaggugcuauguuuaugcccauuucaaagaugagaacucugaggcgcugagagacaaaguaacuugcacagggucacacaacuacaagucagcuuccuugcaucuugaaaggcaggaaaagacaucuguguccagucaguuaaauuauaacaauccagcuuaaguuuucacuuuccaagaggcuuucacaguuuaguguucuaacccugagaguaagaugugugugcucauuucauagaugagaagucuggggcucagaggggacauggcauggggcggcuucccugggagugaguggcagagguuugggcuccagugugacuucuugucuccccacuugcagaacucaucucauguggaccgacgcuccaugcccuccauggguuacaugacccacaccgucagcgcucccaguuuacauggaaaaucgguagggugaaugacaagacauagccugcaaagcccuaucucaucaacauuuuccuuccucugaguuaguacaaugcaguccagagggcagcuauuaacccccauauuagagaugaggaaacugaggcucagagaaguugaaugacuugcuuagggucaccuggcugucacuggguccccagugaaggggaagagcguaucagggaaauguaggggaauauuaggcuuaucuccucuuucaagaugaauuuugccagaaacauuuuucagcuacccaccuuuuuccacaggcagugccucuccuuucuucccugaucuuugauuaguuaacuaguuaacucaaucuucaaagcucgagucugagaccaggugugguuguucauacuuguaauccuaccacuuugggaggccgagguggguggaucauuugaggccaggaguucaagaccagccuagcaaacauggcgaaaccccgucucuacuaaaaauacaaaaacuaucuggguguggugguacacuccugugaucccagcuauucggaaggcugagauacgagaacucaggagguggaguuugcagugagccgagaucacgcugcugcacuccagccugggugacaaagcaagacugucucaaagcagaagaaaaaaaaagcuugagucugggugagguugcacuguugguuguugcuuuccugaaaaaaacuuccugaagcccuuuuacugccagugccuuuauuuguccuaaugacagaauugacacaguaauugcuuaacggugucacaucagugcuguccuggcacugacaccggggugaagagcguaauucuagcagugugcuccugcggugcuaacuuccuugugcugugucuacacaucugcagcuggaggagcucucguugcuucucacccgguuaaggcggcaccaggccaaguuggccagugugcgaaauuucgccaucagccaguuacugcagcaccagcugaccuuucccaccugccaggucagcacuggugggcuccucucagggccgggggcagggagugacaugcuggcucgcguucgcucgugcccaugcucuggucugucugugcuuucuggcucucgcguguucgcugccuguuugcuucuggaugcuacugccagacacucuguggugguggaagcugagccuacccuucuggcacuggggaggggggcugcaugugguguaggggcccuaaacugucgcuucucuggcuguaaguagugacugccaggcugguguauggucauguucaaagggcugugcuggcugacagccuuguugcccccguggccacugcuugggauguggaaaggcacauaugcgucagccuggagggagaugcagggcgcccucucuuaucuggauggugcccugcugccucacagagugucuucucaucucauaucuugcugaaccucacaguaagcuggaagagguuagguaggagaggaguaaggaucacacacaaggcaaguggaaccagaaggggaagugacuugcucaggaucccucagcuagaagcaugcaggcugcagccaaaauccaaggccugcaugacacaauguucuaaacuguugcaagaacguugggcuuugcaggcaagcuucucaaggacuggcuagggggcugcccucccggguaucuugagcagaaggauuaaagaaaaggaucccucccugggguuguccucaggcaaaaauagguucagccaacgaggcugguccuccaggcuguacagagguaggcaggggacagaugaggaaggugacaggacuguuaccuuccuuccuuguucuguuuuagugaguuuugagagauuuaggaaauguauucagaaaaaugaaugucagugaaaaacuaucaucaguugugaaucuaagugaucuugaauaaccuucuucuguucugucuuacuccuauggcaaguguguagggacugagcuguuugggaaguauagauggguaagaaguuaguuuagggacacaagaccuugcaagccacuagugccccugacaguuguccuucaggcauucccaugcauaagagcccugccucaacucuucgugugguuugucugugugacugucuuaccucagagcuguaagcaaaggccaccugccucggcccuagcuugcuuggcugugacccucuuagucugcugagaagauggugccuggauuauuuuucuuucacagcuuucacagcuccucugccucacaguuagcuucugugaucugcuacacgggaaagcaugaguuuugggaaaucaaagagucuuuuucuuauuuucacuguuucugguaauuauacugaagaacuugauagauugucagagaugccacaagcagauaggucugaccuugcaccugccucagguagcuccugacauggcuacauuggcuccauggugagcaaaaagaaccaaacuugcaggaaauuuccagcaguugcuggugguuaucauucuggaaaccaaggucguauugggaccuccugggucacccaggccaucucccugccucuucaaggcauccacccacaccagugagcuucaucuucaugcaugugaagugauccagaccaaagguuugauggauggaauuggagugaugaugacugaugcgcucuagcucagguguggcauaugcuccuccagguggaccucccaggucuaucuugggagcacagcacugccucagcuacccuagcccugggguaggauccucccugccaaacucuuccccuagccagugggggacaagcugacuuuccccacagugaccugcaagauccgcccugcugaaagacggcucucagcugcaccgagacauuugugcuuccucuguggccccugauguguuggucugcugugguuccuuguucccaaagcugcacgauguaaauaauucacaugugaaaccucgaguuauggaaacucuugguguucauaacuguguuuuuuccucucugcuucauuugaaggcugaugauaccuaccuccagcugaagaaagaccuggaguaccuggaucuaaagguaagugacaucaggguuccugccuuccuugcauacucaccuuucugagagugucaccucacuggagccaagcccaaagccaaaggccagacaggucuuauccaaucugaauucuaaaucaauaugucucccaucuugaaucagaagaacuuuauuucuuacagacuaaaacucugccuuuuuucaguuucuugugaauuuuguugugaggucccuggcuuacagaaugagggcuugagaccuugaucucuuccuucucuuggucagaacaaaaaggucccuccaaaagcaaccagucgcuucuucggagucuccagugggggcagggguguauguuugguucacuaauguggguuuucagccacaaguggugugguggguucuuugguucuguugcuaggggagcaggcuccacauggaaucgcauggcuuugaggcucaccgguagucucccaucucgguuuaggaggugaaggcugggccccucccuguaggugauaaggcuucaggcucuaaauuagcuuucucagcacagagagagccaagaaagcuccuguagagaaggcaggaggcauucugccuggaagagaggccuauuguucccugcccacaguccucugaaagcuccuacugugaaaagcacuucuuacgccugagccaugaaauagacuggaggaaugugaccuuuagucagcugugggucugaaaaggugggugaggggccaugggacacucaggugacugccacgagggguggcgugccucccuacagucuccaguguaccuggcuugggauauuuuuaacuuggggaucuucauccagccucauagaagcagguguaugaacaucagguccuaaggaagaagauggaaagggggucuccccacaaugaaaggagaucagggcuuuugauuagaaaucaaccagugcaauucugugucuguugaacacuugcuguguuacccagaugacauggggagaugcagaaaaaaauuugagucugucuggucuugagauacuuccagauagucuuggguuggugaaagaaauuauccccaaauaacagacuccucuacaaugacuagacaaagaucuguuuggccugguucucagagcugagauggugagaaucucuguggguuacaacacuggagaggcuucugggaggagguggcauguguuugaagcuuugaagagccaggggugcuggggcugguugagauuuaaagggaaggaucagugagagccaaggagagccagggcacagugguuguggccagggcagcagaggggagguggcacuaggucaugcaggcuguugacucuauccuaggcuuuaggaaggaagguggaugcuaugagcaaaaagaccuggcuuuagcaugugaggagaacaaggagcuuucucucaaggccaggacugucuaacucacuugacagucaggucacacagagcuugagugacugcucuaaguauggugguaauuccucaggauucaaaaugcucaagcauagcuguauggaccaaauguggcagcccagcccauccuccugcagccuguggggacagacaggguuguucccaccaugccuauggagagagauccagcagcccccagccuccaccugcccugcgcagcaccauauccccguuccucagccucccugacagccagucagcagcugccugcauaguucuugucaccccugacccagggcccaacaguccacucagacauaccuguagagcauccauagugcaccugggccuaugggagaggccuggcaugccagcagcacaggugaguauaaaacacagguauaccagaguguuuagugcacggggccagagggaacuaaaugcaccugagcaagagcagugagaaauagcugccuucugguuccuguuuguaugugacaguggaaacucacaguugguccuggagugaugcuuggccucagguuuguuuuauuucaagaucauagaauuugagcuaugcgggauuaaagagggagaaacugagccacagaauggcacagcagaacuaagagucccugagugucgacuccaacagaagcuuaauaacaauaggggguuauaaugugugccagucacugcauuuuacuucuauuaaguuauuuuaccuccaaaguggcccuguaagggaaguggugguaucaucuuuuaauggaccgugacuccgaaaggcuaaugaguuucccaagccuacacagcagcuagcgggugucaguauuugggugcggcucucacccuaaagcccuucaucaccuugccccacauccucucuuaaaauggugcucuaccacuguguacccaaaggccuuauguuuuuguggagcugagcuuggauuguuaugccaagaaauauauuugaugggauagagagaggcaaguuacauccuugguguguuuuacuaccuaagagcugcacaugauuagaacguuaucuaguuauuggacuuucuggaaguugucauuguuugucauggaaaacaacuguguugauaccaguauuccccuggucuuauagcugcuaccccgguugcuaaguuccucuccaggaaccagcugaacugcaccagcagccuggaagaggcuuggcucaccagcagccacaugcgagaaacaagcuggguuuugugccaagugugugucaucagucugacauggcugccagaaaggcuggcaccccccggcuucccucagaggggcaggcccagaucaggaggcaguaggccugcucugcccugcucagacucagcuuggguuuaggguuccaagaugagagucccacuucaagauccagaugaaggaagggcuggaaucaggggagagguauugacggcuugcagaaccacuggguguguuaggugggaugcuuuuguuuguaaguaucuaaaacccaaagcaacaugcuaagucgaaaagggaauauacuaauucguguagccaggggccccauucccggggcucagccacauugucacucuucuacuuuccgugugugucagacuucuucuuuccuguggaacaagggcugccuccacacgggcagggaagguggcugccugcaagcccagauucacuucuucccuacucaguauuccaugcagugaggaguucccuaaugggacacacuggguggagaaaggaagcacaacagcagcugguacagcuacagugcggaaugauugaaggaguuaggggcgauucaggagaggcauagagacagccuguaaaacucugguaugucuccauguguuuucuguggcccuaaggaggaauuaagacacguggauggcagcuacaaguagauagguugcagcuuaguagaagaaagacuuuucuaaaagggccaccucagguggugguggacuucccgucacuaggguacaacugaggcucaaugaaacugagugggaugaaugguuggauuaggaaaaccccaaggcuuauugguccuuagauucuaugacaugcuggacaaaaugucccugagucaggggucucucuggacaugguugaauaggccuguagaccauucugggcauggaaauggagauaagcacagccccucugggaccagcugcuuaugagagguccccccugguuccuuggaggggggugagguaaggauauaagccucucuggagaggagucucccugcuuggcaucugaucugcugaccucuccccuccaugugccacguugacuuggugucccccaugucccuguucgagaggccaaggacuuaaggauccagagcccaucuuccccugccccccaaucagcugaugcucagcuuccagaaucaggggugcuugugggcccacguugagaagcuuuaccuuccugaagugagcguuccugcuggggugccaaguaaucauacaacgggacacucugcucuugggacccacuuacauuagugugcuuuuuuggaaauguuuacuuugcuggcauuuuacuugauggugccagggugaaaaggacucacauugauuaagcaucuguuccugccuuggcaguauuugggcacuugauguucauuuaucucauugaauccucucagcaacuugagcaauaugaauuauuaucccuuuuuuauaaccaggaacccaggugucagagaaauaaaguaacuucugcaaaguuacacugcugggacauguacgcagcaacugacuucacaccugccuucuuucguccaugcaucacacgcuuugcccacucuaaagucguguucguugaauuguauucuuggcauugaaguucugcucuucagaacccuauaccuuagcugagucagaaggguggggugugggguucacuguuguugacacuuuaaguugucuuuaugcugcggugaagcacagccaggaagaugaggguaccugcugucacucguggagccuuuguagauagaaaagguugcagucagccccaaaaaggcuuuugucuucagugagggaugugccgucaguggcuucgggguuacuggaaucuggacucuuccugacuguuugaaccugagaucaggacuuuucuguucaggcuguuuccaaaaucagcuucugggacaguuuuuaaaguuguaauuggggaugccgcauacuucagaaucaccugggagcuugauaaaagcacagaccuggaggguucuauugaauuggacacucugcugcccagaauucugcauuuuugucaagcucuggggugauucuugugcacacuaggguuugaggucuauuguucuggagaagaaauuauuaacccuggcuaugaacgagaacuguuggggaguuuuaaaaaugaauauaaaugucuggguccuaccccuuagagacugugauuuaauugguaauauucagguauuacuacuuaauuaaaacaaacaaacuccuuagguguuuuuaaugcacauccagcauugagaaacaugguuuugaaguagcggcucucaaaaugugauccucagaccgaaagugucaguaucugggaauucauuagaaacgcaaaaucuugggucccaccccagaucugcaccacaagaaccuccagggauggggcccagcaaaucuguguauuugcccucuggcugauucugaugcaugcuaaaguuugagagccccuguuuuagggcagugcuucucaauccuggcugcauauucgaaucacucaggagaguguuuaagaaucccaaugcccaggccccaucccagaccaauuauaucagaaucacuugggguggaacucaggcaucgguacuuuuuaaagcucccccagugauuccaguguucagcaagggcugagauccacuguccuagguaaugaggacaauguugccaaaaaggagcuauaagcauuugggaccauggguaagacauaaucauguagaugcaccacaguucugguggaacuuaagguugagugggggugagaugaaugcauggcacgacucuaaacuaguaucuuacagaaugugaugagggaggacaaaagaagaagcaaguucccuucuaucauguuccuccuugccuucugccgcagaaccaggaaggaaaugaacacugaaauugcacucccacaaaaaccagccugugcaaaagucccuucagacagcauauaacauuuuauaaaaaggagagagcugcagucugggaaggucccauggcccaugggaggagcauccacggucccauggaaguagcaucaccaagauucaggccugguuguuugaauugcauagcacacagccuccuuaaaguuuucccuuugccaguuccccaaauucuggcugcuucaagugucauuugaugucucaccuguuacguuuuguuguaucugccuuuuuguuuggaacagauuaaaaauaaugaaccuuugaucaacgugcuuuacaaagugcugaagaagucagcacggggcugucggcccaggagaagcguaagaugaucugauccgugucuccaagcggggucauuccauugcuucuggcucggugccgacuucaucacuugcuuaaccaguugcucuccugaccgccccaggcuucccgcaagucauuuugguuuauuuucuuucaacugaagcucucuucagcauuuuggcugaugcaccaggcugagccucucaucugcaguuuucugugacuccauguuuugugcugccaagggugggggagcuugccuggcuugccaccagcuuguguuguguuuccaucaucacgugucugccuccauggcgagggcucacccagacagaguugagcaugaguuucuugggagggaacagcaguuauuggucaucuuccaagagccaggguauccucagaugccacgguggcccugagauuaagguggcacuuuuugggggcaggcaguugguauuuggauaacagccuggagcuggacuagaauaaaaugccacccccugcccauacccucuuugauugaugcagaaguagggacugcaauguggccagcucucacagcauuccaggggaggaugcagaucgagaagcagguguuguguccaaccaucgugagcccugagaaaguggguugggaugugguggaggggagggaagaugccuggguggccuuugauuccccucugauggagagacucuuucaaauggaugagcacccacagacuuuuacuuuuucugaugacagagaugcuggggggacccagaguugauguuuuaaguguauuugaacauggcuauaacaaacacacuuuuaaaaggaaaauuagauguaauacgcuacacguggauauaauauuucuuagcagccucggcugucuggagcagagcuacauucagaagcuuaacgguccucugagcuguagaaacagcucucaucaagcccaugcucuaaagccugugaccuuucguccauaggagacagagucagcucacauuacuuugauacauucaugaacucacugagcaaacauugcccgaauuucuucaauaugcuaggcccuggcugggcuuugaggauacagaggaaaggcauccaucuccacagucaccccuaauuagguuacucucuagugaggagagacaaaugagcaaacggaacauuguacucuaaugugcugggugcuguaguagcagcagaugcaacguguggaaagagcacccugaagggcaucacccccaguuaaagggagagaagagauguaaguaccucgugucagucgagcuuauaguccuuugaauuccuaaccuacaacaccuaguaagcagcaguuuuuuuuguuuuuguuuuuguuuuuuuuuuuuuuuuuugacauggagucucgcucugucacccaggcuggagugcaguggcgcaaucucaacucacugcaaccucugccucccagguucaagagauucuccugccucaaccucccgaguagcugggacuacaggugcgcggcacugugccuggcuaauuuuuguauuuuuaguagagaugggguuucaccauguuggccagacugaucuugaacuccugaccucauaauucacccgccuuggccucccaaagugcugggauuacaggugugagccaccgugccuggcaagauaagcagcacuuuaaaaagggacaagagaaaucuacuucuuagaaaaagagguaguacuaauauccugagagagagaaaaaaaagguugaauguauauucaguauuccaugaaggcagcaaagggcauacuuuuagaaagcuuuccaucaaaaaguauaauuuagaggauucagcuucuucucaaaauguccuuuuuauauaaaauaucucauucuuuuccugauggugcuggauaaaugaggcauugcucaauuagauuuucuggcuuguuauuuaaguaucaaaaagacauccucuguaaaaagcuucagugaaauaaggggaagaguuuugcugggggaaagaauccccagaguguaucuccauuugaaaaugauuucuaccuagaaaaugagccccaaaggucagccgguuuggagaauagacaaccuccuuguucuuggcuuugaugaaaggacgauggcauagagcgaagacuucacugcuuucaccugcuuuuucuccuggguuccccugaguuuaaaacccacauucugccugagaaguucagcuguuugugauucaccaggauuaacuucaugcccaccuccccacaccucccugcaccgccccccccgcauugcaggagacagcacagucuguuuguuuguggauuguugcagucuuguguucugcaacuguguguauacguguauguacacauaaucugacagucugaagagcagaauuuggcuggaguucuauuuuuuccgggaacucaacaacacugaccuacauguguuucccuuugaccuacaugcaaugcaauucaauaagcauuugcugaguuugugccaggucuucuguucagggcugacuuuaccaagauaaaacaaugguuccguccucuucugugugaccaaagggaucgugggaauggguggggcauguguguagcccagaaucaguccucacuccaaggcagggagagguccucucccuugaccuuuggauuugcucaugacaguuugcagggagagguagcauaggacaguugggcacaugaagggcuugagcacugaguggaauguuugccaauuuauuuccacccccaauccacacugacaaacuuccuggaccuuacagauagaauggggagaaaucuacaccucucucuccagcagcuaucgguccacauugggaccucucugcauagcacacacacaccaccugucucugccacuguuagcuccacccuccauuuuccuggucagaucugcaaaauagagcucagugaggugguuuccccuacauuaggcaaaauagacuugguucucccuggccuuaucuuggccaugggagggugcaucugugaaagucacuccccucagccccugcaugacuuuuggcaagaaagaaauugggggaaauggaaaaaugggauaaguaagauuuagauucucaggagucagugagagacaggcagcauauugccuacuuugagucaagugagggaugggaaauguaaaaucccauuggcccgcaaguuugggugacuuuuguauauugcuuuaugguuuccuuucuuguaacuuacacaaguacagccuagccucaguuauucagggaacaauuaaaaacccuugcugggaacuagccagguuccuuuuuaccuuggccaggucuucuucccaaaugguaaaggguaaggaaggcuggccuuacccacggggaagugggcugcucagagacuucauuaaacuaaggcuugacaauggucaagggauuuguuuguuccucugggucugcccaucucaccacccugggcagggggugaugggcuucguaacuuguguuuguucccacguucaguaguacaccucugucuuaucgguggcaaaucuuccaagauucaugcugauuuuucacauucauuuuaggcaaauauauacuuuuaaaauugaugauccuuuaacuugaacaucuacauuuucuuuaacucaaaggacuuaccagcauuacuagaaucaucaaaagguuuugguuuuuuccuaaaaugaaauaggcauagaaauagcgaaguauggcccaaguuuuugucccucucauacuaugacccuaccugccacugccaaggacuuccacaccauccauuauaggaugaauuuucuuuccugaguucugaucucaaacaccaugguuaaaucucuuuuaaauuguucgccucccagaugacaggccgggaccuucucaaggaucgaagucugaagccugugaagaucgcugagagcgacacugacgugagugagcagagugacacgcugaccccucagcugccuccugacccagaccccgggugaacagcuucaggcagggcuuggaugguucuguagccaaaggcugucugauugcaaucccaaggucauguccuuuucucaucaccccaggcccucuccaccuguucuugcuuuuaggucaaacugagcaucuucugugaacaagacaggguccuccaggacuuggaagacaagauacgagcccuuaaagagaacaaaguacgugucaguuuugaauaaucuuggaaugggcagagggacauuuuguccugucuuucuugagacauaggcuggacccucauguuaguauugaagagcagauguuagcuuauuuaaaaaaaaaugcaccaggugcgguggcucaugccuguaaucucagcacuuuggaaggccaaggcagguggaucaugaggucaggaguucgagaccagccugaccaacauggugaaacccugucuccacuaaaaauacaaaaauuagcugggcaugguggugggcaccuguaaucccagcuacucaggaggcugaggcagaagaauugcuugaacccgggaggcagagguugcagugagccgagaucacgccacuguauuccagccuaggcaacagaggaagacuucgucucaggaggaaaaaaaaaaaagccuuuguguuuaaaugguguuucuuagggguuucuaucuuauagagacccuccugcccccauucugcuuuggcuuaccucuccguggaggcccugugaggugagccugggagaggagcuccacuggcuuauaugugaugaccccaggucccugaaccccagggaagcaggguuccuuuggaggaaguggcuguagucauuacagggcagaggccuuugcuuccuaaagcuccuugucuccuaggaucugggcuauggaggcagcaagucuggaugggagugccggaaugggccaggggccaccaacauuuggccuuuucuauucuuaaaguauuuuuuuccuuuugcauuuuaaauucgugaugcuggagguugacaauauacucuuuucccuaggaggcuaaagagguuuuuguuuuuuguuuuuuuaauucuuugauuuauccucuuagcuuaguuuauucucuuaguuuaucccauaaggaguuagacagcuguaucccuaguuuauagaugacaaaauugaggcacagagcuguuagguacuuuccccagccuacucccuagacagagucagagcuggcaucagagccccgacugugggcccacaucucagcgcugaucccuucggccuugguuagguccaguagcuuugguuccuggugugguauggggaggccucuggggacuguccuccuauccugcuguuuuuuggcccuucguggugcaggaccagcuagaaucugugcuggagguguugcacagacagauggagcaguaccgagaccagccccagcacuuggagaagauugccuaccagcagaaguugcugcaggaggaccuuguccauauccgagcugagcucuccagagaguccacugugcguagaggguggcagaccugucucccucaggacgggcugagcaaggggcugcuuuucuccccucccaagauguaguugaguugguguccagaggcaagaguccugaaauagcagagcuucuccaguagcagaacugccaccugacaguagauaaccuugucugggggugacaugucugccugcacgugugccuuaggcugcuuaccacagcgacucuugaaggccagugacacccagugggccagauucuucagagcugccugcaaggcuguuccccugaucugugugcaguuaauuccaaguugucagaaucugcuuuuucacuuuucagucuguugugguacaggccagggcugagaaucaaagcauccugaggguggaagagugaacagugcaggugaccagggucagagcacaaaugagaggaugccacgcucuuuccugcuccucucucucucccaccaggccugcccggucuccuucccucuuccccuggcugggucagcauggucaggaguacagguguucgugaggccuuccaagggggcaggggauaacuaagaaccggaagcauugucuuggccaacaggagauggaaaaugcuuggaacgaauaccugaaguuggagaaugauguggaacagcugaagcagacccugcaggagcaacacagaagagccuuuuuuuuccaggugaccugauaccuguccaucucuucugagcucuuguuuuuuguuuuuuguuuuuuguuuuuccaagagacuucaccuguggggguugugagcacugcucagaguccuucucccccucagccccagaugcuccaccccuguaaaggagccaccccaagcucucccuugaggaucccuuccccaagccaggcugugaugagaagcuucaccccauuccccuugccuugcugcucucaaagacaagcucuuggguguuuuagaaagggcuuuacuucugaucauuuggugucaucaguaaucacagagugauccauguuccuguaguucuuggccccaucuuaggcugcuagcucaucacuuagacagcagcaggaagugcccaccccuucccuccucugauuccuggagauagauguuaucacaccucuaccagagggagacagugugaauucuguccuuugaggcacucuggucuccaggcagucaucugcauuucuggaggccaggcugggugaugcccaucucugugaccccuauaccacucaggaaaguuggccuuagagcccugccacuucacccuuaaaaaaucaggccacccuauugauagcugccucugucccccagaagugagacagugaaaggcccugugugguuuuucuucuuccaaauuggguuccaaauugcccaguguucccccacuguggugcuuaaccagguuuccaccccacccucacaauuuuuuaaguggaaaauaaccuguuuuuuucuccccugacuuaagaucuauaucuucuccuuucagggcccugacauaauaaguguguuugaauucagcaagcauuaauugaggcuucuuguguaugaggcaccuugcugggccacuuuuggugcugggcuugcuaacugauaagauaguucuaaccaaggcucuuuguuuaagugauuuaaugaguauguugacucuccagacauuagccucaccccagaaaguugaaggaaauucuggaguaggguguaggugugugggcccugaggcuuuuccaagggcccugcugucccucuauucaugcagagaugguucccagagagcccugccuaggaccacguggaggagacccucgccuguggcucagggcuggucuacaagacucuccccagcacuugucuaucuccugcugcuguuggggucguuuuccucccauaauuucucuucauccacacuggcuaacauuucacuacucuuuuuuguagccgcagcauuuaccguaaugacuugaaaauacuaggugaauguuguugacaaaguccuucaauuauuucugguuaugaguuuauaaaacugcccagguuauaccuauuuucuuggacuucagugaucugaauuuuuuuagcaguaauuuuuuuuugcuuuauuuuuagcaguaauuuuuuuaagcuuuucauucuuuguuccuguaauuacacaaaugguacaugaauacgugucuuugaaaagaccaaaacaguaagaagcaaaaacaaaaaaugauauaaaaguuccucuucccccucucccuuucugccccucccaucacccucccuaugugucaucagugcuaucuauugguggcauugccuucuagaccauuuucuaugcauuuucaaaaauaugcacaugcauagaaucauaugauuuauucaggaaugggagcagguaaaaggcuuacuugaagaggaucacacuuacacauuauuuggcaacucacuuuuuuugucauaaccugauaucguggaaaucuuuccaggacaguuaauccaaaauuuaugcugcccaauaaaauauaaauuaauuaaaaguaacugaaauucaaaauguauuccucauuuacaccagacucauucaagugcuccauacccacaugcagcuaucggcuacugucuuggacagcagggauuauagguuucuaucaucucagaaagguguauugggcagcgccagucuaaggaaauuaaacuuguuuuucuugacuguuacauacuauuucauagucuggguguuuucuacuuuauuuagccauuccucuucugauagcauuuaauuauuuucagcguuuugcuuuuauaaaugguggugugauaaggauuuguguaacugccuuuucacauuguuuacaaguaucuguguaagauaggcuccuaggaguggacuugcugggguuggaaugaguauacaucuuaaaaguugauggauaugccaaaccaccuucuaaagggcugcaccuguuuaucuuccuacccacagcaaaugaaaguacuggaccuauuugcucacauccuugucagcacuuguaauugaucuuuuuaguuuuacuagucuacuaaauggcaucuugcuuuaauuugcuuuuauuuaguuauuagcagguuaaauaucuauucguaugauuauuggccauuugugucuuuacugugccuuaugucauggugauuuaacauauagcaggccuagaauccuuuuuuuuuucccccuucccucccaaaagcaaauagauacacugugacaggucuuugucacagacgcccuggagaacucagccccaugacuuacucucagauaggccagccuggagccugcaucuugauuuccaccuugccuguggcacugcucacacuuucccuaaguggcacaguaaccugggaagcuaacaaagcccugcuuugagcaggcacugugcuagcuucuuuggugucauucuaggccaggcaggcuguuagagcccuagaaaaaucaucagcacugcagaugcacuugcagccccaugugcagauucucaguaacagggcuuagaaauucgccucccuguagucagguuuggcugcaggaaaauagccuuuucagucaaggcuaaaacagugaguucaaggcuuugcugaaagcagcacauaggagccuuucuacccaguguggugggaggaggcaggaaugaaacuccacccccucauuucccccaaaauuccccuccccucauuaugaaggcccaaaauuccaucaccguuggagaaggauagggacucuccagccuuuuuuauucucugcucucuguucuuuucucacaugugggggugacagaaaggcaucaggggggcaagaaaguggcugacaggggagcuuugccagggagcuauggaggaggaagaggacugcguuuaaucccuuucuuuaccuguucucaacacucagcuuggggacuucagcccuagaggucauccucuuacauacacaugcccugggcucgguaauacaccugucuguuuuaggaugcucaugcuuuggcauggagcugagaaucaaacccauuauuagcuugccagaccugaggaugugcuuuauguuggagggguugagagagagagugagaacugugagccccaccuugggacaggaggcuuuggacuucuguuguccuggcuguuggaaaguauuugcucagggaauuuuuacaugacugguccuuuauucacguagcauguaugcacugagaaccugcuaagugccaggcccuguagggauggaucaaugagcaguauugggcagguccaugaggcucaugcagugcaagaacucuuccaguugagggguagcuaggugccucgagaggagauggggugggaagccugccuuuauuuuaguccauggggugggaccaaggcuaucuuucccccauuuuaacuuaaaagucaagagaauacuacauuugauguuuaaacagccccgucaagagauggccguagucccuuaaccccaucagaccccucugcaccucuuuuagauccucuucccauucgauuuugguugucagaaugcacaugaucauauagccuagguccuuccccauuguauguagauauguauuuuuuuggaguuuauaauuuuuuuuuaauugauauauaaaaauuguacucuuauugugcuaaaaaaauuaacagcuuuaucauauauuucacaugucauaaaauuaacccuuucggcuggucaugguggcucacgccuauaaucccagcacuuugggaggccaaagcaggaggaucacuuggagccgggaguucaagaccauccugggcaacauaacaagaccccugucucuacaaaaacugaaaaagaaaaagaaaaacuagccaggcaugguggcaugcuccgguacuccuagcuacuugggaggccaaggcgagaggaucacuugagcccaggaguuugagguuacggugaccuugaucauaccacugcacuucaaccugggcaacaaagugacccuaucucaaauaaauaaguaaauaaguaaauucacccuucuaaaguauacguuucagugguuuuuaguauacucacagcaugauacagccgucaccgcaaucaauuuuauaacacuucaucaucccccaguagaaauccuguauccauuaacagucacucucauucccccagcguccccucugcccuugccaaacacuaaucuacuuucuguuucuacugauuugacuagucuggacauuucuuauaaauggaauuauguaauguguggcuuuuugugacuggcuucuuucccucacauguuuucaaggaucauccuuguuguagcaugcaucagcacuucauuccuuuuuauugccaacuaauauuccauucacuacuguauuuuuaacuaaaccucaaauaucggguucagcugacuuuuuaaaaauguuuuuuauauccuagagaugguguaaacucuaguccuugccuucccuucugucaugauuacauaggacagugccuuucaaaaaaacugugguaaaggccaggugcaguggcucacgccuguaaucccaguacuuugggaggccgaggcaggcagaucaucugaggucaggaguucaagaccagccuggccaauguggugaaaccgcgucucuacugaaaauacaagaauuagccagaugugguggugggcgccuguaauucagcuaccugguugggaggcugaggcaggagaaaugcuugaaccugggagguggagguugcagugagccgagauggcgccauuguacucuagccugggcaacaggagugaaacuccaucucaaaaaaaaaaaaaaaaaaaaaggaaaaaacugugguaaaauacguagaacauaaauuuaccaccuuuauuauuauuauuuuguugagacagggucucacucuuuugcccaggcuggagugcagugauaugaucucggcucacugcaaccucugccucccagguucaagcgauucucaugccucagccucccaaguagcugggauuacaggcgcacaccaccaugccuggcuaauuuuuguauuuauaguagagaugggguuucacauguuggccaggcuggucucaaacucuuggccucaaguguuuaccuccuuggccucccaaagugcggggauaacagacaagagccauugcacccgacucaucuugauuauuuuuaaguauacaguucagugguguuaaguacauucacauuuuugugcgcccaaucuccagaacuuucuauccuguauaacugaaacauuauacacauuaaauaguucugcauucuucccucucccccgcccccagcaaccacuguuguacuuccugucucuacgaaauugacuacucuaaguaugucauacaguauuuuagcggaauggcacaguguuuacggcagucuguuuuuaaauuagguaggcaagcuggacugcugaaagcuacucugaaauuucucccuggaucgugggcauuuuccuugucuaugcuuaccuagaaagcuaugaagcaggcuugguucuagcacuagugggguuuccagaggggaugcugccccucagggcggggggcucugucugaaaugguaggauaaguccuaagaagaaacuuguaaggagcuaagaaggcaaacccaccacuucgucuuccucaggagaaaucgcagauacagaaagaucuauggagaauugaagaugucacugcaggccugagugcaaauaaagagaacuucagaauucuaguggagucaguaaaaaauccgggugagauguucaucuuccuggaugugggggaucugauugggggcaggguggugggaggguggaaggcugggaaccaggugggugggauggcccuuggggagguugagucuucgaggugcuaaauuacuccacucauccuccaaggaagggggucuuuguuccaucccgugcuuuguuuccuucuaugccccuuagagagaaaaacggugccuuuguuuccucacccgccugugccuucacucucaacuucugagagcaagccgcccccacagcccaguccucccaccagcccugugcggaccccucuggagguucgacucuucccccagcugcaaaccuacgugccguaccgaccucacccaccccagcugaggaaagugacauccccccuucagucaccaacuaaggcgaagcccaaaguuguaaguagugauaacuaggagcugaaugccauuguuuccucucuguccucagauuaccuucuccugggagagaaacuccugggaaaacuuggggaaauggacccagccagcguccuaaaggaguccuuagucacaagcaguuaaaaaguaguauuucccugcuauugugccuuagacugucagaacuggaagagcccuggaagaugaucuaacccaacucucccauuuugcaguugggaaaacugaggcccaccaagaagaagugagcgugcugaguaggguggaguuugugaucugcagagagguguguggcuguggacgaagcuguccccaugcaaaccuuugugcaaauccgcagggggcucuccugcaguuacacagccugugggcagugaguucaguccaguggaaaaguguccuucccuucacccgccgcugagcacugggcuggguugugaggaugcuuugaucuuuaaaauaaccucgcagaguauacacagcaagagcaguauccccauuccacagagaagaaaacuaagagccuaaauuguugacauuugcucaaugucuccaugcuaacuagugaauccaaucacaucuccuggcccuucucuuuuauucugugccaucugccaucuaauugggcuuucagucccagauccggucuguggccucuguggcugacugggccagcaccuugguuugccuggcauagaaaggggccaagcucuuggcagagucugggaaugcaggagacuuuaaagaaauaggagauguggucaggucccaagagagcucacgccuccagggccaggccagccuuggcuggagaacacaaugaggcuggucccagugcagggaagccauagaagaguggaccucggaauggggcccuccagauuuuugccaacaaaggcuuggaggagacuuaccugggcauugugugugccuggaccucugaugaggucagugcacagugcuggguaaaacacaugaguucugcugcccuggucuucaccaucuaccugcuuccagccauaguccagggcccagagcuggacccaggauauggcccagcacccagccagagagucacuguggauuucagcaucuugagaucuccuucccaaucccagauccaagagguggacuggagcucuagcccuaaaacaggagagggaaaauuccaaaacaaacagcaggaaugucuggggcagauggcugccaacauagggcagaaugcugccagcugggacagggcguaggggaaaaaggcacuggcauaggagcugggacacccagauuccgggacugauucucucacuguguccucaggcaaguccgucccuucccugagccuccucauuuucccuuuuguagauggucacagaggcuccuccucagcuuggucaucuguggcucucaggcagggcuuucucagcuugggugagcaucaggaucaccaggagagguccucucuccuaggaauauauguguguuugccaguuuuaccauuuguuuuauuacuuacuuguuuuuaacacuuauaagaugggcguggugcugcuugccugucgucccagcuacugggaaggcuaaggcaggaggaucauuugagcccaggaguuugaggcugcagugaccugugauuacacaacugcacuccagccugggcaauacagcaagacccugucucaaaacaaaauaaaacccauuuauauuugugaaacaauaauauccauccugaaaaugacauaaaacaggauuauauaauuuaacaaauaacaauaaagagaccaccuguuuuauaccaacagcuagacuaagaaauagaacacugccagcaaccagaagccuguggguucuuucccaggccaagcugcuuccugucugccagaaguaaccacaaucuugacuuuuuggauaauaauccccuugccuuuuuuuuuuuuuuuaauuuuaguaccuguguugacuccuaaacacugugauuaugcugguauauaauucuauauacuauuuugugucuugcaucuuuucuucaacauuauguuugugagauuuauauacauuguugcauguggcuauaguucuuuuauuuuuauuugacuuauuuucuugaguuuaaugucuuuuuaaaaauaaauuagauaauauucucaaaagauacaaaagcaaaagauauaaaaaaguacauaauaacaugucuccuucccacccucugccuccagacauuccauucaaucaaaggcaaucaauguuuuauguuuaucuuucuggggagcuuuuuagaaauuggugauucggauaucuugucaggauuggaaacuguggauccucagagaaccagugcguaucuuaggcagauggcuuaacuuucacacaucagugaagauuguugauaaaccuuugcuuuggagugcucuuuccugaacuuuccaagagcuuggagugcccuuuccugaacucugcaaaauucuuaaaaacaaaaccaaauuagaccgagaaagagggaauuuaggagguggaaggcaugauggucguuaguccugcgaguggguguucauggcaaccaggggccggucuguugauauguagaggaaccacagcccucacagaacacuguggacagggaguuucaaggaaaauguugcauucaucacauucuagggaaugaacugcaugguaggcagugagucacucauccugaccgccuguucugucugagucaggaaggaggaaauauuuuguaaccaugcacauuucugauagaaaggccaggaggauguagacucuguccuuguucagguccccaccuugcugaaggcgccagagcucguguagggccaaugagccggcucaggcugagcacugcugaguggguagauguuacucuccagguagguggugcugugauaagcauggaagucagggcaggguuagcagccugccugcgaugugcacuccagaugagcggagggagcaguucagcacagcaccgagggcauggacccaggagaccugaguccuggguuucaggacacaguuauacagguaacacuuggaggaauagaaacuguauaccucugaggggauagaggagcagagcaugucccuucuucacugcuccgccaggggaagugugagugcuccuuggcugaggcagucauguucuguggcucugauguggccuguuccuacccuuuaaaccuccacuguggcaguaccuagcaguccucccuccagcuccgucucgcugaccacuggucugguucucuuucucagcaggaagaugaagcaccucccaggcccccacuccccgaacucuacagcccagaggaccagcccccggcugugccgccucugccaagagaggccaccaucauccggcacacaucugugcggggccucaagcggcagucagacgagaggaagcgagaccgggagcuggggcagugugugaauggggauuccagggugagcgggggacccuggggcugccacucuacauguggggagagguaaaggggugugacacuggcaggucacaucaccugggacucugcccacagguggagcugcggucguaugucagugagccugagcuggcgacccucagcggggacauggcccagcccucccuaggacuugugggcccugagagcagguaccagacgcugccaggcagagguaaggcagggcccucccuggaguuucucugggaaucccaccacacugcuuccagccuucagcuggugccucguacccuucugccugcagcucuaggccuaggagugagcagcagcugucaggggggucugggaugccaagagggaggaccuggccugucuuccucuggcccacauccugauucucuuccucuuuuguuacaucuguccccaggaacaaugauaauagcaguuacuagaaagccuggcacuguuuaagcacuuuauauagacaugauauucacaacaauccuaugaggaaaguacugucauccccauuuuagagacacagaaacuaaggcccagagaaauuaaauaacuugccaauuagcuggucauugguggaaccggaagacaaucccagugcucuggcuccagagucacugcacccuguaggccggagugcuggguggcugccaccaccuuggccaucucagaccuuccagagugccacucuaagacucagugagcccuuuccuuaaaugcuuucuugccaguugaguguccuucucacuguccuccucaccccaaguuggguugugcagggugccuaagaauggaucagggggugaaaggcauuccugccccgccagccuuucuaccugccaggcagcccagucaucugcauguaagggaagccuggggugguccacagaucugcagggacacugccccccaucagggacaaaggucaccccugggcuggcccccauccucuauuggggaccuugcuccuccaugcccuggggaggaagaagagaaauaagggugggucauugacugggugcucuugguacuccugcaagaaugugugaugagggagaagcagggacccauccaccccagcacaaacaugcuugcacuucucuuuccucacuaagggcucucaggguccacgucaaggcuccagcagucguccaccauugcucccuacgucacacuccggaggggucucaaugccgaaagcagcaaggcgaccuucccugugaguggccuugagcugucgaggaccucccugcuccuucacauggggagggagggucucccagggggacaguaacuggccaucccuucagcccuggggauggccucugggguggccucagccccuccugagcucccugucacccacuguccaccaaggagggcauccugccuuucucucuggccugucaggguggcaggagggagcucaagaagccugcacccuggguucuggccucacuggacaggccugagccuaagugucugcaucugcagaaugggugcuacucagaaagcuccugaggguugggggcaucguguugcuuagaggaaauaguucucuaaggccaagaggagcccaacuagagugugcaugugugugagagagagacaacgggaaugcagccagcaggguggcuguccucugcgugcccagcccagcuguucugugucucucuugccugccuccucuuccucagagaccuaagagugccuuggagcgccuguacucaggggaucaccagcgaggcaagaugagugcagaggagcagcuggagcgcaugaagcgacaccagaaggcccugguccgagagcgcaagaggacacugggccaaggggagaggacgggccugcccucaucucgcuaccucagccggccgcucccuggagaucuuggcucaguauguuaggaggggccaggcagcggggcagggacagggagccgagugccccucagagucccccaaacacaagcacaucacaccucccagugagagagcuguccauugaccuacaugguucagagaacaccccacggggcuguuuguccacgacccaggcuggacgaaugccuggucagagggugaccugaaccagagcuggagugaggaucaaacaggcccaggagccugaggaaauacccagucaguccucccagccgcgauggagaggggccuuugcaggcguucggaaucucggcugaauucaggaccugggaauacaggguucagagaggagaggaggaagauggugacaugauuugguuagaagcacaagcaaacugaucagccucccagaccugccagcagaugcugugugagggugauggagcacggggucacaccccugccccaagggccacuggucucccugggcuugcagugcagaggccucagggugucugggauugcuggggaggccugugcugcccccugguggcgcuuccuggcgcugcgcccuguccacagucaccuuaggucccuuuggaaacauuccauuugacuuuucccuguuguuugaaaucccauguuucccuaaaccucuagccugauuguucuuucccuaauucauugcacaagcuccuuugcuuuuaguguuaccgcucauugccucucuaauccugccugauuguguuuacagaagcuucugauuugcauugaacaugcucuaacuggccugugcuacuuauuaccgggcuuguaauagcgguucuugucuccauagccuguugaguguucccagaugugacucaccuuucugcugcccucuucaugcaggccuacugacucauaauucacuugucccaaaagccaccccacaagccugagccaaccugcugccugacgccacagucauuggcagaggucugggcauuauuaauuuauaaaaauccaugcuuuacaccuggacaguagacagggacuucagagauugcacguuugaauacauucucccaagacugagguuguucgguuuuaauuccuguaguccaaucacacaauuucuuauggaaaaccuuuuguguuucugguauuuaauaacuugaagggauagcaaaauauacuguguauucagagggccucucugcagcugcuagcucagacaccaaagggguaaggcccaggacauucauaucuuuaaaagcugcaaaccugguaaccuuuaaacuuuuaaaacaaaugucauaugggguaacacugaccuuuuauaauuugaugucucaaauguagagauuaucuaaaaaucguaacuugaauaccuuguaauuuuucucuuaaaaaagaagacuuguguaagucucugcaucaacgccaauaaacauguugcuuaauaauaauggauuggcgugguucuuccccaggauaccuuauagagucuagugaacuuuuccuguuuguggaaacaaucaggcuggguuuaaaugaggacuugucucuauuuggagcauuugugagcguguaaggaaaugaguguuuucuuugugaaucauuaaauugauuuuuucaucuuuggaacuucaguugccuaauccuuuccaacaauaguuggaaaccaucaccuaagagugauuacauugauuuggagucauugagagcuugugcaugaaugggugaaaugugcgaauauggcucuggguuugggguucuggagggacuugaggcaucaaagacaaucaggaccauuuggggcuuugagguggauggaugggagagagaagauggccugggauagauaagcaucugcuuugguuuugcucaggggaagagaggcuuugagccugcucuguucucaacaaccugcucagcggucaaaggccugugaggaugcagguccugggucaacaggaagucaccacggagcuggacagucaugguuggaucuuaucgguuagauuuucccucuugggaagcuuguuacaaaguugauacugugaaacagccuuagaaacauuccauuugauuuagcauuucaauuuuauaugauuuaguuuuuuuuucuaauuuaaagaaaacaucuaucucaaauagaugggucucauacagcaguuuuucugccucauuggcuccaagcugcuuuugcuuguaccuccccagcccuacuguaagugcgagaucccccaccuacgaauguuaucuuguugaaaauucccaauagaaagauccuugguuauucuucuugcuuagcagggccuugaagggcguguuuuuccauuaauucugagccugggacguaugucuccugaaccagcuguagagaguggaagggacaaaucccuucucuagaacucugucccaaguuguuuggaggucacccucucugggagccuucuauuucccuggggaccacugugagccugaagucaugagucuuagaccugugccccaaggguguauguuugaaaccucugggaacccagaucagagagcacuuagcagucuggaacagcccauaugaaggggacagcagcuucauucucuauugcacauacagcuuuucccuaaggggaucacagguucaucuuccaaaggaccccauggaaaaaggugaccagccgggcucuuucagcaaucaggaagcgacuacguuuaaccucuuguucuguugccaguggaagcgugagcaggacuuugaccugcaguugcuggaacgggucgugcaaggggaaaaaaaggacaaggaggagaauggcugguugaaagugcaggccaugccugucacugaguuggaccuggagccucaagacuaugacuuggacaucagcagagaggugagggcaggcacuuccuucauguccuccaggagacauggccuucaaguucccagccugauccaccuucccacugugggguaucauccugaacagggacauggcucagcuucaguguggccuaggaggauggauggauagcagcuuaaggcaaugaaaggaggccagauguuucgaugaagguucaaaacucucuguaauuuagggcaaauugcaauuuuagcuucucugugcuucaguuuccucaacagugaaguggguugugaagaggauuaaguaacugcacauguucuugggagguuuagcgaucaaagccacauaguaggcacgugagcagcaguuguuauuguuaggaaauguucccugcaacaccagggguuggcuuuucaacuggcuggugaggccaacuugggcagucugacuaggggaaaauggggggcagguuugaaaaucacaggcgaaauuuccagccaugguagaagcuaggagacagugcagaguucuggucugaauucuucuggugcccucugguggcucacaugcaucaugacagggcaggcccaggagagcaaguaacuccuggaucucuacccaucaggaaaugucucuacccaaggggagagaaagggaacucgggaugacacacucagugucuucaagacguagauugucuccuguggccuaugucgaugcuauuccuaagcucuucagggcagcgucuauggcugcuugguucaccuuuguaucccuagucccuggcacagggccuggcacacaguggguacgugguacaucuuugcugcaucuuugacuguguugaaugaaucacacagugacccauaaauguaccaaaagcauuuguacaaggacuuggccugccuggaaacugcacaagaggaaauguucucaccacaugaaggauggaucgaggcgagaccucaauaaaacuuucccccaggucugugugauaggagagugagaacugaggaggaccugugucuuccagagccuuccugcugucuuaagagguggugccaggcccauucacaagcugauuugccaaugguaucuaccugacucaguauguuagggguuccucuggucuuugggaacaaaggaacaguguguggauaagauagaugccuguacaguuguugaguuuuggggucugcuggggcucuaggaguuaacaaggcugguccccugccccaagaccuuguuccuuugccaucugaaacagccaaaggucugugcguucucagauucacaaaagaagccccaacaugcugccuuggcaggggaaguguguucuguaguguccugauugccugccagcccagggaaaaaguucuuccuuaucucuaaccuaaauuccuccugcuacaauguaaucugcuuccuuccucuaaaucuguccucauuggaguaacagagaagagcuuauuucuugccaucuccaacagagugaaagggcugcguguggguuuaaauccaugaccugauuugcccugggauuggauuaagcuuguuuuuaggagcuucaacccaccccauuuuagugugcuuuuguaauucagggaggaaaaaguuccuggagcaugcagaagcuuccuuucguguucuuaguccaagcaagguuucaccaagccgaguuugccacuagguccacgggagaugcuggugaggugaaauuuggggccauuuuccucuggccagcaguagauucagcauagcugccuccugucuagaucagaagagcuuuuuuagggacagaaagcaccaucacauccuuucauucacccaccugucaaucauccauuuauccauuauccauccauucagggagaauuaguuggagggcuacuaaguacuaagucccugcauuagacagagggagacaauggugaauggaaagugaggggguggaggggaucagagaaggauccucaaagugagguugaaaagaugagagucaagggaacaaaaggaagagcuucccagacagaacagaggccccacugugggcggggaacuggagggacugguugaucaguggcuggagaggucaucaggggucagaucacuuagggccuugacgguggcauuaaggaugaucauuuuuuauccugagagcuuguagucuaguuauuucgcccuucccuucccccagccuguaggagguuggcugguggaguggaaggaacaugagcuuuggagucggacucagguucaaaccuggauuccacaacugacuaauuuugugaucuuagcaaguuacuuagucucuguggacucugcuugcuucccauggugggaggggacagagguggggaaagcgaguccuaaacccagacaucugagccucucccucugccaccuccuggccucuccccagcuguccaaaccagagaaggugucaaucccugagcgcuacguggagcuagaucccgaagagccacccagccuugaggagcugcaggcgcgguaccgcaaagccgagaagauccgcaacauccucgcccggucaaggucagcccucgcuugcucaaguguuggcaggucacccugaccccagguggcgucucuaccaugugggcccugggccgggcuggcuggggugcguguuuugccaggucuucgucucagguaagcccuacucauuggagggggcaggcugguacaucgccagcagaucagcaagggagccugccugggucaucuggaaagaccugcaacauucguagaggcuucuuguccugggcugucacccccaauucugugucccaagugacccuagcaaguguggagaauggagccaagcguggccgugaaguggaccccguuggagaucagcuccagugauggccugccagcauucgggccugugcacccucaugcagaccagcggaucagagccaagggugccagccuuguccguagggcaccagaggcauugcccacuccccuggaugcuggccugggguccucugaagugacuuuacuguccccuaagccucaauagcuucagaaauuuaaucuuguuuguaagccucccuuucagagcuggcuuagccaucucaugucugaauuuaauaagagccuccagcuagagccgugaacuuaaggucuguggccuucccaaaggaggaacaaagcugggaccguuuggguguuuggggaaaagcauguaccuuugucuagggagaaaguaccacaguuuuugucugaucccccucaaaauguugagaaccucuaggccagggagacccuccacuccugaggcugcuacccagggcaggagggcccauggucugcuuccgacccuccuacagcaugugcaaccuacagccgaccucaggccaggaccagaacaguguggcugaccuggacuugcagcugcaggagcaggagcgcaucaucaacaucuccuacgcccuggccuccgaggccucccagcguagcaagcagguggcagguaaggccauggcccagcccccaaggccuggauccugccccacugcaccugugggcuugggcccagcauggccuguuccagagccaguggaaaaccaggugucaaggaugguaguugagggucagugguguguuccccugaccacucggcauccugucccaugagcacagcaggacuuggaagggaagguggagcaggccacacaguggaggagaccaagggggcccagaagcucagaagugucuggggaaaaaggucccaggaggaguggugcugcuaccccacuuccucugagacuaugagcuaagaacagguuuuucaaggugcugagccaaggggccaagguuucugaccucaugaagaagggggcaggaaagugguugaugcuuggauuucuugcuggggcaaggcagaagggggccccuccugccuucccuggcccccugccuucgucucuaaacuaaagccaguguucaccucaucacaguguacugugccagaaaguacaggacuuggaaagugggacuuugcaguccaauuggaaaaaaauaacaccaugggaugagaacguguguguguggguguguguguguccgugugucucaaugugugucuauguguguguguaugugugucugugugucugugugugugugacuguguguaugugugugugucuguguauaaaagggcugcucuuucucucagccaggaaggagaccgcaggcuccuccuuccacucacagcucaccugcuugugugugccuugugccuucacaauucacccaguaccauuucucccccagugcagaggccacugugugucuggguggugcuccuggccaggugugcuucuucuggggagggaacagccauagagccugaaguggugucauggccccuaccaauucuccaacccuggccaaagugucuagaaguagccaaggauguggccggcaggguccucagaugccugggccuggggagucuugucuggagaucagagcuuugcuguggccccagagggccaugagagugacuggcaacaaggggaggggccauagucuuagucaaaaccuguucucugucccccacagccugauccugcacagaguccuugaaaucuuggcuguccucugucccuucgagcacaugcugaaugggcugagagguggccggugugguguucugggauuagggaugcaggagauggcucauccagaccucuccuucucaugacccagggguucaucuuagcagcuuuugagcuucuccuggggaggguucgagcaggggcggcucccccaccauaccaugcccuccucucgccuugcuugcucuaacccugagggggucugccauccucggccuccuuauugccagcagaugagcgcucccagcccuaacaugcugcggccaguucccagggccuuucuuccucccuacucagggaugaucuuugcugcggccuuuccucacucuugaugccucucuccaucucagaaacauauccaggaacugcagccugacccauccgguuccccaccaggccccguggaucugucccucacccucaagcccaggcccuucguggugggcagcagggcccaugccaccccagccugccaaauggggcaucuggugcugcaggagcugaugaggagucuaacacaccgcuuaauuccugugugccccaucuagcacagcagcuggcccuccucccgccuaaaggcccccugucuuccaggacggugccaccuuaccccccuuuuaccaacggacuccacuacaccuuugucuaacaccuuccaaguaagagccccugucuggugugcuucugccugcuuccugcaccucccuagcgcugagccccucaccucccugcugugcugaggugauugcagugccaccugcugaugccuccuuccacuggcaaagcggccgcuggcgggacuguucugacugguaggcaggugggaaagugaugcuuuuuaggaacucaauccucaguggcucuaauacgauagggacugagcaauccacccugcugccuccaugaaaucucuagaaccggaacugugcccccauccccugcucuccucaguagggcacccugaugcccgagaaccagugcagaccacacugccagccuuggggggcuggaaaggaagaguuagaucuuggccuuucagggcuuuggccaaagaaauugaagaacuguaagauugggaaaaguccaguucuacagaugaggaaacugaggcccagugaggggcuggggcucacuccaggucacaaagaauuggugucagcgcagagacugggacugcccuuuuggucacugggcacuuuaagagggagagaaagggaagcccagggcaaugugaaauuggcccucagccaggcagaaagcucuggcaccaacccuaccaaguucuccccaugugggcaucuagugaugagaggcagugugggaugaggagggagcccugaaacaggaggcuggcaucugguccagucucaagugaguucuuggccugggccuguugcuuuugagcccagcgguucaccuggacaggggaaggucagacuaccagucugggcaguccuuacccugacaucccaucccacuaucauuuugcagggcuuuccccucuccuuccuuuacguauacuugugguuaacauuguugagugccugcugugugccaggcauugugcuaaguaucucuuucgauccacacaacaacccuaugaagauauuccccccccccuccccguuuuagagaugaaaaaacaaaagcucagaggccuugagggauaugcgcaaggaaucgcagcuuguuaagugcugggguuugaaccccuuugaugugaguucagagccuuuguuccccaucaccacucauggguucaucugggccgccccgagcagcucuagguguuuggagaaagaagugaaaggagggagagaguauuugugcugcagggagcgaagcaugauuuuuuggcaggugucuauccugggugcuccccgugccucacagcagagucagcagguccccgccagccugagcaugagaggaagaggucagccuccuugggccaggcucugaggagguguggaguagaggccccgugguugaggagccauagggaagugcucuagccacgcccauugugaaggccacauuugaggguguggcuuucuccuagagaucugagcacaguaacagcgcucagucacagagaggcaggagagagguucuguuccuccuggguuuuggugcccccauggcuguaagauuggccuauuauacucuuuggaguacugcauuucuucuuacucucaaagcauccuuguuaagaaguggguaugaccaccauguuuuuuagguuagaaaaacaaggcccacagaggccaagagcgcuacccacauugaaagaaugaagggcagggccagacugcaccuuuauuagagucuuugcccugucgggauggggacccaauuuaggggccagcaugugucuagcaguggaauaggggugcagggaggguggggcaagagccccauguguccuggaagcugagggucccccagcagcggccgcauugccagagcccccugcucugcugcucugccuguccgccuaucugccauuccaucaugugugugcagacgugccugcucccuggaugccagccucucacugucuccugugcuuuuugccagcccaggcagugacugacccgugacccagcaugcaaagaagccuggagccaggggcccaguggaaccagcuuccuccaaggagaugaccuuucugcccccaaggaaaccccuuccagcugagcagggaauccggccggaggaaggagcagcuuaccgacugcggguguucaccacaggccaggcccuaauaugcacccacuaguuuagcucagacuccucucuacauaugaauggcaaaggcacuuuugauauacacuguaaaauacacuguauuuuagaaucggaaucuauuuucuaauguuccccucaagggcugaguggcaggaagguugaggaugcaggacuuugcagcugcacguacagauucagguacuucugggugacagguguugugggggcaggaagggcggggcaagccgaggcuaguccaacuuccaaugaccucaggagaaagugagauuuaaagagguguucccaguagacuccagcaagaggcugguuggcgugcugucugggagaagaggggcccuuggcugcagagaucagcugucccugaccugaugaccagcucugugugaaacuccacgaggaucacacguggagcccaagucugugccuugccccuuggguuuggcuuaggggcaacaguguguucaagaggacuggggcccacaaccugcccccaggcuuccuccagcaaaaggcucuugucagaaagaaaaaagcaguuugcuaucuuuuuuuuuuuuugagauggaguuucacucuuguugcccaggcuggagugcaauggcacgaucucgguucacugcaaccucugccuccuggguucaagugauucuccugccucagccucccaaguagcuaggauuacaggcaugugccaccacgcccggcuaauuuuguauuuuuaguagagacggggguuucuucauguuggugagguuggucucgaacuccugaccucaggugauucauccgcuucagcaucccaaaguguugggauuacagccgugagccaccacgcccagccugcuuucauuuuuaacaguacacauugaaauacagaaaaggugagaggaagcaacuuucauuguaucguagcaauaaacuccacacugggugacaucuaccuagaaaucccuucccucuaaccaggccaugaugggaaccuuugcugccugcccuuggagaaccccggauuggcuucccugggacucaggucugguggcaggagggcagcagugugcccccaccaucccucauggccugccgccagcagggccauaauggcaggacuuugauuugacuuccagccccacaugaggaggggggcuaccaagccaggugcaguguuuguggcccuuuauuuaaguuguuuucuuauauuauucugcauauaaacaaugacguuuaaauggaaaaaacaacaacaacgaaaaccuccauuggguggagccacacuuuaaaugaaaauuucucuuugacuaugcucagaaaaaaaaauagaauuuugaauauaucuagcaguuguugucuauuuuuaacuaacuccauaugcugccaguaucgacuucaugacauuugccaaaauaaaauuuuauuuuugccuuuauaagauuuucuuggaaaaaaugaaaugaauauuuugcaagaaaaaguuaauuuaaaaauguaaugguuugcaaaaaaaaugugauguacagauuaaaauauuaaccugauacguuucc

SEQ ID NO: 15369 - RNA, 1900 nt, Homo sapiens
caucucccgaaaugcauuucagcgucgcaagagaucgucaauccagccucaucccggcaugcaucggucuuuggucagccuuguugccagagcgggaauuugaggcugacgccagcuugcgucgaaauucccuguggacgccgagaucacaaagauucgaaugcugcgcuggggguggguauggagcagguagggcuggaagaagcagccauacacagguguuugcucauucaccagugccuggcuuuguccuggcacuagaucccucagagucggcccugcgccuaauaaauuaacagauacaauagcaugugaugaggaccacacgggaagccauggcagcggcuaccgcccagccagcgcuuccauuucucauuucuaaauccuacccuaaucugucaggggagagucgcugacggugaagaaccggucuaaggaguugaaccagguccccacggaugccugccgcccuccgcacucgaauuccccugcgcagggcucuggggcgcugggcucgccggggagaaggguugggcagaggcuuacggagcuauguucccaagugagagaguuggcgggcagggaagagccuugggagcaagacugcaaaggccaagaggaugagggauaaaaugaagcauuugaauuucaugggaaaagggaaccgucaaggaagaagcuuuuuuuuuuuuuugagacggaguuucgcucuugauucgcaggcuggagugcaauggcgcgaucucggcuugccgcacccuccgccucccggcuucaagcgauucuccugccucagccuccugaauagcugggaucacaggcaugcgccaccacuuccagcuaauuuuguauuuuuaguagagacggguuuuuccauguuggucaggcuggucuuaaauucccgaccucaggugauccgcccgccucggccucccaaagugcugggauuacaggcgugagccaccgcgccuggccggaagaagcucuuuuaagacagaccuagccugggcaacauggcgaaacccccucucuauaaauacaaagaauuagccgggcgugcucgcucgugccuuugguuccagcuacgaaggaggcugagguggagaaucucuggagccgggaaggacauugcggugagccgagauagcaccacugcgcgccagccugggcaacagagcaagacucugucuuaaaaaaaaaaaaaaaaaaggaaagaaagaaaaagacugacucagugccgguacacaacaaugcguugaaagaaugggcaaaugaagcagcuucuuaaaauuuuaaaaaguaagcauagcucuaggaaggagggaggucagugaaaucaaacuccugucgacaagcuuaaaguaacuggcaagacgcugggaaacuagauacugaaacauccgcucuuaacuuuuaaccugucacuauuugaaauaaaguuaucagggauagccgggcgcgguggcucacgccuguaaucccagcacuuugggaggcugaggcgggcggaucacgagaucaagagaucgagaccauccuggcuaacacggugaaaccccgucucuacuaaaaauacaaaaaaauuagacgggcgugguggcgggcgccuguagucccagcuacucaggaggcugaggcaggagaauggcgugaacccgggaggcggagcuugcaguaagccacgaucgcaccacugcacuccagccuagguggcagagcgagacuccgucucaaaaaaaaaguaucagggauaaagagagaacccuuuauaacaacaaacgggucaguucuccaagaaaacaacaccccucccccccaaaaaagccauaaucugucacuauuugauuaauaacuuuucccaaagcauuaggaauuuuagucaaaucggguacccuauuug

SEQ ID NO: 15370 - RNA, 1430 nt, Homo sapiens
uuuuuuuuuuuuuuuuuuuucaauguucaguuuccuuuaaugacccccaucucccugaagggcaggugcaggcagcuaggugauggcaagagauguucacuugaagaucuugccgugauugaaggcuuugcccacaugcuggaaggcccccucccaggaaaaguacucucgaaccagcgucugggucuccucucugccaggauccaguuuccgccauguguaugacucguaguccaccugccaaucuggacucagcggaaaggcaagcuccuggccucggaagacccagacuccagaaauggagcugcuauuguugguuccaaaaaggaugacacuggcgaaggcauucuuccucagcuuguccagucgcuggaacauuccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuaggcugggucucugcaaacuuuuuagcaucaaacugggccaucuucucacacaguuucaguucccccaagacagcccggaacuggggcugguuaaugcaggugaggaaccagcgguugguauugcgaaaggcccggcggaaagaaggcucuagaaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacauaguaggcaauggcguugcucucaaacacacagaauccaucaucacccucaaaugcugggaccuugccggcaggaaauuugcgaagaaauucagaggugcgguugguuuggccaaaauggaagugggguggugcggagagcacgcggaucugagccccgcuguacugagcagcgaugagagccuugaaggcccuccaguuuucaggauacguguacagggucccagccgccauggugauuccgcaaagaaagg

SEQ ID NO: 15371 - RNA, 4947 nt, Homo sapiens
acuguuccauaaaggcaguguuuuuuuaauuuuaaaauucugcaucugaaaacacaguaugacagaaagcaucuauauacaccugcaguguuuuugguaugauacaguauuuaauacauccacuguuuucugcaaaaaauguugcuuugucagacagaaacaaacuccccuagacaaaaaaauacagcuaaggcacaauuuuguuguuguuguuguucugcaaaauaaaaagacagaaaaggugcaaaaaagggcagguaaugcagucauuucugagacucacauucuaccucaaggaaaagcauucagaugauuggaacuuugauuacuggucaauuucagauaguucaauaucucuuaaaauacuccuuuaaauaaauagcaaaauaucuacauauuucagcgugugccauuugaauucuuuuuuuaaaacuuuauuuacagauuuuuuuuaaaaucaacacauuacaaaauauuucuguacaguuuuaugcauauuaugaucuauaacaaaauaguuauuuuuaaaaacuauaucaccacaugucuuugaaaacaaugaaggggacgguaauaacuuagagugaggccucuaaaacaaauacccaaacaaaugcuauugacaacauaauauuuaaaaaaaaaaaaggcaaaaggacuacaaagacaauugcgcacaauuccagugaauuuccuaugaaaacccugggguugucuuuggccuccaucagcacuggagcaauggaaggguaaagaauagagucugaagguagggaaagggugauuccuuugagaacacuacccaucugcugggaauauuuagugcuaucacuuuccaggcaggaaggacgaagagauaaauggagaacgucuccugauuuacccuugaaugaaguacauauaaagucacccagucuugggggcaggggaggucugcaaagccuuuucaagcacucugccgauaauuaagccagcccauuacagcagcaguaugcucugagagagugcuucaggaguuggcugagcuuuagaugagcacccaagccuucauuuugcccauaggaaaaauauaagaacauuuuucuuaaagacgacauuuguaagcaauuccuauagcaucugccaacuacagauuggcagccccuuccuuaggaggcugccacagaagcuucacgaugcugucuucucugauguugguggagaugggagggaaaggauggauggucagcuucccaaaaauaauguuaaggccacauuucaaaaaggagaaaccuaaggcuuuuguuuuguuuuguuuuguuuuugaaggagggaugggagaagcaaguuggaggaacaugagggauggaguagaugacguuagggagggggaugacaaggugcagaacccgcuuucuggugguaucuguaggcagaggcaguuggaauauucccagccaaguggagagggaagagaggucacuuucucccugcauacgccugguaagaccagagccaaagacaacgugagggguagacacagguggcgcaagaaagcccuccuccaucuuaagaggguccuauacaguaucuuguuugcaagguaaacacaaaacaaaacaaaacaaaacaaaaaaacuucuaagagagccagagaggaagagagagaggagagagagaauuugcauagaucauacauucagcucaagcagauuuggacaacuuuguuccccccucccagguaaacuucucagcagacacaaugagguagcgccugugguagacccaugggcaaaguaagguaacugaggcagaagcaaacaggacaucccgugagccagcacagcucuaugugguuuccaaagaggcuuccagggaugggacaagauggcugugucaacacuugggauuuggagagagccuggcuguuucacacccuaccuccuccuccuccuagacugucuuugccauuucggccugguuugauggagucccacaagcuguagccccaggcagauguggaccucugcauaucuaaggggcagcaguccagaucuccagauucuauuccuucuucccuucagcacaaucuugggaccaggagagcugaaugauccauccccccucuguggaauggucucuugaggaguggaaugacuuagcaagagguccccauuccgaguucaacaugggcuguuauuuuugcccugaccugaugcuggcuuuuuuccucuucuaccagggcaaugcauaaucucacuuuaaaccaccucuccagagagcagagguugcuggcaguguacacguggaacaguggaauuuuucuuugcccacuaucuguuaaaaaaaacaaaaacaaacaaacaaacaacccgacguugaaaaaucagauuuuuuccauuaaaucuggauuuccggcuucccuuccaaauuggaagauuccacuacacugugcuuacauuuuuacaaacaaugacagguuggggcugaguagcagcugcucauucuggguaggucacgugcaugccaguaagaccacaguccccauccuugcccccaccaugcccuuuugccucacaccaaccauuucacgcaucuaugcuaguauucugggccccauaaacauuuguaaccccuaccacaguguguggcuuugauccugcaggucuagcuugcugucuuuaaaguggaguguguuaacagcuguuucuagaauguacaccucuccaccccuagauguaccccuccaccugaauguacaccucuccaccccucgauacugcugggaagcuggugcuccaaauccucagugaacuugguugugaaaggacucuuuauucacaccccacugccaguagcuacugcccugcucucugcaucuuuuuggcagaaagcuuaagguucuagccagugucuucuguguuaucugcaaacuagagaaccagagggaaacauggucuucagacacccuacuugugcccagaguagaagcaauugcagugagugagagaugggggcagguccugugguucugcucauccucucuaaacuccauuugcguuuuagaaguuaaacccacaaugagaaaugaagccggaaggacucaugaucucaccaggaaagccuuuuuuuuccccugcaaagggagaaagcagcgcgcuucucacaacacggggaccuugggaauugcucacugccuccuuggagacacacugcuuuacguguggaccgggaagugaagugggaugugggaaggcuggcugucuccugagcucaauuucugccugaaugucacucggugggugggaaacuauaaggagugccgcagccuaaagaaugcuuccuucuccacaaaccaauaccccaaggcccaccugucagccuuccugaguuuccagggaccucgucacuggcucagcucacagcugcaggcuguaauagguuuccagagaccacagcccuaugcuuuugaaaucuuccacagcccaagcuccaggcugucugaccaauggccuccaacaaauaaauaaaucauucucaggcagguuaaaaaaauuauuuucccugggaaaacauccucuuuucucaaaucaugcugggcuuuguuugggauuuuccuuaaaaaaaaaaacaaaacacaaaaacacaacaaauguaauaucugcaaccuuauucucuggucuauuaauuaauaacaucagagaagggagaggaauacccugugugacuucucagcuccccgaauuaguuguggugaggaagaaaugaagccaugggaaaaagggaaggguccccagagucagccagcucugccauuucuccacuuguuccaggauaaaaacaaaaaaaggcagacauguuagugggugcaggaggggccccaucuugaagucugcagguucacauuaugcacagggacuugccacugcugaguccccaaagccacugcaaauaacgcugcgaacacaaagcacugguggcccagcaaggagggugaaagggaagcucccaaaguggcuucggcagccccagggaaacccuggccagaggcagaggccgggggcagaaagaggauguggcacccagcgcguggccaccauagagucuguaaaagagaucauaggggcuuucugagaaaaguacccugagaucccuggaaucgcuguugagaauggcuaucucccggacucugcugccuggaucugacgacccuccuccuaagauggaucucucucaaaggagccuguuucccucuguuaaggucgcaugaaugcccauaauuagaugggccaugggaaggcaaccacggagcaagcaggaauggcccaaacucucugcagcuagcacauuccccacaaacucucugcagcuagcacauuccccacucacccuccacguuuucugccugucaccuccuugugccugugacggggggugaguagggggaggaugggaggcucaggaauuccaauacucuuggaauccgagggagagugaggcugacacucugcauaaggaaaaaaacaaggcuccaacgguccccaaggcaccccacucaaagccaguggaagaugcggguuggagcuuucuuugcgugguguucgaugccccugcuuuacucugaggaugaggaggaugggggguagacgcagagaaagagaaaccgagagagagagagacaccagggggugggaaaagaugggaaaaggggccuuuugugaauaaaggcagcuucaguuaguaagguaacauaauugacaagcugcaaaaacagcaccuacuaauuagucaucgacuaaaacauguaaauaauaaauaucuaaagugucccuucucuacguccuccauugccaacaggacacccugccuugcgaggcuugggauggggcaacacaucuggcuaggauuaggacaagucacacaaagcgaagggcagccccuucaaacccacgcuggagagaaguguca

SEQ ID NO: 15372 - RNA, 10075 nt, Homo sapiens
ggguaccuuauagacaucuaaggaccacacaggguacuucauuaaucagauucauaaauccaaucauaaauauuauauuggcuaaguuauaaagaaagugagacaugaagauuccagcuuuuuuuauuuuuuccccuuuuacacaaaacaaaguagaagaaauaauacaggauuaaaacugcaaaaguaguuaaucaguagaauauguaugcacacaaaaaauccagauaggaagacaggcuuauuuacaaugaaaguaagguaaaauuaacguaguuuucuuaugaaauaauaaaaaaaaaucaaacauaugcuacaaugggcaccacuguucacagcaauauuaaagaggagaaaacaacacuuauuuaauagggacagauauaccacaagguacaacaucagugcaauaaauucacaaaacuauauuacagcuaguuaaucaguuuaagaauuguucccgucagucacauuuuuuggcccucagaaguucauuccuaaagauuucaacuacucuaaauuucuagcuaccaagaaguuaagaaugauuauaagaagcuuuccaaggaguuaugaaaucuuuguagaccagaggccaacuaucaucaccucaagucugcucucaccaacagcccuuguauuuuucagggagaaaucucuaggaaaaaagucagacaccaguguagucacuaucucccaugucaaaccuaggggacuaaaauggucaguauuaccauaaaaugauaauuuugagguuuaccuuaaaaggcuuauucuggucucaaaaauuagauaagauuaucuucuacugaaaugaauauugacuaaacauagaagacugcuguccuuuugccagucuuagagugaaagucauagacaugagucuuaaccuacuguauacuauagcuaaugucagcugaaaaucugaaauuaaaagcaugcuagaaauccuaaaugcaaucuuuuggaagucugcuauuaaaaagccuuuaaggauuuacuaacuucgagucuaagugcaaggggacgaaagcuuaagccugucagacauuccuuuucuuggacaaaaagaucaaaguuuccuacaaauugcuaagcuuugcacaagggagaagccuacauguacuagugcauggaaucaguuucaucuuauuucauggggacucuucucccacuggaaagaaacagaaugaggaaugaaucuuaauuggucucuucaucagaagugguaaacuuggucucuauauucacgaagucagacaguuuuuuaagcagacuguggaagcagacagaaccagcuuccuguagccacagaccacuacaugguaucuaagcuaaagcaaagaugaacaauuauccagauucacuugaacuguacuaaagggcaagguucaccacuacaaaaaggaaguugucuaaaagcaagaauucaauuaacgcuggguaagaaaagucaaaacacuaaugaguuguccaugaagccaacugcuaagaacgcgcucaacuauacgcgacaugaagacacuaugcacgaagccuuacuuggcgagucugaauuucuauuaacuaagggcagagugagggagaacaaagagcuacuuccguaacauuuuaguauccagauaguacagcagaaacgguucccggggcaaugggugcugcauuaaucacacugauuaaagcagaugaaucauucguuuuucuuuucuuuuuguuugagaaguuuguuuaucucccucuuggccauuccaauguacuucaaaaugauuccauguugguuuaguccaggaagcaauaguaaggaagucacuuaaaauaaaaaaaaacccaacauuaaggaggcagcaauuaaccugcuaaagguuauuacuuuuuuuuuuuuuuuuugagacaaaguuucacuuuuguugcccaggcuggagugcaauggcgcaaucuuggcucaccgcaaccuccgccucccagguucaagcgauucuccugccucagcuacccaaguagcugggauuacaggcaugcgccacuacgccugacuaauuuuguauuuuuaguagagaugggguuucuccauguuagucaggcuggucucgaacucccaaucucaggugauccgccugcuucagccucccagagugcugggauuacgggcgugagccaccacacccagcgacaagucucacucuuuuugcccaggcuggagugcaauggcacaaucucgguucacugcaaccuccaccucccagguucaagcgauucuccugccucacccuaccaaguagaguagcugggauuacaggugccugccgccacgccuggcuaauuuuuguauuuuuaguacacaugugauuucgcaauguuggccaggcggucuccaacuccugaccucaggugaucagagguuauuacguguguauggcgguggugggugggggggguggugagugcaguggugugaucucagcucacuguaaccuccaccuccuggguucaggugauucucaugccucagccuccuagguagcugggacuacagguguguaccaccacauccaacuaauuuuuguauuuuuaguagagacaggguuucgccauguuggcuaggcuggucucaaacucccggccucaagugauccaccugccucagccucccaaagugcugggauuacaggcugagccaccgugaccagccaguuauuacauuuuaaagaaggcagguuccuacauuauuaaacucaguaaugggaggaagcaacaugaaaucaauuacuuccacugggauguauccccagaaacuucugcucucauccccucuuccaccucagaaaauaaucauugcuuauuuuuaccucuugcacauuacuuucuaccuugguuauugcauuguuuucacuuucuaugagaccauaauaaucuuuccauauucccacaguuccuuuucggugucuaaaacuuaggaaguauucagcuguuuacugacgaaguuacaguuaaauuucacuggccaggaugugccuguaguuuuuccucaaagacuuaccuaucagguaggugagaagcagguuguggacuuguugucccacccaagcaaccgcagcaagggaaacgaucauggucaugaaguacuagcaaugaaaacaagaauuuaauaucaaaacuucaugugacaccauaaauauauguaauuuuuauuugucaauuaaagaagaauguguuucaaaguucgggaaauaauuuagcuuuuauuaucacuuuucuuuaaaaauucuuagauuuaaaaaccuauuccauuggaucuacuuuauagaauuuggauacauuucuuccuagaauuacugcaauucuguauguaaauauuuuaugauauaaauuauacgaucuuuucaguuaauaacuucacggaacagccucacgacgugaagcuuacagauaagagaacagaugaacagaugcuuuccuuuuuuuuuuuuuuuuuugagacagagucucauucugucacaaaggcuggagugcaguggugcaaacagcucacugcgcaaacacagcucacugcagccucgaccuccagggcucaagugauccucagccuuccauguagcugggauuauaggcauuagccacugugcccggccuaaacagaugcuuucuaaguauaugucuuuuacuauuauuucaguaagaaaaaugaaacagaagaauuuuguuuuauuagaauaaaaaauuaaaugcaaaaauguaauuuuuaacuuuaaaaugauucagucuaauuaauacagguaaacauuuaugaauguacuuaggaauuaaccaaugaauaauuuucaaauuauagcuauuaagacaaaaaggcgaauugacucaaaucuuaaaauuuuacuguacuuaagucaaagcaaaaaaaguaccaucuuagguuuuucuuccuuuagugugaagaggcguuuccaccaacccacagcucugcgucgaguuuuuacuagauugcugcaaauuucauggaaucuuugcuguuguucagugguccuagaaaagaaauuugccuuuugcuauaaacaaaucguuacaguagacaaaaacaugacacccuguucaauuuaagagcuaucuucuaaagaaaauaaaaauaaaaacaauguuucaccauuaucuuauguaggugaaaaaauccuuccaccauuaagacaccuuuuauagcacaggaguaaguauuuacauaaacuaugugugugagagagagagugugugugugugugcgugugauaaagaaaggaucaucucuggcucugaagccacauuuauuuaaugguaguaaaagacucaugacuucuaugggccauaaagaaaucaguauaaauuugauuuugcuauuccuaaauauucuuuagauccuaguaaaugcugcacuauaccuaccagaaucccaccgaacaacuguauuugaacacuccuuaguaagauacuaacuacuggcauuuaacacauaacacccccaacugggcuucauacaucugaugacaaggcagcaauaaacagcucaaaucuaaauucuucuuuguaaauuuaucccuagggagggaaaauauaaucaacaaacaacacagcaguaaaaauccaacaagagacccuccaagaaaaccuuuuauauuuauaauguuuuucuugguucugauuuuuuuaauugccuuugcacugucuucgcuacacagcuauaauggcugcuauuauugcccugugcugagggauguguugccuucucuucucuagcccucaucucuguaaaacugcagugauagauaaaguacaaggauuucugcugagcccuggaacuucuuuucaacaaugagauguuauuucuugcccauggucaaggcuagauuguggcuaugcaaaagaguauucuuucuuccuuguaagaucaaaaaauaaacaaaaucugcucuaucaauaacugagucacaucacgaaacuaucagugguuauuucugcaaacuuuccucuaggaguuauaaauuagcagacuggaauguuaucuggcuaauaaggccaaggucagugauuuauuuccuuugcuaacucuguuauacugcacauucagaaacuugcccaaaagagccaacaacauugauucauuacugcaagugaaaaacaauuuggacaguuccuaacacuaauccauucugcuguugggggaaacaccuuuaaauauugucaauuauaucauaauuuaagcaaacuuugaauuuguucuuaaagauccauaagguacacauuuaaaauucuuauauuuacagaauuauuuugcaauuugcuauccucugagauacaaacaaccaaaggcacaaguagaauacuaaccaaauaaaauaaacagccaaggauagaauagcagcugagaagaaaauaucuauuccaacuucuauuuuggcugauuauuugaaucaaaacucaacaugcuagagaaaguuaaaauacuuuuaauaugauccuuauccacuuaacuauaucugaggaguucauaagcaaccucaugguauaaauaggccgggcacgguggcucacgccuguaaucucagcacuuugggaggccgaggcgggcggaucacaaggucaggagaucgagaccauccuggcuaacauggugaaaccccgucucuacuaaaaauaaaaaaaaaaaaaauuagccaggugugguggugggcaccuguagucccagcuacucgggaggcugaggcaagagaauggcaugaaccugggagguggagcaugcagugagccaagagcguacugcacuccagccugggcaacagagcgagccuccaucucaaaaaaaaaaaaaaaaaagagaaugguauaaauaaaaucagcaacccauguguauacagcuugaaccucuucggaaacacuugguauucacuuuguuaacugccauuccacugccucagugucucaguaucucagccuuaacacaagaucaaucuuaaaagucaaaauauuucacaguacuuuacagggccugccacaguaggcauuuaauaaauaauugcuaaaugaaugugaaugaaaaucugccaguuuccuuuucuguauucauucaaaaauaauuugugaaguuauuauacuauccuaaauaucaauggaaauguaaaaauguauaugugcauuuaccauaaaagaacuauggaguacagaaaauucauaguuuauauucaaaucaguuacaauauucuucacauaaaagcaauaaaucuaaugcuuaggugucugaugguuagacaauuaucucugcuuauuuacagcauacuaaucacagccaccaaguucaguaacuacacaaaaaugagacugccaaaucauuaugcuaccuaccauuuauuggagccaaaaauucuaggcgcuagaaugggaacaagguagucagccaagcacaaaaacauaacaaaacaggaaacgccggacagaacagauggaucuagauaguagauaauccuguuaaaaaaauuaauaaagguuagaaaaacauagucauuauuauuccuaacuaaacaugucuaacuuaacuauucacuuaacuauucaccgccucucagagauauuugccauuuuucuucuaauuuucucacaaguggcuuuccagaggcuuugugacaugcugauaucauagcugcagugguuaaguauauaucaauggacaaaagcucuuuggaguucucagcacuuuuuuaagaguuuagggaggugggggacuaggggagggauagcauuaggagaaauaccuaauguagaugaaggguugaugggugcagcaaaccaccauggcacauguauauauaccuauguaacaaaccuguacauucuacacauguuucccagaacuuaaaguauaauaacaaaaaaagaguuuaagugucuggaggacaaaaaguuugcgagucacugauuuacucaagugcuuuagguuaccaaguuuacagaaguacuacaaauucuggaaacuagaagugcuuaugagaaacauucuuuauggguucuuuauggguuauauauuacagaagacuuaaggcacucccacaaacagaagcuauauauuaaaaagucuuuauuaauaagaagcacaacccauaguaaucuaauagcucacuuacagaaacaccaaagaaaccacacccaugauggcagguggaaaccaggcucuuucccaucggaggacuuuaucagccaucagcaucacuucuccccauccuugcagcuguucuuccagacuugcagucucugcagccuaaauaccaccgacauuuaaagugaucauuuuaccacucucaacauuuuugugguucauagacuucaauuauuuuaaagcuccaaauacaaaaaauaaccucuuaaccaaauugccaauuuuaaacuaguugguuucugaaaaacugcaauuucaaagaugaaaauacaauggguuuuuuuguuuuuuguguuuuuuuuuuugagacggagucucgcucugucacccaggcuggagugcaguggggagaucucggcucacugcagccuccgccuccuggguucaagcgauucuccuaccucauacuccugaguaguugggacuauaggcgcccgccaccacgcccgacuaauuuuuuguagagacaggguuucaccauguuggccaggcuggucucaaacucuggaccucaagugauccacucaccucgucuucccaaagugcugggauuacaggugugagccaccaggcccagccuaaauauccuuuaauggucacuuuucuaguccaagcacugggcuauucuuuauauacaugauguaacuuaauccuuacagagagccacaagguagggauaauuagacucaauuuacaauuaaagaaagugagcucaaaaugguuuacuuucucaaagucaugcggggaaucguggcagugcccagaguauuaauaaaaugaaauaacuuuuuuuaaguuuguuuauuucagaugguuagaauugauccguuguuuuugucaucuuauugauuuaaacccuucuaaauccauuaggaaagacuuucccugaauagcauucaauuucuaaaauagcucuuuguguaauggaaucacucagauguugacauucauuggacaauuaaggaaaacuacuuucaccaaauuaagguggcauuuuacggucaauauaccuccucaauacaguguuucuuaccacucaggaugucauuuugauuauacuucaaauuucucugacucugaacagccgaaagugggccucuaggaugagcuaauguggcaaaagcccuuaaagcugguuuugguaaaggaagaaaaauuuagaauaagaaacucaagugucucuauguuaucaggcuggaugcaguggaucacgccuguaaacccagcacuuggcgggucgggggggauugcuugagcccaggagaucgggaccagccugggcugagaccuugucucuuuguaaaagucauucacuggaaaucaugcaaaugacagaacaaggcacuuaaucuuaacaaagacgcucgcuaucugugccacgcugagcacuagugugaucucaauauuucugacuuuauauuccaugcuuaauacuagugaaagagacuacuaugugugggcacucugcugagcauucauauuuauacuucaauuaaucuuccuaacaacccuuaaaaaaagguguuauuacuguccccauuuuaccaaggaggaaacagauacagagguuaacugaucugcauccaagaaauccacgaccaaaggcguugcuuuccuuagaguuauauugcucugcuggaaggagaguugggaagcaggagcucuagcccaggauuugucauuucaacagggcuugagcuacuucucugugcuucaauuaauccucuuaaaaagauccacgcugagaacuaacuaugcuagaaggagcguguguuuaaaggaacaaaccaugcauuucuaaaagcaaauauaaaaucacgcacaaucaaaacugcccugaagucacgucauuggccagcgucuggggucuuggaaguucaaaagccccuaaguaaauucuuugguuccguuuuucauugcugguaugugaccuacagucaccagggaagggcaacugagaauaugcaaggauauuucucuuguuuuuugcccacaaggugcgcuuaaauucauaacaaauaaaaauguguccgccuaugauaccaucucacugcaguuccuucggaucccugcuuauuacucuaaagcuguuuccaguaguccugugaccccacccccgccagacuuccaaauuccagacaaacgccaagacaucccauugucuguucagcuggaccccgcucccgguuccccacggugagcucgcagccucccugucguuuuaaguuguaccagcucuaagauaaauucugggcaguagcccuuugacccuccacccuuguccaaguuuuagggggaaaagaaggcaggcacauccagguuaagaucaaagacggggaaagccgaauacggcuggggccugagccgcgaaagcgcuggacaggccccaggaggccuucugcccccacccgcaccccaggcuagugucgcagccccucugccucccacuuccuccucgacuccuacucgcggugaugaaucacgcgcccuccucgccccgucgcgcaccguccccaggaaagguaaggguucgacacccaggagucacccaagaagcccgagggccaggcaucgucgccugcccagggagagaagggccgggcccgcggcgggugacagggacgaggccgcgguguuugagcccacggacgucuggaggccucgcucggcucccgggggacaggcagccaggacucaccagcagguuggugcugcgauuaucucccuccgccaucgucucggggaugcagucucuacaagcgcaggccaccuccccaacgaguccuccaaccgaaacccgcacaccaaccacaacccgagggaacgccccgcaggcugcuuauaugggucggccgcccuucccgacggcccccgcgacgcucgcuccucauuggacagaccgag

SEQ ID NO: 15373 - RNA, 10075 nt, Homo sapiens
cucggucuguccaaugaggagcgagcgucgcgggggccgucgggaagggcggccgacccauauaagcagccugcggggcguucccucggguugugguuggugugcggguuucgguuggaggacucguuggggagguggccugcgcuuguagagacugcauccccgagacgauggcggagggagauaaucgcagcaccaaccugcuggugaguccuggcugccugucccccgggagccgagcgaggccuccagacguccgugggcucaaacaccgcggccucgucccugucacccgccgcgggcccggcccuucucucccugggcaggcgacgaugccuggcccucgggcuucuugggugacuccugggugucgaacccuuaccuuuccuggggacggugcgcgacggggcgaggagggcgcgugauucaucaccgcgaguaggagucgaggaggaagugggaggcagaggggcugcgacacuagccuggggugcgggugggggcagaaggccuccuggggccuguccagcgcuuucgcggcucaggccccagccguauucggcuuuccccgucuuugaucuuaaccuggaugugccugccuucuuuucccccuaaaacuuggacaaggguggagggucaaagggcuacugcccagaauuuaucuuagagcugguacaacuuaaaacgacagggaggcugcgagcucaccguggggaaccgggagcgggguccagcugaacagacaaugggaugucuuggcguuugucuggaauuuggaagucuggcggggguggggucacaggacuacuggaaacagcuuuagaguaauaagcagggauccgaaggaacugcagugagaugguaucauaggcggacacauuuuuauuuguuaugaauuuaagcgcaccuugugggcaaaaaacaagagaaauauccuugcauauucucaguugcccuucccuggugacuguaggucacauaccagcaaugaaaaacggaaccaaagaauuuacuuaggggcuuuugaacuuccaagaccccagacgcuggccaaugacgugacuucagggcaguuuugauugugcgugauuuuauauuugcuuuuagaaaugcaugguuuguuccuuuaaacacacgcuccuucuagcauaguuaguucucagcguggaucuuuuuaagaggauuaauugaagcacagagaaguagcucaagcccuguugaaaugacaaauccugggcuagagcuccugcuucccaacucuccuuccagcagagcaauauaacucuaaggaaagcaacgccuuuggucguggauuucuuggaugcagaucaguuaaccucuguaucuguuuccuccuugguaaaauggggacaguaauaacaccuuuuuuuaaggguuguuaggaagauuaauugaaguauaaauaugaaugcucagcagagugcccacacauaguagucucuuucacuaguauuaagcauggaauauaaagucagaaauauugagaucacacuagugcucagcguggcacagauagcgagcgucuuuguuaagauuaagugccuuguucugucauuugcaugauuuccagugaaugacuuuuacaaagagacaaggucucagcccaggcuggucccgaucuccugggcucaagcaaucccccccgacccgccaagugcuggguuuacaggcgugauccacugcauccagccugauaacauagagacacuugaguuucuuauucuaaauuuuucuuccuuuaccaaaaccagcuuuaagggcuuuugccacauuagcucauccuagaggcccacuuucggcuguucagagucagagaaauuugaaguauaaucaaaaugacauccugagugguaagaaacacuguauugaggagguauauugaccguaaaaugccaccuuaauuuggugaaaguaguuuuccuuaauuguccaaugaaugucaacaucugagugauuccauuacacaaagagcuauuuuagaaauugaaugcuauucagggaaagucuuuccuaauggauuuagaaggguuuaaaucaauaagaugacaaaaacaacggaucaauucuaaccaucugaaauaaacaaacuuaaaaaaaguuauuucauuuuauuaauacucugggcacugccacgauuccccgcaugacuuugagaaaguaaaccauuuugagcucacuuucuuuaauuguaaauugagucuaauuaucccuaccuuguggcucucuguaaggauuaaguuacaucauguauauaaagaauagcccagugcuuggacuagaaaagugaccauuaaaggauauuuaggcugggccugguggcucacaccuguaaucccagcacuuugggaagacgaggugaguggaucacuugagguccagaguuugagaccagccuggccaacauggugaaacccugucucuacaaaaaauuagucgggcgugguggcgggcgccuauagucccaacuacucaggaguaugagguaggagaaucgcuugaacccaggaggcggaggcugcagugagccgagaucuccccacugcacuccagccugggugacagagcgagacuccgucucaaaaaaaaaaacacaaaaaacaaaaaaacccauuguauuuucaucuuugaaauugcaguuuuucagaaaccaacuaguuuaaaauuggcaauuugguuaagagguuauuuuuuguauuuggagcuuuaaaauaauugaagucuaugaaccacaaaaauguugagagugguaaaaugaucacuuuaaaugucggugguauuuaggcugcagagacugcaagucuggaagaacagcugcaaggauggggagaagugaugcugauggcugauaaaguccuccgaugggaaagagccugguuuccaccugccaucaugggugugguuucuuugguguuucuguaagugagcuauuagauuacuauggguugugcuucuuauuaauaaagacuuuuuaauauauagcuucuguuugugggagugccuuaagucuucuguaauauauaacccauaaagaacccauaaagaauguuucucauaagcacuucuaguuuccagaauuuguaguacuucuguaaacuugguaaccuaaagcacuugaguaaaucagugacucgcaaacuuuuuguccuccagacacuuaaacucuuuuuuuguuauuauacuuuaaguucugggaaacauguguagaauguacagguuuguuacauagguauauauacaugugccauggugguuugcugcacccaucaacccuucaucuacauuagguauuucuccuaaugcuaucccuccccuagucccccaccucccuaaacucuuaaaaaagugcugagaacuccaaagagcuuuuguccauugauauauacuuaaccacugcagcuaugauaucagcaugucacaaagccucuggaaagccacuugugagaaaauuagaagaaaaauggcaaauaucucugagaggcggugaauaguuaagugaauaguuaaguuagacauguuuaguuaggaauaauaaugacuauguuuuucuaaccuuuauuaauuuuuuuaacaggauuaucuacuaucuagauccaucuguucuguccggcguuuccuguuuuguuauguuuuugugcuuggcugacuaccuuguucccauucuagcgccuagaauuuuuggcuccaauaaaugguagguagcauaaugauuuggcagucucauuuuuguguaguuacugaacuugguggcugugauuaguaugcuguaaauaagcagagauaauugucuaaccaucagacaccuaagcauuagauuuauugcuuuuaugugaagaauauuguaacugauuugaauauaaacuaugaauuuucuguacuccauaguucuuuuaugguaaaugcacauauacauuuuuacauuuccauugauauuuaggauaguauaauaacuucacaaauuauuuuugaaugaauacagaaaaggaaacuggcagauuuucauucacauucauuuagcaauuauuuauuaaaugccuacuguggcaggcccuguaaaguacugugaaauauuuugacuuuuaagauugaucuuguguuaaggcugagauacugagacacugaggcaguggaauggcaguuaacaaagugaauaccaaguguuuccgaagagguucaagcuguauacacauggguugcugauuuuauuuauaccauucucuuuuuuuuuuuuuuuuuugagauggaggcucgcucuguugcccaggcuggagugcaguacgcucuuggcucacugcaugcuccaccucccagguucaugccauucucuugccucagccucccgaguagcugggacuacaggugcccaccaccacaccuggcuaauuuuuuuuuuuuuuauuuuuaguagagacgggguuucaccauguuagccaggauggucucgaucuccugaccuugugauccgcccgccucggccucccaaagugcugagauuacaggcgugagccaccgugcccggccuauuuauaccaugagguugcuuaugaacuccucagauauaguuaaguggauaaggaucauauuaaaaguauuuuaacuuucucuagcauguugaguuuugauucaaauaaucagccaaaauagaaguuggaauagauauuuucuucucagcugcuauucuauccuuggcuguuuauuuuauuugguuaguauucuacuugugccuuugguuguuuguaucucagaggauagcaaauugcaaaauaauucuguaaauauaagaauuuuaaauguguaccuuauggaucuuuaagaacaaauucaaaguuugcuuaaauuaugauauaauugacaauauuuaaagguguuucccccaacagcagaauggauuaguguuaggaacuguccaaauuguuuuucacuugcaguaaugaaucaauguuguuggcucuuuugggcaaguuucugaaugugcaguauaacagaguuagcaaaggaaauaaaucacugaccuuggccuuauuagccagauaacauuccagucugcuaauuuauaacuccuagaggaaaguuugcagaaauaaccacugauaguuucgugaugugacucaguuauugauagagcagauuuuguuuauuuuuugaucuuacaaggaagaaagaauacucuuuugcauagccacaaucuagccuugaccaugggcaagaaauaacaucucauuguugaaaagaaguuccagggcucagcagaaauccuuguacuuuaucuaucacugcaguuuuacagagaugagggcuagagaagagaaggcaacacaucccucagcacagggcaauaauagcagccauuauagcuguguagcgaagacagugcaaaggcaauuaaaaaaaucagaaccaagaaaaacauuauaaauauaaaagguuuucuuggagggucucuuguuggauuuuuacugcuguguuguuuguugauuauauuuucccucccuagggauaaauuuacaaagaagaauuuagauuugagcuguuuauugcugccuugucaucagauguaugaagcccaguuggggguguuauguguuaaaugccaguaguuaguaucuuacuaaggaguguucaaauacaguuguucggugggauucugguagguauagugcagcauuuacuaggaucuaaagaauauuuaggaauagcaaaaucaaauuuauacugauuucuuuauggcccauagaagucaugagucuuuuacuaccauuaaauaaauguggcuucagagccagagaugauccuuucuuuaucacacgcacacacacacacacucucucucucacacacauaguuuauguaaauacuuacuccugugcuauaaaaggugucuuaaugguggaaggauuuuuucaccuacauaagauaauggugaaacauuguuuuuauuuuuauuuucuuuagaagauagcucuuaaauugaacagggugucauguuuuugucuacuguaacgauuuguuuauagcaaaaggcaaauuucuuuucuaggaccacugaacaacagcaaagauuccaugaaauuugcagcaaucuaguaaaaacucgacgcagagcuguggguugguggaaacgccucuucacacuaaaggaagaaaaaccuaagaugguacuuuuuuugcuuugacuuaaguacaguaaaauuuuaagauuugagucaauucgccuuuuugucuuaauagcuauaauuugaaaauuauucauugguuaauuccuaaguacauucauaaauguuuaccuguauuaauuagacugaaucauuuuaaaguuaaaaauuacauuuuugcauuuaauuuuuuauucuaauaaaacaaaauucuucuguuucauuuuucuuacugaaauaauaguaaaagacauauacuuagaaagcaucuguuuaggccgggcacaguggcuaaugccuauaaucccagcuacauggaaggcugaggaucacuugagcccuggaggucgaggcugcagugagcuguguuugcgcagugagcuguuugcaccacugcacuccagccuuugugacagaaugagacucugucucaaaaaaaaaaaaaaaaaaggaaagcaucuguucaucuguucucuuaucuguaagcuucacgucgugaggcuguuccgugaaguuauuaacugaaaagaucguauaauuuauaucauaaaauauuuacauacagaauugcaguaauucuaggaagaaauguauccaaauucuauaaaguagauccaauggaauagguuuuuaaaucuaagaauuuuuaaagaaaagugauaauaaaagcuaaauuauuucccgaacuuugaaacacauucuucuuuaauugacaaauaaaaauuacauauauuuauggugucacaugaaguuuugauauuaaauucuuguuuucauugcuaguacuucaugaccaugaucguuucccuugcugcgguugcuugggugggacaacaaguccacaaccugcuucucaccuaccugauagguaagucuuugaggaaaaacuacaggcacauccuggccagugaaauuuaacuguaacuucgucaguaaacagcugaauacuuccuaaguuuuagacaccgaaaaggaacugugggaauauggaaagauuauuauggucucauagaaagugaaaacaaugcaauaaccaagguagaaaguaaugugcaagagguaaaaauaagcaaugauuauuuucugagguggaagaggggaugagagcagaaguuucuggggauacaucccaguggaaguaauugauuucauguugcuuccucccauuacugaguuuaauaauguaggaaccugccuucuuuaaaauguaauaacuggcuggucacgguggcucagccuguaaucccagcacuuugggaggcugaggcagguggaucacuugaggccgggaguuugagaccagccuagccaacauggcgaaacccugucucuacuaaaaauacaaaaauuaguuggauguggugguacacaccuguagucccagcuaccuaggaggcugaggcaugagaaucaccugaacccaggagguggagguuacagugagcugagaucacaccacugcacucaccaccccccccacccaccaccgccauacacacguaauaaccucugaucaccugaggucaggaguuggagaccgccuggccaacauugcgaaaucacauguguacuaaaaauacaaaaauuagccaggcguggcggcaggcaccuguaaucccagcuacucuacuugguagggugaggcaggagaaucgcuugaaccugggagguggagguugcagugaaccgagauugugccauugcacuccagccugggcaaaaagagugagacuugucgcugggugugguggcucacgcccguaaucccagcacucugggaggcugaagcaggcggaucaccugagauugggaguucgagaccagccugacuaacauggagaaaccccaucucuacuaaaaauacaaaauuagucaggcguaguggcgcaugccuguaaucccagcuacuuggguagcugaggcaggagaaucgcuugaaccugggaggcggagguugcggugagccaagauugcgccauugcacuccagccugggcaacaaaagugaaacuuugucucaaaaaaaaaaaaaaaaaguaauaaccuuuagcagguuaauugcugccuccuuaauguuggguuuuuuuuuauuuuaagugacuuccuuacuauugcuuccuggacuaaaccaacauggaaucauuuugaaguacauuggaauggccaagagggagauaaacaaacuucucaaacaaaaagaaaagaaaaacgaaugauucaucugcuuuaaucagugugauuaaugcagcacccauugccccgggaaccguuucugcuguacuaucuggauacuaaaauguuacggaaguagcucuuuguucucccucacucugcccuuaguuaauagaaauucagacucgccaaguaaggcuucgugcauagugucuucaugucgcguauaguugagcgcguucuuagcaguuggcuucauggacaacucauuaguguuuugacuuuucuuacccagcguuaauugaauucuugcuuuuagacaacuuccuuuuuguaguggugaaccuugcccuuuaguacaguucaagugaaucuggauaauuguucaucuuugcuuuagcuuagauaccauguaguggucuguggcuacaggaagcugguucugucugcuuccacagucugcuuaaaaaacugucugacuucgugaauauagagaccaaguuuaccacuucugaugaagagaccaauuaagauucauuccucauucuguuucuuuccagugggagaagaguccccaugaaauaagaugaaacugauuccaugcacuaguacauguaggcuucucccuugugcaaagcuuagcaauuuguaggaaacuuugaucuuuuuguccaagaaaaggaaugucugacaggcuuaagcuuucguccccuugcacuuagacucgaaguuaguaaauccuuaaaggcuuuuuaauagcagacuuccaaaagauugcauuuaggauuucuagcaugcuuuuaauuucagauuuucagcugacauuagcuauaguauacaguagguuaagacucaugucuaugacuuucacucuaagacuggcaaaaggacagcagucuucuauguuuagucaauauucauuucaguagaagauaaucuuaucuaauuuuugagaccagaauaagccuuuuaagguaaaccucaaaauuaucauuuuaugguaauacugaccauuuuaguccccuagguuugacaugggagauagugacuacacuggugucugacuuuuuuccuagagauuucucccugaaaaauacaagggcuguuggugagagcagacuugaggugaugauaguuggccucuggucuacaaagauuucauaacuccuuggaaagcuucuuauaaucauucuuaacuucuugguagcuagaaauuuagaguaguugaaaucuuuaggaaugaacuucugagggccaaaaaaugugacugacgggaacaauucuuaaacugauuaacuagcuguaauauaguuuugugaauuuauugcacugauguuguaccuugugguauaucugucccuauuaaauaaguguuguuuucuccucuuuaauauugcugugaacaguggugcccauuguagcauauguuugauuuuuuuuuauuauuucauaagaaaacuacguuaauuuuaccuuacuuucauuguaaauaagccugucuuccuaucuggauuuuuugugugcauacauauucuacugauuaacuacuuuugcaguuuuaauccuguauuauuucuucuacuuuguuuuguguaaaaggggaaaaaauaaaaaaagcuggaaucuucaugucucacuuucuuuauaacuuagccaauauaauauuuaugauuggauuuaugaaucugauuaaugaaguacccugugugguccuuagaugucuauaagguaccc

SEQ ID NO: 15374 - RNA, 7900 nt, Homo sapiens
guuucuacaaguuccuuuauuaauaaagcaaaauagaaaagaacaagguccccaaaugacccacaugauucaaagugcaaauuuacuccaaccugcaagagaaaacgaauggcaggucuugacugugggggccauggaaauuuggggugauuaaauugccuuugaaucauacaauuguagcagcugaaccauaucugauuaacucuuuggucucuguuauuggaacaaaaccgacgcuaugccugcagccgccagacugcaaccaaaaacacaguuuggggucagaagacauuaaaaaucacaauaaaauaggaugaauguucuaagucacgcaacugaaucaaggcaccuuuuuuuuucaaaagcaaaaaguuguuuaacaauauuccagaauaguagauacuucaaaaaccagauuacaguauauaucauuuugcugcacauuuuagucuauuuucuguauacauagucacacauucuuuacccucucccaacuuauacaugcuuuauccccccagucaugugcuauguagguauaaaaaaauaaaguuguaucuaaacaagugauuuaaaaaaaaaaaaacuaacgaaugccacgaugauaacacugaacuuguuucccucuugaaggacauuggaaauguuaccgagguucauuuuccccaccacugaaucaucuuccuccauguagacagggaugagaagucaaagucuucaucaaggucaaaagccacauguuacagaaaaagugacuuacuccauagagguuacaugagaugcucuggaagcacuuagguuaauuccuucacaguguuugcuaggaugucaauuuugguggagcugcugagucagaaaaugauagaggccggccgcgguggcucacucacaccuguaaucccugcacuuugggaggccgaggcagguagaucaccugaggucaggaguucgagaccagccuggccaacaugaugaaaccccaucucuacuaaaaaaaaaaaaaaaaaauauauauauauauauauauauauuagccaggcgugguggcaggugccuguaaucccagcuacucgggaggcuaaggcccaagaaucacuugaaccugggaggaggagauugcagugagccaagaucaucccaccgcaccccagccuguaaaacaagagcaaaacucugucucgaaaaaaaaaaaaaaagaaaagaaaaugauagaaacauucaggggugaagucugaucagaacgacgcuuuuaggccaggugugguggcucgcgccuauaaucccaacacuuugggaggccgaggugggaggauggcuugaguccaguaguucaagaccagccugggcaacauagggagacccugacucuacaaauaauuuaaaaauucgcuggguguaguggcacauaccuguggucccagcuaguugggaggccgaggcaggaggaucgcuugagcccaggaggucaaggcugcaaugagcugcaaucuugccacugcacuccagccugggcaacagacugagacccugucucaaaaaacaaaaacaaaaaccuguguucuugguaguugaaaugguaugagccuaagaagcuugcaccccaaaucuagccaccaaucaucccuguaaaggcacgagcuaggauaccacuaaccccccaaaauuaauuuaaauguaagaauaaaauacaaagaaacaaguuauucugcaauccuucugauuacucaucugcaaacuccgacagagcaaagaaguuuaccccaaaucaccaggaaggaaaugccaaaaacuggcccuaagugguuugauguaggaucugacucaaaaagagcagcuucgagaucaaguguccuccugggaacugugaguuaaguguuaucuauggcuguguuaacuuuuuuuuuuuucuucuacaauaaagcuuaacucugagagauaaagaugacuucaaauaucacgcccccaaguauauauaacacuaccauauccaaaacaaaaaauaugacuguauacauacucaggguguuaacuacguaaggcaguggucgcaaacugguggcccccaggcucaaacaaauguuuggcccacaugguguuuuggacauuuuuuuaauuacuuguuuaaaaaucaucaaguuucacuuuaaaaaaaaaaaaccugauuuccagcuuguugccccauuuuuuucugcauggcugagcaauggcccccucuuuaaaggugggcacagcuucccccccaccucccaccccuguuucuacaggcugcugaguuugcgaccccugguuggaaauagcacuaaaaacauguuuccuaacccaaaccucucucacacccucacgccauuuucacuucauuuccccuucccucucuugcuucacuuucaucuuaaguccuccuuccccaggucuuuggauuucucuugguucacucgaauucuccuuucuuucagcuucaguuucauuuugcaaaaaacaucuccgcucagcccacgaucauuccaggaaggcucccaagacuggucagugggaguuaccaaagggugucucgccacaaaaugacugagucaucuuccccagaaacauuuuccuccagcacuggcuggacaacuaauuuuuucuuuuugcuguuguuacuguggaacuucuugcaugagaauauuugcauauaugaaucuccaguaccaagcauacaccaaaaauguguacauuucagaugaaggacauaacagagcccuaauaaaauacagaauugagcuuaauuuaacugucuugggcaaccaucaugccuggcuaauaugccauauuauuuccguuguacacaguacauguuuugguuuacuaaacauugaucaaaauugaucgaaaucucuaaguuuugguuaccauguacagagaacaauugcucagcauggcauuuaaauaaaacaguaauauuuuaaaaauucacaaauacaaugcacaauuuauuuuaaaaaaauaaaauuuaaaaaccuugaggauggaugaggcuuuggguaauuaaccugaaaaacaaaacuaacaaaaaacuacaagaacaguauguuaccagauuuauacuuuaaaacacuauuaaaagaggaacucacugacacugcuagaaauauuucuaaaauucagcuuuuuaaagcuuuuuuuuuuuuuuuuugagacggagucucgcucggucacccaggcuggagugcaguggugugaucuuggcucucugcaaccuucaccucccggguucaagugauucuccugccuuagccucccgaguaucugggauuacaggcgcccgccaccacgcccagcuaauuuuuguauuuuuuaguagagacagaguuucacuauguuggcuaggcuggucuugaacuccugaccucaggugauccgcccaccucgccucccaaagugcugggauuacaggcgugagccaccacgcccagccuuaaagcuuuauaauccuuccaacccuugaugucccccacuguaguaaacaaugaguacagaggaaguugugguugaguauggaaauauauauauauauaaaauauguauacauauauauauauauaagaucuacucuuggcauuuauuuuaaaaacuaauuuuaaaaaauaccgugcaguuucuaucuuugcauaaaguuagcagacugacuucuuugcacaaugcaguaccuuaugacccaacauugaccucaaaagcuaggaaugaccuuugcggggaacuguccccaagacaaccucaaagagacagcacaacauuugcagcuguuucucuuucagcccaaggucgcaaaggauauaagaagccaaugcagcuuggaggagaaggauuccuguaaaucacucacuaugauuucccacagcaggcaaguggauccccuaaagaaagaaggcuuauagaguucccucaaaagagcucagaacuucaacaaugauucuauucacauaggcauuucugucuuccaaauuuuagcuuuaagagucugaggaaguacauguuuuuauuuagaaaacaaaaaaaucccaauuuguaacacuuggacuggcugcauuuccaaucaggcaagcagaugaggggccaugcugaacuuaaacugcaauugaggacuguuauaaauuugggagaacaaggaagaauuccaggaccggcuccucccagcugcaaaauacacccaaccuggugauacugacaccuaaagagaaaagagacagacugccgucaagggcugucucccuugcucuuuuccuaauuugucuccucugcccacgaccagggaguaacugaucuucaagcacagagcccaagauacugaacuauaagugaaauguuuugcaagaccugugcugaaucaacaggucucuuggaccacguaagacugccuggacaaggaagaaccaucaaugguuagagacccagcacaaaccacaugcuaagcagcaggcauuuccucuucauuagcucauuaagcucagaaagaaaucucuuugugaaggaguuugcuaaaaaccuuaaaacaaaaaaguuuucugucuccagccagcagccagccuuggagaaacaccuuuacaggcaaagccuaaaacacaucuuucuccaaagccaacauguuuuaugccuucaccaguguugucuugaauauguauuugguugcuacuuugguuccagacaucucuggcugguaguagguaguuuaaugaauggauguugacggacagguacauaucccagcuuguggccugcggcgauguuaguuaggcaagcaugcuggcugcuuuucaagguuguacauuuaauaauaaauauaacuggcuucccuuucagaugcaaugcuuggugcuagcaauuaccacaaaaugagugaauugaucaauauaaagugcuauuuucucuggaagcuucucuaaccaacucucgauugccuuuccaucuaugugacuuaacuuguugacaaucuugucaaacaccugugauugcaccauuuuaaaaauacauuaauauuaauuugaacaguggaaauuauguuccucuaaacauuagccccuaaaauagaacuucaauuccaguugcaaauaaagauucagauuuuucuuuuuaaagacaaucaggaacccaguaccuagcaaguaauugugucaaaaacuuuaguguuuuguuuuguuuuuuuuuaauuugggcagagagaucugugucuaaaaaccgacagaaggaacuuucccugcagcuaguucuugcuucuucuacuggacuucucuaaaagccacauccuucuacagaauccgucuacacagaacaauauuugaaccaauucuugggucuccuguuggaugucuucccaugguuugcccaggacacucuagugggugugaagaugucauauuauacuggacugugaagcgagaaggugauauuuaagccacuaaagcuuguggcagccaccaaauuuuccaaugccuucugcaaucuugcauuuaacuggcuucaccgccauucccacccccacccagugggaaaggcuuuaggagcauuuggucaggugggggugcugucaggguuuacgguucaccuucaaggaagcccugggugcgcugacuccgggguggggggcaccuggcaagguagcggggacccccguaggcccggagaagcuggggcagccuuugccacguggacagcaaccgcgcugcugcaaguucccgggcgugcccgucgaaagcggccaggaggucaacuggggcggcuucccucagugccuugggcaggggacccaccucggcagccgccccaccagggcccaggacgcaguggaagagcguauggcgucgcagcaggcagucccuaaggaacugcaccaacuccuccaaacaccuucccaggugcuccucgucccagccuugcccaggggcccccuugcgcagcagcacugccagcagcacugucuugagcacauaugaggauaggaugcguccccacuggguggcggccgcugaguccagcccacgggcccccagaucgcgcagagccuuaagcaacugcaggcacuugagguagcaggcaccuggagcugcccguuccugcagccaacucagcagcuucugcuccuggcgugcuguguucacaccccacagugccuccgcacgcaggcccucagggagcuccaacaggggcgcgcugggcaaggguggcggugguggcgccacaaggaagaccccaucucccagauggacagcggggaugagacgcacagccauagaaaggcggcagcagccguagucagugcggcagggcaagauguguaagguggggggcuguuccaggccaccuggggucaaggugacccgacagcgccccuccaggcuguaacgcacaguggccaaggagcgcugcagaugcgacuggaaccagcgcagcaccagaguagcagagaggugacgccgcccgcgcacauccacgcagaaggcaucagcaaaggguuugcagucccgaagccaguggccccccgaggcccccgauggugaggguggugccuugagggcgcacaagaagcagccgcggaaggccggggccagcgcuggcuccucgcccaggcuccguggcuccagcgccacaagcggcgggaggcgcaguggcaccagcacgucgaagcugucgggccggcggauuuuauguugcucguaggcgcugcccaccuggaugaagucuccgcggaaggccaaggccagcgcucccccaggaaugagaccgggggacccccgggcgcggccagcccgcaccagcucgcccacgauccggcucacgugcgccuugcuguggcccaacacgugcggagacaggcgcaccucaugcucguaguaacucuccagcaggaugcugaggcccggcucucggaagugucucgaggagaaggcggcgugacccuccagacggggagacccgggcaggaagcgcugccggacagcguggcgacagcgcaggaggacauagcugaggaggagcaggacggccaccuuaagcaacgggaagccgccauccacgccgucggcgggcucggcccgggcgcccccgcuuccccgcaggacaugguagaggcacaccagggcggugcacaggccggucaccaggggccagaagacgcguagauugaggguguagugcaccgacaugccgggcgcccggggcggcgguggccgagcagcccagggggcaagccccggcggcgacccaagcccagcaugcgcacagcgcccgggcagccccgcuguccccgucuccuccuccgcggcggcuucccgaacgcaggcccgagggaggccgcccuccagcucggccuccucucccagcucaaguguuccuuccagcugcggcccgcccugcgcucucgggccccgggccgcgcccugccccggcugcgcgcugaguccggcccagcggcccuccccgcccggcgcccccgcgcgccgccgucggccagcuucuggcccggccuggcucgccuccuacccugggcggcccuccuggcucucccgccgcuccucuccgcgccugacccuguuacucggaccccgggaguuuccucuuccgagggggaggcgaggccgcgccagcuagcggggaggaaaugccggagucuggagccgagcguggagcuggcgagccgggucggcccccucccgggccuccgccuuaaagcgacgcggggcggcgggagggacuucaggacgcucuuggaacuggccucccgcggcccacccccauccucccuccccgaaggcagaauugggaaggcccugauuccggggcgguagcuucguccagggagccucuggaguugcgcucccuugaaguuauacugggacguugaaaaggagaaaagggcgcacagccagacugucca

SEQ ID NO: 15375 - RNA, 7900 nt, Homo sapiens
uggacagucuggcugugcgcccuuuucuccuuuucaacgucccaguauaacuucaagggagcgcaacuccagaggcucccuggacgaagcuaccgccccggaaucagggccuucccaauucugccuucggggagggaggaugggggugggccgcgggaggccaguuccaagagcguccugaagucccucccgccgccccgcgucgcuuuaaggcggaggcccgggagggggccgacccggcucgccagcuccacgcucggcuccagacuccggcauuuccuccccgcuagcuggcgcggccucgccucccccucggaagaggaaacucccgggguccgaguaacagggucaggcgcggagaggagcggcgggagagccaggagggccgcccaggguaggaggcgagccaggccgggccagaagcuggccgacggcggcgcgcgggggcgccgggcggggagggccgcugggccggacucagcgcgcagccggggcagggcgcggcccggggcccgagagcgcagggcgggccgcagcuggaaggaacacuugagcugggagaggaggccgagcuggagggcggccucccucgggccugcguucgggaagccgccgcggaggaggagacggggacagcggggcugcccgggcgcugugcgcaugcugggcuugggucgccgccggggcuugcccccugggcugcucggccaccgccgccccgggcgcccggcaugucggugcacuacacccucaaucuacgcgucuucuggccccuggugaccggccugugcaccgcccuggugugccucuaccauguccugcggggaagcgggggcgcccgggccgagcccgccgacggcguggauggcggcuucccguugcuuaagguggccguccugcuccuccucagcuauguccuccugcgcugucgccacgcuguccggcagcgcuuccugcccgggucuccccgucuggagggucacgccgccuucuccucgagacacuuccgagagccgggccucagcauccugcuggagaguuacuacgagcaugaggugcgccugucuccgcacguguugggccacagcaaggcgcacgugagccggaucgugggcgagcuggugcgggcuggccgcgcccgggggucccccggucucauuccugggggagcgcuggccuuggccuuccgcggagacuucauccaggugggcagcgccuacgagcaacauaaaauccgccggcccgacagcuucgacgugcuggugccacugcgccucccgccgcuuguggcgcuggagccacggagccugggcgaggagccagcgcuggccccggccuuccgcggcugcuucuugugcgcccucaaggcaccacccucaccaucgggggccucggggggccacuggcuucgggacugcaaacccuuugcugaugccuucugcguggaugugcgcgggcggcgucaccucucugcuacucuggugcugcgcugguuccagucgcaucugcagcgcuccuuggccacugugcguuacagccuggaggggcgcugucgggucaccuugaccccagguggccuggaacagccccccaccuuacacaucuugcccugccgcacugacuacggcugcugccgccuuucuauggcugugcgucucauccccgcuguccaucugggagauggggucuuccuuguggcgccaccaccgccacccuugcccagcgcgccccuguuggagcucccugagggccugcgugcggaggcacuguggggugugaacacagcacgccaggagcagaagcugcugaguuggcugcaggaacgggcagcuccaggugccugcuaccucaagugccugcaguugcuuaaggcucugcgcgaucugggggcccgugggcuggacucagcggccgccacccaguggggacgcauccuauccucauaugugcucaagacagugcugcuggcagugcugcugcgcaagggggccccugggcaaggcugggacgaggagcaccugggaagguguuuggaggaguuggugcaguuccuuagggacugccugcugcgacgccauacgcucuuccacugcguccugggcccugguggggcggcugccgagguggguccccugcccaaggcacugagggaagccgccccaguugaccuccuggccgcuuucgacgggcacgcccgggaacuugcagcagcgcgguugcuguccacguggcaaaggcugccccagcuucuccgggccuacggggguccccgcuaccuugccaggugccccccaccccggagucagcgcacccagggcuuccuugaaggugaaccguaaacccugacagcacccccaccugaccaaaugcuccuaaagccuuucccacugggugggggugggaauggcggugaagccaguuaaaugcaagauugcagaaggcauuggaaaauuugguggcugccacaagcuuuaguggcuuaaauaucaccuucucgcuucacaguccaguauaauaugacaucuucacacccacuagaguguccugggcaaaccaugggaagacauccaacaggagacccaagaauugguucaaauauuguucuguguagacggauucuguagaaggauguggcuuuuagagaaguccaguagaagaagcaagaacuagcugcagggaaaguuccuucugucgguuuuuagacacagaucucucugcccaaauuaaaaaaaaacaaaacaaaacacuaaaguuuuugacacaauuacuugcuagguacuggguuccugauugucuuuaaaaagaaaaaucugaaucuuuauuugcaacuggaauugaaguucuauuuuaggggcuaauguuuagaggaacauaauuuccacuguucaaauuaauauuaauguauuuuuaaaauggugcaaucacagguguuugacaagauugucaacaaguuaagucacauagauggaaaggcaaucgagaguugguuagagaagcuuccagagaaaauagcacuuuauauugaucaauucacucauuuugugguaauugcuagcaccaagcauugcaucugaaagggaagccaguuauauuuauuauuaaauguacaaccuugaaaagcagccagcaugcuugccuaacuaacaucgccgcaggccacaagcugggauauguaccuguccgucaacauccauucauuaaacuaccuacuaccagccagagaugucuggaaccaaaguagcaaccaaauacauauucaagacaacacuggugaaggcauaaaacauguuggcuuuggagaaagauguguuuuaggcuuugccuguaaagguguuucuccaaggcuggcugcuggcuggagacagaaaacuuuuuuguuuuaagguuuuuagcaaacuccuucacaaagagauuucuuucugagcuuaaugagcuaaugaagaggaaaugccugcugcuuagcaugugguuugugcugggucucuaaccauugaugguucuuccuuguccaggcagucuuacgugguccaagagaccuguugauucagcacaggucuugcaaaacauuucacuuauaguucaguaucuugggcucugugcuugaagaucaguuacucccuggucgugggcagaggagacaaauuaggaaaagagcaagggagacagcccuugacggcagucugucucuuuucucuuuaggugucaguaucaccagguuggguguauuuugcagcugggaggagccgguccuggaauucuuccuuguucucccaaauuuauaacaguccucaauugcaguuuaaguucagcauggccccucaucugcuugccugauuggaaaugcagccaguccaaguguuacaaauugggauuuuuuuguuuucuaaauaaaaacauguacuuccucagacucuuaaagcuaaaauuuggaagacagaaaugccuaugugaauagaaucauuguugaaguucugagcucuuuugagggaacucuauaagccuucuuucuuuaggggauccacuugccugcugugggaaaucauagugagugauuuacaggaauccuucuccuccaagcugcauuggcuucuuauauccuuugcgaccuugggcugaaagagaaacagcugcaaauguugugcugucucuuugagguugucuuggggacaguuccccgcaaaggucauuccuagcuuuugaggucaauguugggucauaagguacugcauugugcaaagaagucagucugcuaacuuuaugcaaagauagaaacugcacgguauuuuuuaaaauuaguuuuuaaaauaaaugccaagaguagaucuuauauauauauauauguauacauauuuuauauauauauauauuuccauacucaaccacaacuuccucuguacucauuguuuacuacagugggggacaucaaggguuggaaggauuauaaagcuuuaaggcugggcgugguggcucacgccuguaaucccagcacuuugggaggcgaggugggcggaucaccugaggucaggaguucaagaccagccuagccaacauagugaaacucugucucuacuaaaaaauacaaaaauuagcugggcgugguggcgggcgccuguaaucccagauacucgggaggcuaaggcaggagaaucacuugaacccgggaggugaagguugcagagagccaagaucacaccacugcacuccagccugggugaccgagcgagacuccgucucaaaaaaaaaaaaaaaaagcuuuaaaaagcugaauuuuagaaauauuucuagcagugucagugaguuccucuuuuaauaguguuuuaaaguauaaaucugguaacauacuguucuuguaguuuuuuguuaguuuuguuuuucagguuaauuacccaaagccucauccauccucaagguuuuuaaauuuuauuuuuuuaaaauaaauugugcauuguauuugugaauuuuuaaaauauuacuguuuuauuuaaaugccaugcugagcaauuguucucuguacaugguaaccaaaacuuagagauuucgaucaauuuugaucaauguuuaguaaaccaaaacauguacuguguacaacggaaauaauauggcauauuagccaggcaugaugguugcccaagacaguuaaauuaagcucaauucuguauuuuauuagggcucuguuauguccuucaucugaaauguacacauuuuugguguaugcuugguacuggagauucauauaugcaaauauucucaugcaagaaguuccacaguaacaacagcaaaaagaaaaaauuaguuguccagccagugcuggaggaaaauguuucuggggaagaugacucagucauuuuguggcgagacacccuuugguaacucccacugaccagucuugggagccuuccuggaaugaucgugggcugagcggagauguuuuuugcaaaaugaaacugaagcugaaagaaaggagaauucgagugaaccaagagaaauccaaagaccuggggaaggaggacuuaagaugaaagugaagcaagagagggaaggggaaaugaagugaaaauggcgugagggugugagagagguuuggguuaggaaacauguuuuuagugcuauuuccaaccaggggucgcaaacucagcagccuguagaaacaggggugggaggugggggggaagcugugcccaccuuuaaagagggggccauugcucagccaugcagaaaaaaauggggcaacaagcuggaaaucagguuuuuuuuuuuuaaagugaaacuugaugauuuuuaaacaaguaauuaaaaaaauguccaaaacaccaugugggccaaacauuuguuugagccugggggccaccaguuugcgaccacugccuuacguaguuaacacccugaguauguauacagucauauuuuuuguuuuggauaugguaguguuauauauacuugggggcgugauauuugaagucaucuuuaucucucagaguuaagcuuuauuguagaagaaaaaaaaaaaaguuaacacagccauagauaacacuuaacucacaguucccaggaggacacuugaucucgaagcugcucuuuuugagucagauccuacaucaaaccacuuagggccaguuuuuggcauuuccuuccuggugauuugggguaaacuucuuugcucugucggaguuugcagaugaguaaucagaaggauugcagaauaacuuguuucuuuguauuuuauucuuacauuuaaauuaauuuugggggguuagugguauccuagcucgugccuuuacagggaugauugguggcuagauuuggggugcaagcuucuuaggcucauaccauuucaacuaccaagaacacagguuuuuguuuuuguuuuuugagacagggucucagucuguugcccaggcuggagugcaguggcaagauugcagcucauugcagccuugaccuccugggcucaagcgauccuccugccucggccucccaacuagcugggaccacagguaugugccacuacacccagcgaauuuuuaaauuauuuguagagucagggucucccuauguugcccaggcuggucuugaacuacuggacucaagccauccucccaccucggccucccaaaguguugggauuauaggcgcgagccaccacaccuggccuaaaagcgucguucugaucagacuucaccccugaauguuucuaucauuuucuuuucuuuuuuuuuuuuuuucgagacagaguuuugcucuuguuuuacaggcuggggugcggugggaugaucuuggcucacugcaaucuccuccucccagguucaagugauucuugggccuuagccucccgaguagcugggauuacaggcaccugccaccacgccuggcuaauauauauauauauauauauauauuuuuuuuuuuuuuuuuuaguagagaugggguuucaucauguuggccaggcuggucucgaacuccugaccucaggugaucuaccugccucggccucccaaagugcagggauuacaggugugagugagccaccgcggccggccucuaucauuuucugacucagcagcuccaccaaaauugacauccuagcaaacacugugaaggaauuaaccuaagugcuuccagagcaucucauguaaccucuauggaguaagucacuuuuucuguaacauguggcuuuugaccuugaugaagacuuugacuucucaucccugucuacauggaggaagaugauucagugguggggaaaaugaaccucgguaacauuuccaauguccuucaagagggaaacaaguucaguguuaucaucguggcauucguuaguuuuuuuuuuuuuaaaucacuuguuuagauacaacuuuauuuuuuuauaccuacauagcacaugacuggggggauaaagcauguauaaguugggagaggguaaagaaugugugacuauguauacagaaaauagacuaaaaugugcagcaaaaugauauauacuguaaucugguuuuugaaguaucuacuauucuggaauauuguuaaacaacuuuuugcuuuugaaaaaaaaaggugccuugauucaguugcgugacuuagaacauucauccuauuuuauugugauuuuuaaugucuucugaccccaaacuguguuuuugguugcagucuggcggcugcaggcauagcgucgguuuuguuccaauaacagagaccaaagaguuaaucagauaugguucagcugcuacaauuguaugauucaaaggcaauuuaaucaccccaaauuuccauggcccccacagucaagaccugccauucguuuucucuugcagguuggaguaaauuugcacuuugaaucaugugggucauuuggggaccuuguucuuuucuauuuugcuuuauuaauaaaggaacuuguagaaac

SEQ ID NO: 15376 - RNA, 788 nt, Homo sapiens
uccggagcggggagcugccccucacaagcauggcgucagcugaaaaugaagccugugcugugcggagcgucgccugccccucacaagcauggcgucugcagaaggugcugugcggccgcugcggggcggccagcugcccuucacaaacauggcggccgaggggugcggggaguggcgggguaaggaugggaagccgagcagacggccccagaacaagcggucaugugacugggaagauggccgucuuuccuugguaaggaagcagcggcgggugggcuuuggagaggggcuguccuuacuugugauggggucggccugggucugagagugugaauuccucucugucggguucugguggucgaccggccacccccaaguugucuugaccguagaaucccuggccgcuaccgcgguccagcggagcaaucugaagccagacuggcggguucuugguucucuccccgucugcugccucucugcgccuuccacgggccccuguccauucauucccuaaagaaaacuugaguuuccaggcuuccgcguccccagaaguuggcgcggguucuggggucgcuggaugaggguaaugguggacucagcuuuuaaagucuggacgagucgggagaucuggcuguuggucaguuuccucagcuccucuguucaccuggagacuugcuuuucucaucuguaaaauggccgccauucauccuauccuaggcacagcccucagacuuauuccuuggccucaaggagcugacaguauaauggggcagacgcacaguagaggg

SEQ ID NO: 15377 - RNA, 1871 nt, Homo sapiens
ggacauuuuaaaacauuuuuucaagguauauaccuuuuuuauuccauuuauauggaagcucuaugggcaaccacagugaaaacccuaugugcuucuagacccuacuaacgaugacauugacucuucauagucaaggaugcgccacaccucccuaaagacugucccacuagcugugauuaacagcuccccagggauugggggagagucccgaguuguaucauuugccauuuccauagccuauuggaagccagcagccugacaacguaacagaguugggaagaggugcgcacagucagauggagcggggcugcccuggauccccccagggagguacacaggucaacuagugcagccagcaucaggcauaacuucagaccugcaggcuggcucucuagggacaaauuggggacaucugcaauagggggaaauuguuagaaaugcaaauucagggcccuuuuccaggcagacagaaccagacacuggggguggagcccauccaucugcauuuuaacaaggccuccaggugauucugauggaucaggcugggucucuagggacaaguuggggacauuugcaauagggggaaauuguuagaaaugcaaauucagggcccuuuuccaggcagagagaaccagacacuggggguggagcccacccaucuacaguuuaacaaggccuccaggugauucugauggaugcuaguuaaaguuugagaaccacugauuacugguuuucuacccuggcugcuuguaagaaucacauggucagcuucugaaauuuauuggugccuggguuucacuccagcaauucugauguaacuacccuggggccugggcaucaguagcuagguaaagcuccuguguguugcuaagguucagccaggguugagacacagauggggcuuagaaucccuuuaaagaaacgugacuguaggacccugaagagucuagaauuccccucaacuuauuaacaucaugcuggcugccugugagucucacaguuuaagcugcuagagagagaguuggcagacaggcugggcacaguggcucacgccuauaaucccagcacucugggaggccgaggcacgugggucacuugaggucagggguucgagaccagccuggccaacauggugaaacccugucuacuaaaauuacaaaaauuagcugggcgugguggcaggcgccuguuaaucccagcuacuugggagccugaggcaggagaaucgcuugaagggaggcagagggugcagugagccaagaucguguuacugcacuccagccuggguggcagagcaagacugucucaaaaaaagaaaaagagagagagagauagcuggcagacagacagaugcuggaggcaauuaauagcuggagggaaggacuggcuucugggagaauuccccagcccuuggguuuucuuuaguuuucuucaacugccugaaggaagaauucaccugcaagcuguuguccugguauuuuacccaauuccuguccauaccuugacaaccuuguugccuacucccuacguguugaccuugcuugggaaaaagccccuuaguaucucuuuagaucaucacucagaaaucuugacagaggagagcagaaaggaaugagcuagggaccuuguucaugggggaggaccgagagguguuaucucgaguugacgggcuggaaaucaaggugugacguggagccucccaguggaauuaccuggggauuucugaacacccuacacaauuaggucaccaucucuggaggcacaacuacacuggaaaacugcuuggcguuaccaaauggaacugagucugacagugaauacaaaugauuccacucccguaucccacugcagaaacccuuccauacguguac

SEQ ID NO: 15378 - RNA, 28383 nt, Homo sapiens
cagcagcgcgggccgggccagggggcgccucgcgcggcagcgacucuggcaggcgcugcagugaagcuggacccgcaggcgggcgugcguggagcgggggccgcggccgcgccgcagagaugugacucgggccgaaggccagcuggagcgucggcgcugcggggccgcgggggucgguaagugcgagcugcgccgaugcaguggaggacgcuguggggaccccagaaacuuuucccgccguggauuugggagaauugggggguccgcuucuuguguuuuucuaagcgcccccccaacccaagccagggaguuuauugcugggggagauguggaaucugggcgaggggaaccacggugcgacgagagcagagccguagaggggugggcgggggaggggaggaucuggggaccuuuacggggggagggagacugugcccggaccagguagagauccaagucucccaggagggugugggggcgaccacaggugaagggcagcugggaggguaaaggagcccagccguguccuagugacucgucaugugugaggagcugcgggcugguccuggggccgcguugggggcugacuguggacagggcagacgcagccgggggcacaagggcuggacuuugggggugaacagccgcaccugucgcgggggcugggggucaagcccgcagccggcuugagugcgcauuacucagcaaggggagggggggacacggcggugggagauggcagagcugagaccugggcuggggacgaaugacggggagggguggggaggagggggcggcugcauacaauggcggggggggcaguggcguuucccuuccagacagggggcacuuggaccucuggaagaggcggcuaggcuggagauaaggacuagaccuguucucgguccccucuccuugggggacacaggcuuccagccccacaaggaccccacacaucccggggucccuagcgcuuaggccgaaaagggagcgcgcgggaggagcccgcacccgccuuggccccgggcagccgguugaacagccugggaaggggccaacgaccuugccccagaaaucucccccgugcagcggguucacuccuccguccuugcucugucacacccaggccuagccaguccucccuuuccgucccccguucgcuaagggggcggcuccuuggagcgcggacaaaggccccuggaguguggcgggcagcggcguccccgccuggggccccagcccacgcgccacauuggccgcccaacugcaccaggccggggggcaccugaacagagcccagaaagcccugggggaccccgcaaagacaagagaagugggggagggaucuggcacaaaaaccccggcacuucagccaaggaaccuucuuaauucagaaguuucuucgguggggacucgggcuugcggaggauccaggcuuugaguuaaacugcaugcaaaugacauguaaauagaaugcaaauuggcaucugucguuuggaagcccucccggccaguuugguaucuaagacuguggagugaacaguuugcuaucugcucccugcucuaagccuggaaaggggucagcugaguugggaagggaaggagauuccaggaggaaggagccgccauuugggggcacaggcagcaagacaggcaguuuuguuagaaagauaaacucagaaucuuuacuggauuaauauguuauuucaagaaacgugccagggacagaacugggugccuuguauaaaacggacaaaaccccugcucucccggggcuggggaagugaguggacaaacauuaaacaaacccauagcaaauggcuaugaaauccgauuggggugaggacggccaggaaaauaagauggggugauguaaaagaaggugacagggguguauguaccugagaugacuguuccgggagugacauuugaguggagcccagcuagaagaggggcccuccgcugggaggucuuggaggaagacugaaccaggaggaaggcacugugccugcaaaagcuuggaggugggaaugagcuuagaggaacugaacaaaggccauuguggcuggagcuguaggcagauuuggggguggggauaggggaaugguagggaccagccagaucaugaucuuuugggucauggaaaggaguuuaggguuuauucuguuuggaccagugaacccuuggaggguuuugagugggaggccaugggaucugauuuguagaagcuccccugacguugacaaggaaauggaaaauagccccccuuuccauucugcccauggggauagagagacgcugggagccuccaaggggcucuguccagccuugggggaccgcuuugagccuagccagccacugcaagccaacuggaggagcagcucagguuuuaaaauccacucccugcuuucauacaguuuuuauccacucuaacggagccccccggagcccacggccccguaagcacuuucucgcagagcuuccuggggguuccgcuuagucacauuuucuucucggaauuacagccugagaggaaccaaccacuguggaucgggcagccaaggaugcaauuugcauuucaaugauugcuuuuauuuacaggacuggagcugcuuugcauauucauggaucacagagcuuguguucuugcaacccuguuuacuaaccuaugaggauuuuuuaauuugagagcccucaaaugggccaguggucuagucagcauugggaaaugaagaugaugagauccuguaacucggaaaagauaucagagggugagaauugggggugugggaaagagcgggucugaagucaggaaaccuuguaacaguuuaauccugcagagcaggaaauggaccagaggcuccagcaggagugaguugggacagacuaugaugcuggggugcauggggaucuggcucugcagccccauccugagccucugccacacgugagggauucagaacagggaugcagcagaaacgccuugaggucaggagcugggagaaaugggggcuagucccaggccagccuguaaauuccagugaaccucuggccaauuuuccugacgucucugccuucauuuucgcaacaggaaaaugggaaucaugauugucuuucuuuuuugagacaguuuaacucugucgcccaggcuggagugcaguggcgcaaucucggcucacugcuaacuccgccucccgguuucaagagauccuccugccucagccucccaaguaucugggauuacaggugugcaccaccacgcccggcuuauuuuuguauuuguaauagagacaggguuucaccauguuggccaggcugguuucaaacuccuguccucaagugaucugcccaccccagccuccuaaagugcugggauuacaggcaugagccaccgcgccuggccaugauugacuuuuuaacaagcaauucacuaaaaagcuguugcuuccucugugucgggcaccaaaccugacuuuucuuuucuuguuguauuuauuuauaauagagacagucuugcuacguugcccaggcuggucuugaacucccuuccucaagcaaucuccugccucccauagugcugggauuacaggcaugagccaucacgccuggcccagacuauuuuucacguacuucucacaccagccuuguaaggcagcgcuaucauuauccccauuuuacagaugaagagaccgagguucagagagguuaaguaaugcccagugucauauagcucugucugacuccccucuucuggccugccucccacugaggccuuucagccugaugggagagugaacuguguacccguauucauguggguacugggcacugaacuauuaaauaugcacagggcucggaaauccacucccaccccaccugcucauuuugucuuucccuucuguguuccagugccuaccgccaucuuuagagaagguagguuaagaugccacugcccugcuagacacucggaggggacauggcuggggucgaggggacauggcuggggucgaggggacacaggguggagccgugcugguagcagcuggggcaaggccaguaagaauguucuagaaugguuuuguacauuucaugucuccuuucccgugagugaaagggaagaugaggaugcugguucccaagagaauggcuggugucugcucucuggguguccugggucugacuccgcaagagagaugccugguuucagggcaccccaagguccucuggccuagguucuaccuccacagcgaggcucucacuuacagcaccugcugcagguugcagaagagugugggaguccccagggccaaccaccccaagagggucuccccuucacaccaccucagggaccucuuucguugauguuugaugggggaggcuagaagccagcaguggacaaaaaccuaaaccaguaaucucauuacaacacauucuuuucuuauuuuauuuuauuuuauuuuauuuuauuuuauuuauaacagagacagagucuugcuauguugcccaggcuggucuugaacuccuggccucaagcagucucccaccucagccuuccagagugcugggauuacaggcaugagcuuggaaaccagcgguggacaaauaccuaggcgagccaccucguuacaacaccaucuccauggcaaccaccccuucuagaaaaaucaguuucagaagagcucaccaccucagacaagggagcguuugccaaucuuuuuuauuuuauuuuauuuuauuauuauuuauuuuauuuuauuauuauuauauuuugagcagggucuuuaugcugucaccuaggcuggagugaaguggcucagucacggcucacugcagcucaaacucuugggcucaagcgauccucccaccuuagccuccugaguagcuaggauuacaggcacacaccaccacaccuggcuaauuuuuguauuuuuauagagacaggguuucacuauguugcccaggcuggucuccaacuccugggcucaagcgauuugccugccuugggccucccaaagugcugggauuacaggugugagcuacggcgcuuggccuuuuuuauguauuuaauagacaccuuauauaaagugcuuaccccauuaacuaccguccuaaacccuaauuauuuuaaccgucaccgcaaccccaugggguggacacuguuagcaccuuuguuuugcagaugaggcaccuuauggcagcugcccagagucacaaggugcuagcaggugguguggggacauuaucggaaacugggagaucugauuccuaaguucacaccaagguauggccuugguguagccuccgggcaggccuuguuuuccuucucacacaaggaauccugccugccuguguucgcccucugcaggccccagcacguggagagauagagugugcuguuccuccaccugcuagcugcuucuggccccucugcagagugcgugcaugcgcgugugugugugucuguguguguggugugugugugugugugagagagagagagaugcaguauauuuaagagcaucugagugagucacauuucuaggagccuggcuggcagcaaagguaauuaguaugugagcugagucuugugcauucguucacauuuauucauuacuccuuuugagaagcgcacgccugcaucccacggguuuguugccauauauucauccugucccaaucaauccugccucgaggcugacucgaaaccucuaaucugguauuguuccuucuggggcuccuggagagcugcccagcucucgggggugggaggcaccaggugccuaauuuagcaggaugggggcuuaccugccauggggcacaguggaucgugggcauugccugccuugucuugggcugggguggggaggugaaggagcuagggcucugaguuccggcucucgcugcuauacguguccuuguguauccagccucaguacacccccacaucgccugcagcacugguggaagcacugguggcuggacccacgcccugagaaucugcauuucuaaagagcuccagggcgauguugcugcuuuugccagcccgagaaccaaacuucgauguaaaccucucagacccucaguuuccuccucuauaaaugggaaugagaacacacagccuuucgggguggugugagguuuggagaccacauuuauccauucacucggcaacuggauugugagcacugcccaagugccaggcacuggggaaauggugcagacgacaaggucccgggcaugagguagggguugggggaagaggggaauggugaggaacagaccaaaagaguaauacaaauaaaauaaucuggcccagugugguggcucacgccuguaaucccagaacuuugggaggcugaggcgggcagaucacuugaggucaggaguucaagaccagccuggccaacauggcaaaaccuccgucucugcuaaaauacaaaaauuagccaggugccugugaucucagcuaccugggaggcugaggcaggauaauggcuugagcccaggaggcagagguugcagugagccgagaucaugccacugcacucuagccugggcaacagagcgagacucugucucaaaaaaguaaaaucaaauaauugaaaauugagguacacgcuacaaagauaucacucaaaagauugacaaggacagggagaaucuacuuuggguuuuuuuguuuguuuguuuguuuguuuguuuuuaagacggagucucacucuguugcccaggcuagagugcaguggcgugaccucggcucacugcaaccuccgccuccuggguucacaucauucuccugccucagucccccaaguagcugggaucacaggcacgugccaccacgcccagcucauuuuuguauuuuuaguagaaacgggguuucaccauguuggcuagacuggucucgaacuucuguccuuaaaugaucugccugccucggccucccagagugcugggauuacaggcgugagccacugugccaggccagggagaaucuacuuugauugacuugccagucaaaggcucagcaaguggcacuucugggacucuaguguguaguaaaagcuaguguguaguaaaaagcaauaggacaauuguuugugucucgccucuccccuuuguagcugcgugaccuuggacaagccugcugucuucccugugccagguuuugucuccuguaaaauggagauaguaauaguacuuaccuuauagaauuauaauguggaucauuagguauuaauauacgcgaaguacacagagugccuagaacauagcacuguaaggguuaaccaguuauuguuguugucacuuuggcugcaauaggaaacucuggggggcauuucugaaucccccagaaauccuagaugagcugccucagugucagucugugaggcaaugugccacaccccucccccaaacauccuggacauuguccuauggaguggguggcugucaccucaugggcagccauggcaaugauaaugacccacuugagacaaguggugccaucaguugcaucugugugcuuagauauuggguacggaggacuuccuggaagaagggggccauaagaugugggaggaacauuagaacuucuuuguugguaagugacagaaacccagcucaaacuggcuuaauccaaaaaaagcaggggcugggggaguuaacuggcugccggaacugcauagacuaggcuggcuucaggcauggaugaauccagccauucaguguauuaggacugugguccaucccauagcuguuuccucugggacagcuuuacucucagacaaguucucacccuguguguucuccagcuucaggccuccauccuuguaguuuuucaaccccagcagaaagagaagaccucuuuccagugagugcuagaacaauccuagagcggauucucacgggccuggcucaggccacgugccuuuccaugaaccacucacuguggcuaaggguagcauaaaugcucugauuggccaggccuaggacagaugcccaugcugggagcucagacgcaagguagcucuccaagggaaaaucaggugcucuuuccagaaaugggagaagcggaugcugagcagcgaaaacaacagcugucccggaagagcagagcguuccacccucagggaugaaaacagaaagcaagaguguaucuauuucccaugucagagaggagucaggagcuggaaaccuggaccagggccauagaacucugcaccauuucagaagcuuggucgccaucuugguguuggcauccuccacauagguuuucuguugcgacugcauggcugagcaggaagugggaggagcuggagaaacaaaagucccaauuugcagccaggucuggaaaagagagaacccccucagggagugaauggaaacagcuucagaaggccaaguucuugcaaggagacccagggugcaggccugcugcugaggggccuggcugguuuuguggcaucuuccccaucgauucucucuuuacgugccuaaaccaggcuugcuccaccuuggcacaguugaccuguagggcuggauaauccuuucucaugggagcuguccuauuguaggauguuuggcagcauugcuggucucuaucccccugauaccaauugcaucucccucccuaguugugacaaccgaaaaugucucuagacauugccaaauguccccuuggggucaaaacugcaacugguucggaaccacuggccuacugggugaggagggguuggggaaucggugguagugaggacugcaaagcacauuccugccugucauccucccagccacccuggggcuggaugggauuagagaggcugcuugcagcauugcuugcugaaacuugcugagaagucucuuaacugagcuggccauugaugagaugucucaggggaauccauuccagggccccuccacugggucggggacuguuggcauuuuguucugacaccuccaguucuuaaauuuugaucccucgugugcuuuaguaccucgugacaagcaauugugcuaggaugauguuucuccaaagggugguagguugaaaugcgcccaguggguaugcaacauggguuacaucaacgagcgauuuuauuuuauuuuuauuuauuuauuuauugagacagagucuugcucuguugcccaggcuggagugcaguggcaagaucuuggcgcacugaaaccuccaccucccagguucaagcgauucuucugccucagccucccaaguagcugggacuauaggcacguggcaccacgcccagcuaauuuuuuuuauuuuuaguagagacaggguuucaccauacuggccaggcuggucucaaacuccuguccucaagugauccucuugccucagccucccaaagugcugggauuacaguuaugagccacugcacccagucucaaugagcaauuuaaaaaugucuggagauaaauacuugaauguguuugguuuucuuguaaguggguugauucaaaaguuaaguaaauaaccgcccaggugguguguggacaaagcauaaguagcugugguggcacgucagugaccgacguggcaggaccacgaauaagugcuggauugcaggccgaccgaugccuggggugcauccucaccccggaagguaccugagcaggaugcuggggcggaaugcuggccggaugccuucuauucugaggcugccuccucucaucaguaggcaaaggacaugagcccgacagccccaggcaccuuuuccuucaguaacaucaauaauuuaugccacuggaaagccucacagccagggcaggaucugagaugcucacaggaucucuguaacagugagguggucgauaccgcauuuacuuagggaagccccagggacguacuggagcccggggagagcagcuggucacaaccccacacguggguugagcuggggcaguaagucuggcuugagaggccaggaaacaagcauccagccagcugugcgggcuguggcuuuccuaaagaccaggcucccuucaaaagcaaggggccguuagagaaaaaaaaaaaaaaagggaaggagcugguagccgugagguaggggacaguccucacuauguuucucauucauucaguauuuacuaaacaucgugccaggugcugugugucgagcuugagucuacagccaugguucucauccaggugauuuugcucccccaggggacaucuagcacugucuagagacauuuuggguugucacaguuggaggaggggacgugcuaccgguauccaguggguagaacccagcgaugcugcuaagcauccugcaacgcacagucccccaugacagagaacaacccagcccaaaugucagucgugccaagacugaaggagccuugucugccggugaacaagagagaccaugucccugcccugccacgucuugcaauggaggaagugaggaugggaggacaggaggaagggaaggcagaaacaaaguaaacagccaaaaaaugacagacgugauuagaccagaggcugugguggagaggacuggggugugaccuuggccaagucugaguugauggcaucagagcugagcucagcacugggaggaggaguggccaggcagagggagcagaggggcaagaggagacuuggguuaggcccaucgcugaggcugcuguguggacuccagcucguauaugggcaagagagagggcagcagggagaauucugcagguuucccagggagagaggcacucuggggaauccuccagagauguucuagagagcgagcgugggaggugagggagagacgcagccuggaaccaaggaagacagcugcuuuuguguuuacuacauuugaaaugcugggauuccagcacuuugggaggccgaggcggguggaucaccugaggucaggaguucgagaccagccuggccaacauggugaaaccuagucucuacuagaaauacaaaaaaauuuagccaggcgugguggcgcacgccuguaaucccagcuacucaggaggcugaggcaggagaaucguuugaaccuggggaaucagaggcuguagugagccuccgauugcgccacugcacuccagccugggcgacagacagacuccgucucaaauaaaaacaaaaaaggaaagaaaugcugggagcccgcggagugaggucgcacccaggaguugaguugugugaccuugugcaaagguugucaccuccuggagacucuguauugucaccuguaagauggagguccuaauaggagcugucucacagggcauugugaggacuggauguguccaauuccuggcuguuagcuguuagccucgagaggcugagaccagguaaugugugccacucauucucccagugcagcacuuggccuguggcugugucuuuaaaguuucauuuuuuuccccuuauuuuucuuucuuugguuuuuuuuuuuuuuuuuggagacggagucuagcucugucgcccaagcuggaguuuaguggcacgagcucagcucacugcaaccuucgccucccagguucaagcaauucugcugccucagccucccaaguagcugggauuacaggcgcccgccaccaugcccagcuaauuuuuguauuuuuuaguagagacgguguuuuacuguguuggccaggcuggucuugaacuccugaccucgugauccgcccgccucugccucccaaacugcugggauuacaagcaugagccaccacgcccagccuuccucuuauuuuucaagaggucagauguggcacagaguauccaauucaaagaauacaaaaggguauacagagaaguuggccucccuccuacccuguccuucagccaccagugaugaugauucacgguucuucacugcacccagccaaggguacagaugggucccaaaaccuccgugccugaggaaaggagcacguuuuccuaugugugcaaaggugccgugugcgcuugcagguuugaaaugaggcgagucuucuucaagaagucaggagagggggagucuuccaaugaauucaucuuuccuuccccccaaccauuccccucuuggcuuuucuagaauguucguggcaucagagagaaagaugagagcucaccaggugcucaccuuccuccugcucuucgugaucaccucgguggccucugaaaacgccagcacaucccgaggcugugggcuggaccuccucccucaguacgugucccugugcgaccuggacgccaucuggggcauugugguggaggcgguggccggggcgggcgcccugaucacacugcuccugaugcucauccuccuggugcggcugcccuucaucaaggagaaggagaagaagagcccugugggccuccacuuucuguuccuccuggggacccugggccucuuugggcugacguuugccuucaucauccaggaggacgagaccaucugcucuguccgccgcuuccucuggggcguccucuuugcgcucugcuucuccugccugcugagccaggcauggcgcgugcggaggcuggugcggcauggcacgggccccgcgggcuggcagcuggugggccuggcgcugugccugaugcuggugcaagucaucaucgcuguggaguggcuggugcucaccgugcugcgugacacaaggccagccugcgccuacgagcccauggacuuugugauggcccucaucuacgacaugguacugcuuguggucacccuggggcuggcccucuucacucugugcggcaaguucaagagguggaagcugaacggggccuuccuccucaucacagccuuccucucugugcucaucuggguggccuggaugaccauguaccucuucggcaaugucaagcugcagcagggggaugccuggaacgaccccaccuuggccaucacgcuggcggccagcggcugggucuucgucaucuuccacgccaucccugagauccacugcacccuucugccagcccugcaggagaacacgcccaacuacuucgacacgucgcagcccaggaugcgggagacggccuucgaggaggacgugcagcugccgcgggccuauauggagaacaaggccuucuccauggaugaacacaaugcagguaaagugggcaccacccggcugggucaggccgggggaccauucaucucaaaagauacucuucuuccucuucaguggggaugggcggucccaguaccuggggcaguccuagcagaucagaacccacaaauguugacuccugggcugaaacugacccagauauggguuuggguuguuuguuugucuguuuguuugagacagauuuucgcucuugucacccaggcuggagcacaauggugcaaucucagcucacugcaaccuccgccuccuggguucaagugauucugcugucucagccucccaaguagcugggacuauaggcgugugccaccacgcccagcuaauuuuuguauuuuuaguagagaugggguuucaccauauuggccagcuuggucuugaacuccugaccucagcugauaugcccaccucggccucccaaagugcugggauuacaggagugagccaccacgcccagcaggguuuggguuuuuuguuuuuuguuuuuuucuuucuuucuuuuuuuuuuuuuuuuuuugagacagggucuuguucuguugcccaggcugagugcaacagugugaucauagcucacugcagccucgaacuccuggcuaaagcaauccucccaacucagccuccugaguagcuggaacugcaugcauacgccaccauguccagcuacuuuuuuuauucuuuuuagagacagggucucauuauguggcccaggcaggucucaaacuccggggcucaaaugauccucccgccucagccucccaaaacucuggcaugagccacuaugcucagccucagauauggauuuuuauuaagcuuuuuuuuuuucccuaccaauugccagccaauuuauuuuaaaaauacagguuucuggcuucuuuugcaaagucaaaucuggcaacacuggaccaacauuuccaccaggcugcaauggucugaaacugacuugagcccaugugcacuggaagggcccugccucuggccccuccuggacuuguggcugcccuuuagaugggaauccacuuuucuguucaccgcacucucuaccgcucucuauugcaccugacccagcugcuauauaggauaguaacauuaauucccuggcucccccaaagcauuugagucuucaacccaugugcuggauggauguagggggccacagcggggauugcucccauccccucuccuagcucaguuaccgggaauguacuaauuugggcccuggaggcagaugucugcguucaaauuuugccucugccacuuccuagauguguggcuuugaggaaauuauauuacuuucgugagccucaguuuuucucaucugugaacuagaaauaguaagagacuguaccucauagagcuguuaggagaaggaacacagugaguacaaagcccucuugguaccugguauguucucugugcaucugacuuggcuuccacugaaagaagaaucugagacacaagggcuccagugcaggugguuucguggggaaguggucccugcaagggagaggacagggagaaugagacugagaaggcagagaagauaaaacaagcacauuaaugagcuaguuacuaccacgggcaacaggggcucauuugugcugggaauccucugaggacauaugcugaaugagccucagaauugguccaggaagaaaaggaggcuggggcaucuguccacaggcucccaucucccaguguuauuugguuuugguuuugguuuuuuauggauugagucucgcucuguugcccaggcuagagugcaguggcacaaucacaguucacugcagccuugaccuccugggcccaagcaguccucccaccucagccucccgaguagcugggaccacaggcacacaccaccacacccaguuaacuuauuuuuuauuuuugauagacauggggucucacucuguugccuaggguggucucgaauuccugagcccaagugauccccccaccucagcuucccaaagugcugcgauuacaggcaugagccauagcacugggccccccaguguuauuaacauccccuauaauucuggugacugggguggauaaguaucaucaguuccaaggcagaaaaacagacuugcugagcgcuugagauggauguuaucuggguacccaggacuaucugcuacugcugcagggggcuucagaagugagguccuaucuaggggauguggcauaggaacccaauaggaccuaccuaggggaugugauacaggaacccaaauccccugcuauugauacuugaaaaguaucucguagaaucauuacuugaagggagucagccagggucccagcacuugagauuaaauaaacuugcccuuucucgguucuuugaagaugcaucaggggcuacaacauuaauaauaauaauaacuaguauugucaucauuuguugagcacuaacuaugugucagacacuauugugaaucugucuuuuuuuuuuuuuuuuuuuugaggcagagucucacucugucacccaggcuggacuggagugcaguggcucuaucucagcucacugcagccuccaccucccagcuucaagugauucuccugccucagccucccgaguagcugggauuacaggugcaugccaucacgccuggcuaauuuuuguauuuuuaguagagacaggguuucaccauguugcccaggcuggucucgaacuccugaccucaugugauccgccugccuuggccucccaaagugcugggauuacagacaugagccacugcgcccggccacuauuauaaauauuugaccugcauuagcucauuaguccucacuaccaccuaaugagguaaaucuuguuauuauccccaucuuaugggugaauaaauggaggcucugagaauuaaaugacuuguccgaggacuucagauugucaugauucccucuucagugacauucacccaggaggcuggugcaugggccaugcucagcagcugcuuauccuauccaaggccauccacaucccucugucccgcguggaugggcccccucccccuggccagaucucuaggagggaacgccaguggccucuccgcuagauagggcuggaaaucccaguguggcuuuaucagcugcucucuucuuaccaggaagcuccagguuggcaagcccguguuuguugagauuuggcagggauggcagagucagcccagcuuggaggcuggcucccugggaugccagaagauagggaucaggacagagaucagcacugggaacccagaggacgggcccuucagggaaugucgugagcagagaucgggagcuggucaguuccuggguuccugguugggccaucucucugcuggcccaaacucccucuggaacucaaaaauagcaagaauuccugaaacggauacaaacuuuuauacauucauguuuucuuuuuucuuucuuuuuuuuuucuugagauggaguuucacucuuguugcccaggcuggagugcaauggcaugaucucagcucaccacaaccuccgccuccagguucaagcaauucuccugccccugccuccuggguagcugggauuauagccgugugccaccacaccuggcuaauuuuguauuuuuaguagagaugggguuucuccauguuggucaggcuggucucaaacuccugaccucaggugauccacccgccucggccucccaaaguguugggauuacaggcaugagccaccgcacccagcccccuuuuucguuuuguuuuguuuuucuagauggagucucacucugucacccgagcuggagugcaaugguguggucucagcucacugcaaccuccaccucccggguucaagcgauucuccugccucagccuccugaguagcaggacuacuugagacggacacuugagaugugcgugccaucacacccggcuaauuuuuguauuuuuaguagagaugggcuuucacuauguuggccaggcuggucucaaacuccugaccucacgaucugccugcuucagccucccaaagugcugggauuacaggcgugagccaccacgcccggccuuggagccucuuuuauaaggacacgaaucucacucacgaagccuccacccugauggccuaaucaccucccaaaggcucuaccaucuaauaucaucacacuggagacgagguuuuaacauauguuucucuagggaauuguucuauggcuuugucagauucucaaagccacccaugacccccaaaaggugaagaaccaguguguuguugaacaugaugauuccguuucuugaaguaaaaccacgaugccagagcuacccaaguaucauggccuuuacaguguaagauaacuaaccucuguugggggcuuccugggggcccgguaucauucugagcauuuuaguggcugaucucuuuuaaucucuacaauaacugcaugaguucugauuugcagauaggaaacugaggcacagagaggcuaagcaguuugcccaagaggcagagccggaauuugaacccaggcagaggaagaguuuaaauccaggcagagccaagaguuugaacccaggcgggauagcuccagagcccgcaugccugaccccugugucauggaauuacccuccucuccauaaagcgcuuaagcgccccucaucucacugaggugucaggaccacucugugcauuuggaaagaugaggacuauaagacccguuuuacagaguggaaaacugagcccggggaugucaggcaacuuguucaagcauaggcuauaaauacacggcagagcaggaagggaaaaaguugguuuccugaauuccacuacugacauccuuucuuguaaaaaugcagccaagacuuuauagccagauaagauccagagaugcaagggcucugggacccagguuggugucagcagagcuggggcuggcgcggggaugaugaagaguccagacuuaucaauaaggugcggcacaccuuauguguuucacaucuguuucauagugacacauuccgaagccaaggaaguugucuuucuauuccccucuuucuuuuccaaagcaaaaauauuuauuacuccuucuugguggcaaauaagcaacaauaaucauauagaaucaguggaaucauguagguucaacaaguaaaaauaauagccaggugcgcuggcucacgccucuguaaucccagcacuuugggaggccgaggcgggcagauugcuugagcucaaaaguuggagaccaaccugggcaacguggcgacaccccugucucuacuaaaaauacaaaaaauaauaaaauaauaauaaauagcugggcaugguggugcaugccuguagucccagguacucgcucgggaggcugaggugggagaaucgcuugaaccggggaggcagagguuacagugagcugagaucgcgucacugcaucccagccugggugacaaagggagaccuuaucucaaaugaaaaauaaaauaaaacaauaauaaacaaaaauuucuuaaaaucccuuugcccaggggcaacgguuugcuuccacacucacacacaauggggcagagugcgucuuaaccaggcuacacauuacaaugacuuggggcugcuuuaaaaaauuaccagugcuuggccgggcacagucccagcacuuugggaggccgaggcaggcggaucacaaggucaggaguuugagaccagccuggccaauaugguaaaaccccgucucuacuagaaguacaaaaaaauuagccgggcgugguggcgcaugccuguaaucccagcuucucggaaggcugaggcagaauugccugaacccgggaagcggagguugcagugagcugagaucacgccaccgcacuccagccugggcgacagagugggacuccgucucaaaaaaaaacaacaaaaaacaaaaacagugcuugcucaacugugauuaagucugaguuugguauuagguauuuuuuaagcucuccaagugauucucagauguaaccagguugaaaccgcuggucuaagugacguucuucagcgugcuugcuuuaaaucaauguuacagagguaacugcagagcuacagucuccuuuuuuuaaucuucagcuggugaauauucugccugcuucugacucucaacgauaaacagugcugcaaugaacauucuuaugcauucaucuucaggcuuuugaucaauucacuccuugcaaaaaaauuuuucuaaauguggguuaaagagccugcacuucaaaucuugauacaguaaaguccucacuugacauuauuagcagguucuuguaaacugcgacuuuaagugaaaugauguauaauaaagccaguuuuuuccucaucaauuucaguagcaaaacaaugacacuauuugaggaucucuuguauguuccuucacuuaaagucagaguuuucaagaaccuuuugauggcaucaagugaggaauuacuguacauauggccagauggcaccccagaaagguagaccaguggacuguccuuccccuugauaaacgcaucgaagccccaucucuccaccucuucagcaaccuuggguguugucagaccuuuuuaaaaauagacuucuuuugaaucaucccaaauguguguccaccaaaauucacaugaagcugggugcaguggcucacaacuguaucccagcucuuugggaggcugaggcaggaggauuacuugagcucaggaauuuugagaccagccugaguagcauagggagacccugucucuacaaaaaaaaaaacuaaaaauaagccaggcaugguggcgugugccuguagucccugcuacuugggaggcugaggugagagagugacuugagcuacggaggucgaggcugcaaugagccguauucacaccacuguaccccagccugagacagagacccugacaaaaaaaaaaaaaaaaaaaugagaccgggcaaagcucccacagaaaggcuaaguuggaguccuggcuagauggccuuuguucuagaaacccuugcuuugcuggcuggggacuaucuggcaugcucccuugccacaggaggagcagccguuggcaucuuuggugcugaccucagccagcuuguauuuuaggaaccaggccccaugaggcagaggccuuauccuugagcccuugggucucacagaaucgccggugcccaggagcuaugguuggcccaguuucucuugcauuuuagccuuuugggcucucuuccuuugagaguccauccuugacaugcucaugcggugggaagggcauucuccaggcuggccuguggcuuugccaagccccagaagccuccacacccuauauccuuccacugagugagaccucagauagauacaacuucacccaccugcugcuuauuaguaaguaucaacaaggcauaagguaugugauaaaagauuaaaauacacugagagauguagcaccucgaaucacaucuuggaaagcauuaacaaggcacaugaaauguuggcuuucaacagagcaagaaagaaaaguguucuuuccucuauuaggggcuuugggcugucagaucucauuagggccaaggccuauuuaaaacaacuuuuugcuucuugcuagaaggccccgaguuggcuuugggggcaaggccagccuggcaucacaugcagggucuaugcaagaaaaggcuggcauccagccauuugagcuuugauuccuaaggggaccucuugucuuaggagagguccuaagcaaggugggugagccuggcuugccuuugucucuggcccagguguggguaggguguuaguugggcuucuugaaguaaguugcaaguaauaaaaaauccaaugugaguaggcuaaagcagcuguccccaaacuuuuuggcaccacggacaaucuuuccauggaucaagguugcggggggguuggggggcgguuucaggaugaaacuguuccaccuuagauugucaagcauuagauucucauaagaagcgugcaaccuagaucccucacauccacaauucacaguaggguuugagguccuauaagaaucgaaugccagcugggcacagugacucaugccuguaaucccagcacuuugggaggccgagguggguggaucacuuggucaggaguuugacaccagcuuggccaacauggugaaacccugucucuacuaaaaacacaaaaauuagcugggcaugguggcacgugcuugugguccuagcuacuuuacucaggaggcugaggcaggagaaucgcuggaaucuggcagguggagguugcagugagccgagauugcaccacugcacuccagccugggcgacagagcgagacucuugucucaaaaaaaaaaaaaaaaaaaaaaagaacacagauuccuugccugggucccaaugcugacugugccccuuaccagcugugugaccuugggccccaagcaaagugccccaagcaaaguggacauaaugaaaguacauauagucagccugggcaacaaagugagaccccgucucuaaaaaaaaauauuaaaaaauuagccacgcaugguggcaugugucuguagucccagcuacucuggagguugaggcaggaggaccacuugagccugggaguucaaggcugcagugagcuaugaucgugccacugcauucuagccuggacaacagcaauaacuugucaaaaaaaaaaaaaguagcuaucgugcgaugaaaauuaaaugaguugaaaagaaagaaagaaaauuaaaugaguuaaugguuaauauauauaaaguacuuugcacagugccuggcuccugguuggcgcucugugaagcuuaacuguauaacuaaggugauuuuggucccugccccaaguaauuugcaaaacaaacaaacaaaagcaaaaacaagcucucuuguugcuuuuuagccagaaaaguggcucccuucagggaagacuuuuugugugugagacacaauuucaccaggcuggagugcaguggugcaaucuuggcucacugcaaccuuaaccucccggguucaagcgauucuugugcugcagccucccgaguagcugggauuacaggugugcaccaccauacccggcuaauuuuuguauuauuaguagaggggguuuugccauguuggccaggcuggucucgaacuccugaccucaagugauccacccgccuuggccucccaaaaugcuaggauuagggauuacaggcuugagccacugcgcccggcuucuacccuuuuuuuuuguuuguuagauuccuccaugucuuuucauguuagcuuuucuuuaacaaaaaggaaguucaaaucucuaaaaguucaguaaauaagaaacaccgguuuuacccaucuuucagagggaaaaagugccgacaugccaucuuggcuuuaggucucccuuuuauucuuguuuggaauaacccuacacaugugguuagagucccccuguucucaucccuggucacuuuccagugaagacucuuagcagcuuccuccucaguguguguccagaaacagcaagcaguuuugaguagugugaugcugaacuuuacaugaauggcuuucuguagugagaaggcgccugucacccgcggccugcagaggcugcguggcuuggagggggaaccagaggcccaaccaugggccuccuuccccuggucucuacagcagcuuuucccaaacccacugagaugggucaggcuccuagagagccugagaacaaagccccuuugugacuuuuguuuugaaucaggcuugugacaaaggggaggagccacuggguuggguggaugggggugcccggagcgcgcuguuguugcaggggaagaaaacaaaauugugucuuuuuuuuggcaauguugucuugccaaucccucccucccccagcucuccgaacagcaggauuucccaacggcagcuugggaaaaagacccaguggcagcuuggggaaaagacccagcgcuccguuuagaagcaacguguaucagccaacugagauggccgucgugcucaacggugggaccguaaguaucaagaugugauguggggguaggaagccuaggagucuacggugucggggagcagcuucaacagggacauacuccuccauggaggcugcccauguggccugcaaggaccgccacagcucaaacgcaugcaaugcuuuuauuuuucuucuuucccuuucuaccccuuuucuccacacacagaauacccaccucuauuuagaaaaccaucuguagauucguuugaaagaguuuguaauccuugaggcuguuggacccagugaauuauuuggcuuucacucugucccugggaggugacuuuuggaaaaagcccagaaugauggagcgccccuagcagauuuugcugacauccagccuaguuuaagguccccggucaccccucuguugacuccuccccagcuggguaccagguucucccauucccuaagagaugucuuaagaaauugaagcaguuacuguuucucucccucaaacacagaagcagguuuacuacuaucugaugccaaacagaccuucagcagaauugucauuguuuacguuugccuccuuggaaugacaccauuuuguuucuccagcaauccaaagaugcacucucaucuccacauuuaauuuccaaacauagcuacaugcuucuuucagaaacaaggucugagccaguuuacauguguaaauuggguuuccauucuuuauaucauguuccaacuccauaacucaaccugagcauucuucuuuuuuuuuuuuuuuuuauguaaaucagggauggucuuugaucucuagagggaauuuagguuuuccuggccuuuugaaugguaugcuaggcauugguuugcauugguuuggaacaggcucaaagacagaaucacagauuugcauucuuaaaacccccugccaacgacugggcuguuuuauugucccgagccaagaaaagccugauucacaagcauucggccuguguguuauaauaaauaugcuuagaaaagcccccauccgucacucuuaagcccuccugguuccuucaaggccagugugugaaaaaauagucaagacugaaagugaaugaguugaacuuacauuccuuacggguggaugguuauagaaaagggagcugggcuucccaagaaccacagcagcaugacucacagucauugcugccucuccugggaauuauucgacccaucuagguaaaagcaagguaacuuauuuuugccgcguuguuuacgcaucgguuucuaguguugacuuugcaaagcacagaguucucaguguguuauccuuauguguuauuccagaucccaacugcuccgccaagucacacaggaagacaccuuuggugaaagacuuuaaguuccagagaaucagaauuucucuuaccgauuugccucccuggcugugucuuucuugagggagaaaucgguaacaguugccgaaccaggccgccucacagccaggaaauuuggaaauccuagccaaggggauuucguguaaaugugaacacugacgaacugaaaagcuaacaccgacugcccgccccuccccugccacacacacagacacguaauaccagaccaaccucaauccccgcaaacuaaagcaaagcuaauugcaaauaguauuaggcucacuggaaaauguggcugggaagacuguuucauccucuggggguagaacagaaccaaauucacagcuggugggccagacugguguugguuggagguggggggcucccacucuuaucaccucuccccagcaagugcuggaccccagguagccucuuggagaugaccguugcguugaggacaaauggggacuuugccaccggcuugccuggugguuugcacauuucaggggggucaggagaguuaaggagguugugggugggauuccaaggugaggcccaacugaaucguggggugagcuuuauagccaguagagguggagggacccuggcaugugccaaagaagaggcccucugggugaugaagugaccaucacauuuggaaagugaucaaccacuguuccuucuauggggcucuugcucuagugucuauggugagaacacaggccccgccccuucccuuguagagccauagaaauauucuggcuuggggcagcagucccuucuucccuugaucaucucgcccuguuccuacacuuacggguguaucuccaaauccucucccaauuuuauucccuuauucauuucaagagcuccaauggggucuccagcugaaagccccuccgggaggcagguuggaaggcaggcaccacggcagguuuuccgcgaugaugucaccuagcagggcuucagggguucccacuaggaugcagagaugaccucucgcugccucacaagcagugacaccucggguccuuuccguugcuauggugaaaauuccuggauggaauggaucacaugaggguuucuuguugcuuuuggagggugugggggauauuuuguuuugguuuuucugcagguuccaugaaaacagcccuuuuccaagcccauuguuucugucaugguuuccaucuguccugagcaagucauuccuuuguuauuuagcauuucgaacaucucggccauucaaagcccccauguucucugcacuguuuggccagcauaaccucuagcaucgauucaaagcagaguuuuaaccugacggcauggaauguauaaaugaggguggguccuucugcagauacucuaaucacuacauugcuuuuucuauaaaacuacccauaagccuuuaaccuuuaaagaaaaaugaaaaagguuaguguuugggggccgggggaggacugaccgcuucauaagccaguacgucugagcugaguauguuucaauaaaccuuuugauauuucucaaggcccuagucucugcugucuccccuccccaccccauccuugcaaagcacuggggaaaguaaggccaaucuggcccucccugugugacccgccuucgaguuuuccuuaacaguuaguacauuuccuuguguuaccacgcauggggaagaaaacgcauggccccagaaugccacccccaccugaccuccccggaagcaccccgccucugcccagagcaugugcuugcuucuagagaaucccguuccagucauugcguggacagaaaacguaagaguccuggggaggggugggagggaaugaagcuaggaccuggggugggggugggggcgguugcaugcggacccgguauucugaaaagaaagaaaucuucaaacaccucgguccuguccggugaaaaaacgacagcauuacacauucucgugccaggaaaugguuacucacccccgcucucuggaguccuuuggagcuuucugauaccauucacacgauggagcaauucacacguucguuuucuaaguucuuuauuguccaagcauauaaggugagcacagcacaaauggcugccauggaaagucgugcuuccccagcauaagaacagagccaucuuugagccaugggaagccucauuuaaugagaccuuuuuccccccuuuuaaaucugauauguuaucgcacuuaggguuuuguuuuauuuuggcuuuuaagguugagagugggcugaacgccuucauaaugggggcggaggcgggagugagaggagaagggagagagcuguucuuuuucuaaugacuacaccugaaaaguaucaagagacaucuuugccaagagacuguagcagccagcugccccccguggagcaagguuuaaagacaaaauuaaauggcaccucuguuuaagaucugcguguguaaacaagacucguuuggggaaaacgacccgggaggagagcaucugugaucaaaaucucucauuguaagcacaaauuguuccgugucugguuauuaaaaucgcuuugggucuauaacagccacucuuguccccccuuuuaauagaaaauugucauucuagccuggauuucuccccacuggagguggagggugggaagagaagggagucagcucugacagcuuacaaacugggaaguucugugcaucuccagggauuccagaguugaagaucugguuguuggaagcugggcgcccagugcuuuuuuuuuuuuuuuuuuuuagcccagaugccgucaggacccacugaacaagggugaacucgggugguggucucgguuggccaaggcugaguugaacgccucaggccaaaccccaaguugaaagggagcauuguggcuuuuauaauccaaugaugcaaugaugauaccagcuuacaggaguucucagcaggugcuuuuuauuaacugaugaagagcuaaggcucacuuuugauagauaauauauauuuauuaaaugcauuaauguguguuuuauaauguaccuuuaucuucccccggcugacuguugcauacuuauaaaaaagaaguuaaagaaauuucaagacaaucaauauguaccauaaacgacuauauaaauauuacaaauuuaaaaggcuguaaaccaugggcagauagguuuuauuuucaaaaugcuguucuuaacacaaaaauaaaggcuuuacuauuuacuuaagacgugugguagcuugucaaaacaacccagugcaacuaacuacuaggcuuucggaucugccuugagggucggucuguggcauuuuaaaugggagaaucuugguuaacagcaaaccacagaacauauuaagguaauaaguuuacccauaaaagcaggaacuuucuauauaauacuuugggacuuagacaacaaaaauccuuuguuacaucugucuggguuuaagugucucaucuuguuggguuugcaguaaaaguuaaggaguggucuccuuuggaaaugaucauuaaguauaaggucuuuuuuauaaagagaguagucagucacuagguaaacuuaaaaccaaauucagagguuggggacuuaaauuagaauauggaucuuugcaaaggcggccacaagugggaaaacugguaauaagagcacuucuguauuccuugggacuagaguucauuguacauuuuaacagcagcugguguagaagaauacuccugaggcacugaagaaguaaucuggaugaaugaauaaaauguggggauaaugcagaaagugaagacugguccuuucuuuucuaaacuauuugcauuaaagcuuguuugcaaugaauccuaucuuguacagaaaagauuccauuugcacauguuccaagucuuguuaaagaaaucacaagagagagagcaucauuuggacauuuuccuugcacaagguaacuugugcucgaaugggcaaagauacgucuuagcuaugguuaagaugauggaauuuucaucuuggcug

SEQ ID NO: 15379 - RNA, 46383 nt, Homo sapiens
cccuuccccgccagucucccgcgccuggagucggcgccuccauccccuacacucacucugcgucaguccugccuucccccacccacagaagcgcgcagcccgcggcgggcugggaggaggcggcgccaggagcccagcagagccguggccgaccgagcacaggcugguccaguaggccaggccggaccaaaccaccgggcccaccucugugggagcaccaguuccaggucugggggagucucgacugacugacucuacccaucucccgccgcauccaacaauaagcugagcuccuccucccccuauuuuuccuuuacgcuuucauuauccuccccgcuccauucccguaaaacaagaaaaaaaaaugguccagcccagcucccuccggguugcuaggucuuugcccuuacuuggcgacggcuucguacgucuuuaugugcgucgugacgcaaucuuccacucguucccuccuugccccucucccauucucccuccuggagcuggcggccggcgggguuaccggaagugaugaugcaggaggcgauggagggggcggggcuucggggcggccgccgccggugggccgcagaugaagaggaggcgguggcagugguggaagaagaggcggcggcggcggggguagggagccuggaaacgcgagcggggaugguaggugguuuggacccgccgggccgccgucguuuccagaaaggguuugacuggaggaaccucuggagcagcugugaguuuuggggagggggggaguugaggaaaaggcgggggggcauugagagaugaaggggcggggguuggguaccuucgagaaagggggguggaaagggaggaguggaagucagcgcguugucuggagugguaccucugaaagaagaggcugugaggggagccuguggcgugucagccgcagggcucagaaaacuuaccuacugucccugccuccccaccgccagcaccccucaacccagggccuggggauaugggguuggagcugcccuggagggggugcagacucugguccucuguccugggugagcgcugugagguaggagcccuagggggagguggugggugaaucucccagcucccuccgcccucauuucccuccccacccccaucguucucuuuaaucauuaacagcccuggaauuaaggggcucagaccugaaggccuuuuugugcaccuuugcuauaaacgauaaccaucuguguccgagguaaugaggcuggaggcuuugccuguauccucuauaggaagugggacggggugacaaauguauuguuuguuccuccaccacaccccccgcacuucucaccccucauccucccccaugcacaccccugguuuccacuuuaauucucuguggcugaguggcaauaguggauuuuuuuuucuuccccuuuccuccuuuauggcacuuagugccuugguuaccucuuuugaauuugguguucagccucuaucccagaucuuaacuguaagcuuuguaauacuucauacaggcugucacguugggaguaccucuuacgcuccgauuauaaugagcauuuucuuuuaugaauacuggaauuccagagccuuugcaaggaauccugaauggcaucauagcccaggaaucaaggucucuugcucgaaauacuuuaugugugaggaauuuacauguugucagcucuucccaaaaugauuugcuaggcuaauucuggauuucuguguuucucuccacccacuuuucaugaugcacuucagagaacagaaaaccccauauuacuuuuuuguuucuacaauuggacaauagcucuuuuauguuuuucuccauuuaugugugacacacaaaucaucagugacacguucagcuugugcugauuuucaucuuuacguagcugauucuuuguguauggggguccuaaaugagacagugugaucuguuuaguuuugguuuaagggcgaauacaaaccaauaacggaugugaaaaaauuauuugaagcaaagaauggaaagaaggccucuuuguugauaugcuguugguuuaaaaaaaaucaaggagcacucuucuagccucucagacagauaucagagugaaguguuaugauuuuccuuuugguguugauacauucuucggaaaucuuuuguagaaucugaaacuguuuucugaagaacuuuaagagauagugccuacauuuucggaguccuuugauuagaaagugcccguaaguccuguccuucuguaacugagcuugauaugcauagugcuaggaagaucugaugcuaggaaguccuauucagggcuuucgggcccuaaaaaacagaauauuuaaugcuugauuauaccaguaacagcguguuuagauguuucacaaaaauacaacagaagaaugacuacuguucucacuuuaacugauuuagaaccuaguuugccauugacuaaaaaguucacaguucauuaauucaacaaacauuuauugacuccuaagugcuagccaguguuucaggcacuggguguacacaggugaacacaagcaaaagguucacccuuucauggagcuuacaucggagugggagcuggggacagagagagacauaauauauaucccaguaaaccagauuuugaucaagcgcugaagaaaauaagagugaugugauugaaagugucuuaacuguagaugcagucaaagaggaucuuucugaggaagugacacuuaaguugagcuuuaaguauaaagaaggagccagccauccaaagaaaaggggaagauccuuccagguucagggaacagcuggugcagaaacuggcuggaaugcgcuugucaaguuccagggaaugggaagaaagggucaggguaggugggagguaguggaaagaggauggguugggugaguaauagccagagcuuagugaacacgggggagaguuggagauaaggucagagagguggauauggggcucagaauagguaggcaaacaaauugccagaaggaguaggaaguagaaaaugaugcugcuuguugauuaauucugucgccuuaacuagggucuuaucacuuacuguuuuugcagguacuguuggacuaucauaauaaagucacucugcugagugggagaggaagaggcaguggucaccugggucuuuucuggcagauaaauuucaagcuggguguucagauuuucagcaggauguucaauugaggacacaccucuuucuuuauuuugucuuauauacugcuguuuaaaacugcauaauaaguucucugaauguguucuaguauacgaauccuccuuuguuuccagcucuguaugaauuuaaggacugggcaaguguuaauaauaugcccuuauccaucuaccaagaugaccaucaggaucuaaguuucaaguugucuuuuguagggaggcaguuuauguugcaauaguuccacucuugucugauccuucugaugacuaauaacacucagcugagguguagguugguacuaaaaguucacucaguggauuacauuagauaaaugaccauuguggggcucaauuccacugugucggcaucuuugggcuggcacguaaccaagggauguaaccuacuuuugccuucugcugagggcauucaucucuaauggugugcugcuuuucagccucaccuugaccagaccguccacuugagaggcccaaucaagacuccuugauuuggcccucuugagccaugucacacugggcugaaacagaauaugcuuuuuucuucucuugaacccuacaacagugacuaguguguucuuugagugaauuggcucuuugagccaggcaguugagagacuuaaauguugcuugggcuauuuguaguaaacucaguauuagaaaugcuaaauaaaaccuuuuaguguuuggggaaaacgaaucagaaauugaggacuugucaccuguuuuagguucuaguauucucguggcaccuguagaaggauuaucgaaaacuugaacagagcuuucugggcaguucugggggcaaugaaggggacgagguagauccugguacugaauuacuaauucugauuugauugcaaacagaaugucuuuuaguuagcaagcaaaugacuaaaguaaacaucuaggaacaggcaacuucuacucuucauacuagaguaucucaaaggaauagagaauugguagugagauuuguuaauuuaauuauuuggcuuuggcccagguuaaagguuuuggacuuaacuuauaugcugaugcuuggcauaaaaugcucuaucugauggguuauuaagcucuccacuucauuuucauuucaaugguuuauuguaacucaaauaugaaaauauccuguaggcugaaguuucaucagccaguuuggagacugguggcucuuuucuaauuuuugaaagggggcggguggguaggaggggacuugaacacaaggagaagccauugucuccuacauuggcuacuaauuguguuuggggaaagaauccacaaauuuaaguggauuggauuuucggagcugagcuggccuuuuaauuuaggguaccaguggauuuauuucuuacacuuugcaggcuuuuggacaaacucuucugaaaggugggcaaccuagaaagccaguugaugccacuugcuauuggaguuguggguaagugguuuuacauugcauuacacgacuaaaagguaaucagauuuugcuacuguuuugguguacagaugcucuuugauuuacagugggguuaccuuuuauaaccccaucauaaguugaaaauauuguuaguaaaaaaaugcauuuaauauaccucaccuaccgaacaucauagcuuagccuagccuaccuuaaacaugccaagaaccugcauguuuggcauguuuggcaaaugcaucuaaugagccuauuuuauaauaaaauauugaauaucucauguaauuuauugagugaauacuggaagugaaaaacagaaugguuguguaaguacuugaaguagucugggacugucuaugugcugaaguaaggacauuuaauugugcaguaguugccaguuguuuugaggugaagaagugguaacuuagauugaaacaaugguaaugacgugguaacuccuguuuucccgggucuugauaacuuaaaauuaucucuuugugucuguuuagacuguucuggagcucuuugcacaauggaccaggguuaauugaguuagugucuuucaguucaaaucuaguuucacuaguucuuacgucuguguuccuagaugauggugaauccuauucuuuuggguggugagaagggauuaccacagaacuugaccguuuaaucagugaauaauuacaaacuagagcguaacauauuuacauccccuugguauccugggggauugguuuuggaccccuuaguuaccaaauucacaaaugaucaagacuuacauaaagugguaguauaugggaaggugcagggaguggcggugaugcacaucuguagucccagcuacucaggaggcauuuccagauuacuuauaaugccuaauacaguuugggugugguggcucauuccuguaaucccagcacguuaggaggcuacuacaaauaccugcccccuuuuuguuuuauuaugugggaggauugcuuggaggccaggaguucaaguccagccuacgcaagauagucaggcccugucucuaaaaaaauuuaaaaaacuuagccaggcaugguggugcaugccuguagucccagcuacugggguggcuaaggcaggagaauugcuugaacccaggaaguugaggcuguaguagccgugauggagcugcugcacuccagccuaggugacagagcaagaccccaucucaaaaacaacagccaaauacaauguaagugguauguaaauaguugcuaugcuguauuuuaaaaaauucauauuauuuuuuauuguuguauuguuauuagguuuuuuuuuuccaaauauuuuugacccaugguuggucgaaucugccaauguagaaccuauugauacagauggccaauugcacugaaaaugaaagaaaagauuggaaguggcucaaacucuuauucuuugaaguugugacauguugaaagaagagaauggcagauagggaaaucauuuucuuuaagaugugugcaaaugagaccuucuuuaaauaccauacaucagaacagggaagcuuaguaaaucagucuugagguggugauuagcucuuguggcaaaauaagucaccugugcccagagccuggauaccagccugguugcaugcaaaggcagacaugucaaugacuucgucuaccuuccugagggcuugaccuuguucaagaguguccuuugagcuguacuauauuguuaggcuugggauugaauugccacacagaagcuuggauugcauaguguugggaagcaucaucccugauccuuuugugcccugcucugcuggagggcucaaccgcaggaccuggugacuagaaauaauucugucacuugggccugcagauucauaccaggucugaugacugacuaagaaucucagauagcagcaguguauagugugggacucuucauuuuugagacugcuuagcaucucggagccacugccccucuuucugccuguugggccaagagaaaguguugaaaaaaccugccccuuuuugauuuauuauguauucauuuauuuuuugagacagagucucaggcuggacucaguggcccaggcuggaaugcaguggcaugaucaaggcucacggcagccucgaccucccaggcucaagcgauccuccugucucagcccuccugaguagcugggacuacaggccugcaccaccaugcaccacuaauuuauuguauuuuuaauagagaugggguuucgcuguguugcccaggcuggucucagacuucucaccucaagugaucugccugccucggccucccaaagugcugggguuacaggcgugagccaccacaccuggccugcuccuuuauuuuaguagcagauuguuuccacacaagcggcagaguuggguuacagcuuuuagcucucuaucauucaugauggguuugaacucuaugcaguguuugcuuaaaguggauuaguauguguccuuuaauuuugauucugaacgagucucaagucauagcauuacuacuuugaaugcuguuaauuccccuuccugaaguuuaggagaagcaggaaaaagucagacccuugcagaaucuuagcauaucugguguuuauuucaagcugggcuuugaggagcccucuccgccauuguugaaguaugcuuguggcagggaugaggggguuuugcuguuuuccuucuguuucacguuacuacuucagucugugaaaaguuacuguaauauucuguuauauugggcuacccuauuagauucuaguugaauaaaauguucugaggcugaaaacagguugaaaagugguuauuuucagugggaaaacagaaaucaagaaaaauaaguaggccaggcaugguaaugcacugcaugcguguaaucccaguacuuugggaggcuuagacgggagaaucucuugagcccaggaguuugagaccagucugggcaacacagugagaccucauuuuacaagaaauaagggaaaggagcugggcgugguggugugcaccuguagugucaccugcuugggaggcugaggcagcaggaucacuugagcccagaaggucaggcugcagugagcugagaucgcaccacugcacuguagccuuggugacagagugagacccugucucauuuaaaaaaaaaaaaaaagaugaguaaaugcuuaaaguuacagagcaagcucuaggcagcagcaaggcuagaaucaggccuucucugcacuaauucuuguucugucuguugcacugcaucucucaaacaaguugguguaggcacccgauaaaguuuaauugaauccuugguguuuggacucuguguucuuggguucuguacucaaacauuuugucacaaacucuucaucuuucaaagaagacucccuauagugaagcauaugugaagcgagguuauuaaugguagugggaugagaggcuucuuaguuuuaguagugguuguggauacuugauagaaagcugggcuuuuuucuucagaauaguucugaaagugaccauauuacauucaaauaggaguugaggcauuaucccuguaaguuuucuuuuuuucccccccaaaccaaccccaaaauggucagugcacuguaaguuuuucagauaagcaagugggccuguucucgaacaccagugcaaaaugcuaaaccagacuuccauuuccugugaccugcccuggaauuugaagaggagaauccagguggauccauggacagaacagcuucugaacagcucuguggaaauaaccaccauggacaugcauuccuuauuuuuaaaaaauaucuguaaagcaaauuggcuuucaauuaaauaguugcuuuaugucuacuuaaugacuugccuaguaagugcucuuuaaacaggagggggaggugaauaauaccauuacagugaaggugccgggacucuagcaguguggguccuaugagacagcaucuaggggcacacuggaagucucaggcccucugaggagguguuuuuccccaguugugacauuuucuuccuucucaguaaguggaauuagagagugaggagugauagagugaaugcugugugucuacuuuugagaauguugucagauucuuuuucucuuagaaauuuaguuguucuuugaaauagucaguuguucagucauuuacucaaaacaguugguguaucucaugcccacggugaggagcauucugcuugagaguuuccuaacuuuuuaggaaagagaaaagccuaaagacucccagagcacuaagaugggagguucaguugucggagaugagcuuguguaggguagcuggccuuugagaggacacggugguuggugguauuguggacuggggagaaaagcccaucaguggucuagcugggagaggcugcaaaauacuaacagugcacuuacuggggacagaggguagggaaggagcaggcccacaagauugcccaacuccagggaaugccguucacaaggaggggacaggguccucuggaguugggcaguguacuggcccuggccagggcucugaucacaaguccucucccaacuggaaagcauauuucugccuaagagggaugagcacagggacacaguggcugguuuggccaaauuguucuccaagauggacuaaucagccauaaucaggaguuaucccugguccaggcuagaccacugaugggcauuucuccccacuccacacccaccacccaucaccacugugcccccucgaaggccggcuacccuacauguccuccucucugacaacuucccaucuuggagaccagucaucuuuacagacugcuggccaauucccccggccuccaucccugucucuuagggcuuuauuuugacaaaucggaaguugguaaagaagggauuguaauuauuuguauccguuagagcauuagagaacacuggauaguggcucuugacauuuaacaauguuugcuauccaaacggaacaguuacaugucaauugcugagguaauuaaugauucucuugugggaacuguaaugugaaaaaacuaauuaaagaaaaucggccggguaugguggcucacgccgguaaucccagcacuuugggaggccgagguggguggaucacgaggucaggaguucaagacuagccuggccaagauggugaaaccccaucucuacuaaaaauacaaaaauuagccgggcaugguggcaggcgccuguaaucguagcuauucgggaggcugaggcaggagaauugcuugaacccugguggcagagauugcagugagccaagaucgcgccacagcacuucagccugggcgauagagugagacuccaucucaaaaaaaaaaaaucauuuuuuacuucacauuucuacaacauccauguucucuuuggcaggccaaauuagucuuucuucuuuaaaaaaaaaaaaaaaaauuuugaccaggugcugugaucuguccauaggaccugauuuccugcuagugccgaccugcaagcagugcucugaauuggugacagguguagauuuaaugauuagaucaagcagggaaguggcuucugagcaucagaaugguuaguuuuaguguggaccucuuaaugaggugauuaauuauaucauuccaacaguucuugggcagcaguugaguguccagcaguuuaguucuguuacugcguggaguuagcacagaccccaccuguuuauuucauuuuuuguuuauagagacagggucuugcccugucgcccaggcuagagugcaguggugcuaucauagcucacugucauuucaaacucuggggcucaagugaucuccccaccucagccucccaaguagcuaggaccagaggcacacaccuccauggcuggcuaguuaaaaaaaauuuuuuuuuuguagagauggagucuugcuuguugcccaggcuggucucaaacugccucaagcgauccucuugccuuggccucucaaagugcugggauuacaggugugggcccccacacccucagaucccacauauuacuuacgcauuaccucaaaauugccccacuucagaugccagcugcagguauuggguauuuguacguuaccugaacuucugcccagcagacuauaaauuuggagguucccaugacuccccaucccagguuugauaauuugcuaucaugagucauagaacucaggaaagcaugauauuuaggauuacaguuuuguuacaaaggauuuauuuauaacucaggaacagcugaauggaagagacgcauagggcaagguaugaguugggggugcagagcuuccaugccccuucuggugugccacuccuagcucauaaaugcuuuuaccaaccuggaagcucucccagccucauuguuucggaguucugauugagguuucauuacuuaggcaugaucauugaccauuggugauugaacucugucucuagccagcccuccccuccccaaagcucagaaaguagggcuuugaggucuaaucaugugcuuggucuuucugguuuggcuagcccuucacuggaaacuauaagggcccauggugaaaucaccuuguuagcauaaacucuggcaugugguccagagggcucuucaugaauaauaaaagacagaaaauuccaaggguuuuaggaucucuggcaggaaccagggacaaagaccaaauacauuuuucuaauacuccauuaguacuccaguuuuguaucuuguaaguaguaacggaauaaggguaccuaaaguugauuuaaaugauaauuaacaauugucauuucuugacacaccagauacugcaaguugauuagcuuuagauuauaagcagcaaauuccuccuucaauuaguaugaaauggcauucccagaauagucaguauucuugaacuucaaaggugcauuaggucuagacuucccuaaugcaagaaaccagcuuacuuuauaauacagauuucauguuaccuuuuuuuuuuuucuucacucuguugcccagccuggagugcaguggcacgaucuuagcucacugcaaccucucccucccagguucaagcgauucuccuaccucagcuucccgaguaguugggauuacaggcaugugccaccacgccuggcuaauuuuuuuuuuuuuuuuuugagauggagucucacuuugucaccuaggcuggagugcaguggugcgaucucagcucacugcaaccuccgccuccugggcucaagcaguucugccucagccucccaaguagcugggacuacaggcaugugccaccacgcccggcuaauuuuuguguuuuuaguagagaugggguuucacuauauuggccagacuggucucgaauuccugaccucaagugaucuacccaccuuggccucccaaagugcugggauuacagaugugagccacugugccuggcccuggcuaauuuuuguauuuuuagaagaaaugggguuucauuauguuggccaggcuggucucgaacuccugaccucaagugauccaccugccucggccucccaaagugcagggauuacaggugugagccacggcaccuggcccauguuacuuuuuaauaugacuuuuuaaaagauuuagauauacauagugggccaggcaugguggcucaugccuguaguccuagcauuuuaagaggccuagccagggaggaucacuuaagcccaccaguucaagacuagccugggcaacauggugaaacccuggcucuacagaaaauacaaaaguuagccaggcaugguggugcccgccuguggucccagcuacuugggagacugaggagaaucacccuagcccggaaaguugaggcuguagugagcugugaucgugucacugcacuccauucggggugacaaagugagacccugcucaaaacaaacaaaaaauagauguacauagugccuugguuaagagaacauagucucuagagucagucuggguuugagucugaacuuuaucaccgacuugccacuugaccuuggaugagccauuucucucucuaagccucagcuuccucauguauggagugaggguaaucacaguaaaugguugugaggauucaauaagauaguacauucgaaggacauggcacagugcugggcauaaaaacaaacauuuaauaacauuagcuauuauuggcuacauggcauccauugcuaugcccaccuggaauggcagcuaauucccaaggagucaagaaucauguauaucauuuuaccuccucuuauagucaguuuaugggacaguguauaaaaagauugcuaggcacacaguagacacaaguuauguaucauuugaaaauaaaaccuguccucuggguaucugggaaauacacuagugacucuguaauggaaacuuccagcauguuuccaaagcuggccuaaaacccagagauggaaaaucuuccuccugaaacccuauggagccuguauaagucuagcaguggggacaggggcuaggauacuguuggaucaaaaauugggaaacugauccaggagacauuuuuaucuuugacuguaugccuugagguucagugaguugggcaaaaccacauuagacuuugggaaaagaaauagauuuauuucagccagucuagauaauguuugacagagucucagauaaagagaaaagcccagauccacaugcaaaagggcuuccugacugcuuagaguuuacuuguuggugaacuccucugaggccaggucucuaauucuuccuguagcucaagaaccaagacagucuacuguagugggacuaccauuggauuaaguccuuaguucuagucuagacucugccaccauugcugcuuuuccuugggcagaucacauccccucucagucuguuucuuuaacuaugacauaaaggauuuaggacuaaaucacuguuucucaaaguguggcuuugguuacacuuguaauuuauguguugcugaaaugaauacucauguguuuuuuuacugcugauggugcauaagaugauuuuugguggcacaugaugaauacuuuucauuuacuaguucuguuuuuuauuguauuuacuuacuuuuugagauggaaucuugcucugucucccaggcuggagugcaguggcgcuaucuuggcucacugcaaccucugccuccuggguucaagugauucuccugccucagccucccgaguagcugggauuacaggcacccgccaccacgcccugcuaauuuuuguaacaggguugcaccauguuggccaggcuggucuugaacuccuuaccucaggcgauccacccuccuuggccucccaaagugcugggauuacaggugugagccacagcgcccagccuacuaguucuguuuuuuaauguguaugaaugaaaacauaacuaucauaucacaccuaugaauucauggacaauagugcuuaggaugauacuaaagucaugucaaagacaaaauugcaaccaauuuaguuuccagaucucaacuggcuguauugcaauucuagaauugggcaauguuucauuccauaauauagaauaaguguuuagaugagcuaaagcaggaguuggcuuuauagacagaagggcugaagaaagcagaagcaaagaacaaagaguguaucaguccuuuuaaagcugcuuuucuuguaaggcaggacagggaaacagaacaauagagaaauaacugaauaguuaacauuagauuacuucagacuuuuguguguguuuguguguaagguuuaaaacuagggaacuucauuaucgugccaguugaagauuuaaacauggaguuugggaaguuggauguuaucucuuucuccugguuucugggaaggucagauaacaaacuuaguuugggcaugaaugacuccauuuugauuuuuagucuggucucuuggagccuagugcaggagcuuaguccagaaccauggucuucuaucauuuuuauuuaacaguagaugcaguuuuuaaagaagcuuuuaagaaaaauauuaggugaacaguagaugggaugguaaagaugggauaugaauggcugaaguuuguagguuccaagacucaguaacucuagugcagcgccacaccuuauucaaugaagucuuuguggugauggccacugcugagcaggucccgauuucaggacuuaaagacuugccuucagaagucucaggcaaaaaaauaaagacuugacuaacucaagcaaauugacaaauuucuuuuuuugcauuugugacaaaaauacccacaaguagguuauguagaauuuaaaauaccauagccauuaguauugguggccuuuuuuuuuuuuuucaaugaaaaaaugaauaauauuguuuacucuuucaccuuuagcaguuucccggcuaccuggauugcuccucaguuccucauuguuugcuguugggacuccccauguuagaaguaaaguuagggucugacuuguucuguuggggugggagaaaaagccuaauugcuucuugaacccaagccagugcauggauucaaggcucugucccaucucaagagcugaccuguagauuacuucuuccuggugacugcuuuaaagggacagugggauaugugcccuaaaaugauguuaaacacugaggcaggcaguauuuaaaaucucauuucacuuugucauauugcucauaauucaacauaguggggucuugagaagggaaacgaguaguaguagaaaugauacagacuacugugggaggcacuugcuuuuucaguaaaacccagaauaaaauggaaaucucuguuaagcaauagaagccgaaaaagcugcuuucagauguaguuuauguuuuuuuuuuuuuaaagccuuaauuaccuguagucccuaaacauuuucuguguaucuuuacacugucaucuuuuauuaucuacaguuggggauuggucuguguuugcaagugaucuuguucugaguuaacacgcuguaaagggccauggaucugguauagcuccuuguaauaaguuauuuaguguuucagauuuuaguuuuaaaaaauugcuauaaagauggauccaagucugauaggucccugugccaaguguuacuagugaagauuagguuaaaauagagcaaaaugccgggugcaauggcucacaccuguaaucccagcacuuuugggagacugaggcgggcggaaucacgagguaaagagauggagaccauccuggccaacauggugaaaccaugucucuacuaaaaauacaaaaauuagccgaguaugguggcgggugcccguagucccagcuacucaggaggcugaggcaggagaauugcuugaacccaggaggcagagguugcagagagccaagauugugccauuguacuccagccuggugacagagccagacuccgucucaaaaaaaaaaaaaaaaagcaaaaugguggcagugauauagcccaacauuauucuccuaauuuauuuuauuuauuuauuuugagauggggucuuacucuguugcccaggcugagugcaguagccuaaucaugguucccugcaaccucgaacuucauuuauuuaauacaagguuucuacaugacuucauaaugagaaacucucaaauguuccccaacugaggugggaucugugcuucaauuccucauacuuuguaaauuucgauuuugucauucuuacugucuugucucagagaggugucgugaccugugucauugggcacauuggcaagguggaaaaagccuuuuacugaaggcuguguuuugcaggauuacaagucugccuucccacuaagaucuaauugaugacacgcagcaagcauccuuugagcagauuuugaguucaaaccaagcaacuccuuggauauacaauuauaagaccaccuuacuuguagaugucagguuucuagaacagccuauuuccugugguauggaaguuagucauuauguguaggcaaugguugaugagucuggauacauucugaaaggggaggggccgaguugugacauucacccuuggucugcagaccaaguuuugcaaagcuagaguggggcuguuuguuuucuucucuucuugggaaauugccauuggaucaguuugucuugguuaagaucuuuuguggguagcugagcaguugggcuuuuaaagaugaaagccacaugaaagaagacuguucuuuccuagucauacaaaugauuaucuccauggucguauaaucuccauaagaaguaugagcauucgagaccacacauuuaaaaacuuaacauauaacagagucagaaggaaagauguacaacauaguggcagaggucaguaccuuuacaagccauucuuacauguuccagcaccacuuaucgcggucuucucaugguagaauaaccuuuuaguuuauccagaaucuuuucacuccuaaaauaaagcccuuuuaggauguuagaaacuugaauauucauggcaacuucaaguaaaaaaauaaaaauguuuaauugaagacuuaaucuuuaacucugacuuuaaaacuuuccuagucaaagagcuggaguugcuuaauuuaucagagcauuugcuuuuccaaguucacagcucucaaucguugauuggccuagcagaaagagauaauaaaaaguugugcaacagguaaaaaucuuuccaguugccuuuuccccauuuggaaggaaaccuguuuuucuuuccuucugaacaguuuggccuaagcuccuccccuuucugauuugcauauuugcuauuuucauacaguacuucaauugauucacucaacagaaaguucuaaagaucuccaguauuuaauacuucugauacaaccagcuuaagcaaaagaauuuucaauuaugauagcaguuuaacagaacaaaaauuuuuuuuuuugagauggaguugcgcucugucacccaggcuggagugcaguggcucgaccucggcucacugcaagcuccgccucucagguucaugccauucuccugccccagccucccuaguagcugggacuacaggugcccgccaccaugcccggcuaaauguuuuguauuuuuaguagagacgggguuucaccguguuagccaggauggucucgaucuccugaccucgugauccguccgccucggccucccaaagugcugggauuacaggcgugagccaccgcauccggccagaacaaaacuuucaaaaacacacuuuuaaaguacugaaguuacugaaacucugaaaccugaaaugcuccaaaauuuagaacuuuugaucccugacaugaggcccaaaggaaaugcucauugaagaauuucagauuucagauuuucauauuagggaugcucuacugguaaguacaauguuaauauucuaaaaucugaaguucaaaauccagaacacuucuggucucaagcauuugggauaagggauacucaaccuguacaagauauuuucucccuaagaagaaccagacuguuauuuuuaaguuagaaaucuauaagcaaaagacuggcauucucagacagaauguggaccauucauaggguacuucugaaacuaaaaaccaguuuuguaagcuaaaaaauguuggccuccaaaauguaaugcuuucaugguuguauucaaagugaagcguauguauucugaauuuuucugaaagacugacucuaggauuggacacaucguguuucaggaagaagaaauguguuuauauguugccagcuacuuguuccaauaauuuuuagugccuauuguagaucuugcucuuaaggacuuuauugucugguuggaacauaagauagugacaauuagaaaauguuguaaaaccagugcuguaaaaauagcagugcuggccgggcaugguggcucacgccuauaaucccagcacuuugggaggcugaggugggcagaucaccugaggucaggaguucgagaccagucugaccaacauggagauaccccgucucuacuaaaaaauauauauauauauacaaaauuagcagagugugguggcacaugccuguaaucccagcuacucgggaggcugaggcaggagaauugcuugaacccgggagguggagguuuuggugagcugagauugcaccauugcacuccagccugggugacaaaagcgaaacucuaucucaaaaaaaaaaaaaaaaauagcaauguuauaaaugaaggugcucaggggcagagaggcucucagucaggaaggaguccugugggaaguaaaaucccagcauaaggcaugaaagacuagagaaaggaauggggagggauucugagcagugguaacaguguguauaagacuaggccgggcacgguggcucaugccuguaaucccaguacuuugggaggcugaggcgggcagaucacaaggucaggaguuugagaccagccugaccaacacggcaaaaccccaucucaacuaaaaauacaagaauuagcugggcgugguaccaugcgccuguaauccuggcuacuugggaggcugagguaggagaaucgcuugaaccugggaggcggagguugcagugagccaaaauuguaccacugcacuccagcacgcgugacagagugagauucugucucaaaaaauaaaaaaguaaacacauuuccccaccuaacugaaaggauguuugaaauuaggggagcaguuuggugaauuuccucugucucugucacaggcuaagggcuugcauaagcugcuuuaguucugagcuuauuuccucauccguaaaauagggauagccauaggaaccuccgagaguagcuguggagaguaaaugcuaucaugacuguaaaaugccuaacguuguuucaggcacaauaaaggugauggagggaacguuuaucaagcuugguugagauuuccaagcuaugggucauaucucauugguggguuauaagcaacaauuaaaaacaaaaugggaaaaaaagaaaacaaauagugcaaaucagugcaucauagaaguaaggguaaauauugaguagauuauuuauuuugagacaggaucuugcucugucacccaggcuggagugcaguggcacacucaucggucauuguaaccucaaauuccugggcucaagcaguucucuccccucagccuccugaguagcugggacuagagguguacaucaucacacccacuuaauuguuuuaaauuuuuuuguagagacagaguaucgcuguguugcccaggcuuggguaaauauuuaaaagguuaaauauucauggaacuuuucuuugaguuguacauggcuuuauaugugugcauuggguaaggauauaaaauauauuucucacugaagguugcaguuaaaguuugaaaacuacuuguauaguccaaacucucauuucucagugacucaaagacuuagcacaccaaagcaaacaaaaaaccacucuaucggaguaugcuguuuugaaagaagcaauuuaaaccuucaggcuuaaaaaaaaauagcuuugaaaagcauccuuaauuuaagagucugaauuuuggcucugcugcuuacuaucuccuaggguauuauuauuggagaguuggauuguuuuauuaguugauauguguaaaaauguuuugagaaugaugccugguacguaguaaaccuugggaaacuauuuguggauguuacuauguaaaagugguaguacucugcauuuagguagauuugugcagugcacuagggacauaguaggugcuuauuuuccauuugauucuuuagaaaguaucucuuagaugccaguuagccauuuucuuuucuuuuuucuuuuuucuguuuuuuuuuuuuuuuuuuuuuuuuugagacagggucuuacucugucacccuggcuggaguacccaggcaugaucacugcucacugcagucucagcccucugggcccaagggauccuccuaucucagucucccaaguagcugggaccacagacauguaccaccaaggcuggcuaauuuuuuuauuugugauuuuguagaaauugggucucccuauguugcccaagcuggucucgaacuacugggcucaagcaguccuccugccuuggucucccaaagugcugggucugcaggugugagccuucgcauuaugccaaguugacccuuuuugugucaucauacacauucccugucuucuuggagcuugcagucuaagaugcugucacuaaaaugacaacagccuuucucuucuauguacuuuuuauauuugacuauuugcuugggagccaugaauguuuuugucccaagggaauaaauaauguguaaugcauuuaagccuuggacgcacgauagacauaauaaaguauauuauaauaaaaugucaucuuaggcacuuaaaaaauucgguuuaaggacuuacugggagggagaaauuacggaacauuuucuuuucugguucuuaaaauauguuuuuggccuggaagaaacaagugucaaaguuguuuuuaagauuauuagguugacuucucuuacagugaguaguuggugucagcaaauugauuugcaaugagaaagaugacugugccuuuugcugagcagugguggauaaugagacuuccacuucaauaagcccauuggcaauaccgagucauaaccugggugaauaggaguuaaucuuggcugccuggcagaaguggauuuguuauauaauuuaugauacccagaaauccuuuggggaggucuuuauuaucuuauuaucaugacaguauccaucuaugccugaagauuaauuuuuguuguucucaucuaguuccaccagagcgauucuccuaacugaaaggguagugacuuguuaaaugccugcauuuggcuuuugcuuugacacaaagguaugcuaaucaagauuggauguuagcaauccagaaauauuucaguuagugauuuauuaauaguuuagagauuuuuuuuucuccuguuaaacugacuucugaaaaaugagucauauucaggguuucaaacauuuccucuuugaccagccucaaaaaagguuuaucaguguuugucuuguagauuguugcugcaauucauuugugucaguucugccacugcugaaacaaacacaagagggguaucaguuugguuuuccaucauuugacacaagcggacuucuuaauucugucacugguggacgaucacuguuaaacaagccgguacuauuuuuuaugacucacugagaagucaugugguagugugauaccccgucuccagcuaccaguguuuaaacuuguaauuuucaauauauuguguuaaaacagacuucuaauucuggcuauuuuucuuuucaauuuuaggccuaaaauuggaagcucuguuuuuauaaaacagccuccuagaaaagucaccgguguugcuauucucuuucuaccccaaauaucauaacugggccugggggcgggcagaguaagagcuggcuguuucacaugguuaagcagaaugugugggucugccagccagcggagguggaaucugcccuuugcuuucucagcaaguaccucuggcuuugggggccccguugaggacuuuaguuguuggccuuucucgcagucaugugaaacaaaguucauugucucugguggcuguaaagagauggaggaccuuuauugucuguaucacuuacccucuuugauaagguaugugcuucagcccuccaaguuaaaagucacucugucaucaagugaacagugguauaacaucucaagagguguaacacuggccaugaguccuuguguuuuaagcaguugaauucguauuuaaagcaaguaguaugcaguauucaaaaaagcugcuggcuguugcuccugcaucucuagacaccuuaaauaugaugccuuuauuuguugagguggggaagaugcaguucagaccagcagccugaggcuuuucacuggaguguucccaguuggugagccccuuggucuuccuagagugcagugcauggcuguggcuucaguaaacccuuggacauaacacccugacugaaaagagaggcagaagugauuuccauuaaugugaauuuuuucuaagauccugagguacaggucaaaaagagacaugacagguugaacaucucccuaugucagcuucauauucuggcuuuugcuguauuugaggugaaaauuagcuugugaagugaggagagauggaccuguguacugcuggcugagaagcuguguuuguaucacauuaucugagaaacucauaagguaaagaauaauuggaguaauaagauaauccucuccucucuuuccucucugaagguagugggugcuucgaauggggggaguccaagaaaaaauagaccuuaagaaucagggcugggcccagugcucacacccauaaaccaagugcuuugggagacugaggcagaaggauugcuugagcccaggaguucgagaccagccugggcaacauagcaagacccugucuguacaaaaauaaaaaugaaaaaaguagcuggguguggcaccaugugccuguagucuuagcugcuuugggaggcuaaggugggaggaucguuuaagcccagaaguuugaaguuaacagugaguuaugauugcaccacugcacucugggcuggcaacagagccagauccugucucuaaaaagaaaaaaucagcucuugagaacugaauugaguucugcauucuuaggacucaacucccuuuacucuuuccuguugaguguuuguugacaucauccuauaauuugaauugguauaaauagcuaccauuuauugaguauuaauugugugugagaaagugcuaaacaucucagauucagcauuuauucaaucacgaguuaauauauuuaaagcaauaaagccuuguacagagcaugugcucaguaucagugacuauuauuccuucuacagauacuuaucaaugugccaugugccacauagccuaggugcacaggguaaaguggcgaauaaggcagguaaaaugccugcuauuagagggagcaggcaauaaauaagucagcaaauuagaauuucacagaguuguaagugccgugaagaaguaaaacagcguugugcugaauuagagggaaguggcauuuggauugguugaacauggaacacaugucagcacgugaacugagacccaucucauaugaagcagccauuuauucuucaccgugaccuuuuuuuuuucaucgcagaacucagucccauuuuuuuguuaauugauaaauaauauauguaguuuugagacaugugauaauaugauacauucacauuauguguaaaaaucaaaucaggguaauugggauauuauaucaccuuaaauauuuaucuuuucuuuaugccgggaucauuuaaauuauucucuuccaccuauuuugaaauguacauuagauuauuguugacuggagucacccuacugauuuuuccaacgcuaggucuuacuucuguuuguacccacuaacccacuucuuuucaucuccccucccgcuccccuucccugccucugguaacuaccuagagaagauaacugucucucucuuccugagauccacuuuuuuagcucacacaugagugagaacaugugcuauuugucuuucugugcuugguuuauuucacuuaacguaaugaccucuaguuccaaccguguugccuaugacaggguuucauacuuuuuuauggcugaauaauauuccauuguguauauguaccacauuuucuuuauccauucauccauggaugggcacucagguggauuccauauuuuggcuauugugaauaaugcuacaauaaacaugggagugcagaucucuccaguauauugauuuucuuuccuuugcacauauaccuaguagugcaauugcuggaucauacaguaguucuauuuucaguuuuuugagggcccuuuauacuguuuuccauaguggcuauacucauuaacauuuccaccaacaguauacgaggguucccauuuuuccacauccuugccauucauuauucuguuuuuuuuuuuuuucauaaccauuuuaacuggggugagauaauauuucguuguggcuuuuauuuacauuucugugaugauuagugauguugagcauuuuuucguauaccugcuggcuauuuucaugucuccuuuugagaaacaucuauucagaucuuuugcccauuuaaaaaucagauuagagucgggcacaguggcucgagccuguaaucccagcacuuugggaggcugaggcaggcggaucaccugaggucaggaguuugagaccagccuggccaacauggugaaacacugucucuacugaaaauacaaaaaugagcugggccugguggcaugcgccuguaaucccagcuacucgagaggcuaaggcaagagaaucacuugaaccucggaggugauugguugcagugagccgagaucaugccacugcacuccagcgugggugacagagugagacucugucucaaaaaaaauaaauaaauaaaauaaaaaucagauuauuauuauuauuauuuugcuauuaaguuguuugagcuccuuauauauucuggcuguuaaucccucgucagauggauaguuugcagauuuuuuuucccauucuguggauugucucuucacauuguugauuguuuacuuugcuguguagaagcuuuuuagcuugauauaaccccauuugucucuuuuugcuuugguugccugugcuuuuaaggucuuacacaaaaaaucuuugcccagaccaguguccuagaucauuuccccaguguuuucuucuaguaguuucauaguuucaugucuuauauuuaaaucuucaauccacuuugauuugauuuuuguauauagugugagagaggggaucuaguuuuauucuucugcauauagucauuuaguucacagugauuuguuuuaguucccguuuucaacugagaagacugagauggaauaugguuaagugugagcuagagaguugguagagcugggcuguacaaaccuagucauuuugcauccaaugcauguacuuucccuccuggaaggcacaugacuauacuggagcagcugaaggagcugcaauaucugugcaacugguuuuugagugagagaauugaauguugguugcagaacagucaagacacugaacgcaauucagaaaaguugcauguaauuucauggacccccuauuguuggaugcaacauuugugugugugugugugugugugugugugugugugugugugugugugcaugagcgcacgcaguuuauucuggggccauaguugucuuugagucuucagacuuauugaugacugaaagaacuuauggugcugcugcuuuauuuuauaaauuuuuuauguuguuucuuaaaauagggcauagcugcuagggcaggguuuuaauagacagcauugugguggccauuagguggcagcaauuuuggcaggucaugugggugggaagugggcaggaacgaaucaucagaugucuuacuuugcaaagcuugcaguaccacagugccuuccaacagguauagagcuccauuuuuaauuaccugcuuaucuuugcacauguuaauguacucuggggccucaugcuacaugagcauuugugaaaauaaguaacuuaaaaaaaaaaaucaaagccuaaaccuuggggccucaaguuucaaccugcagagaacguauucaaauaaagaugugcaaacaugagcauuuccugucagucuuugaaacuuaaacacuuucuuaauaggcucuucggcauguaaaaucaaagagaaauugucucagugauaggaauugaaaccaagaggguagccaaguucagguuagauuugggcuuucaguuucaugggauaugguuuagaucaaauaccuguuucagcuggaagguugaucauguuauuguacagagaaagacuucugagagauuuuugcuuucagccuuucacauggugucugaaugcugggacgggguuccucuuugggaacaagaugaugacagcaaauauguacacaauagaauaaagcuccugaaguauucuguggcauaucuacuugaaggaggucuaacgguguaaaaauugcaauuggaaagauucuuguagccaguuagucauaccaucuuuuaaauagcauccuacugguccacguaguuauaauggaauuugacagcuuucaugaacuugggaucauugguccuguuguucagcuaaggguccuaugauauauucgacuagaaauuguggccuagucaguugguucugaaccaugaaucagaacaucuggcaauuagaucuucucucucuuugcucucugaauagaagagaucugagugacauagcugugucuugguagggacucuuucaguugugauagaaaaccugauaucuaacuuaugcaaaggagaguuuguuggcucacaccugugaaguucaggcuuugaucuugacucuaggaacaguuggauucaggguguaaauaaugccuucaaaauucaguuucccuuugucucuucauacugcuuuccacuuggugauuucauuuuuggguucuacaugcauuugagcugagccccaugugauaaacagggaccauuuaauccucacagugacccccuaggcauucuuauuuucucugguagcucuuucugguagcaucuccagccuccuguauuuucaggguugagauucugucuggcuggcuugucaugggcauauccuggguccagucauuaaagccaggggcaugugaggccuugguggggcugagucccauaguucuuuaugaaccccacccagccauauggccgagagcgagggaaaaggaucugcuggugaaaauuggguaaucaccugaugaagagccuggaugcugggaaggcagacacgucugcuacaaaucuguccuuugacccagucugcagcuugacagcccauguuagucuucacacuaaauccagcccauugaccauuuccaggcauuccacauuucucuuuugaaugagccucuugcucccugggaaugugaaucacucaauccaugggccagacccuucuaccccugauguuaaaccuuugauaaggggacuguuacucauuagaccuuaagauggucaucaucuuuguccucuucuuuuccuuggagggagugugaggaggaaguugaucuucuuuugaaagaauaaauugaggaaauuuagauauaagugaaagaugucuuuaggauuaagcugcuuuucuccccauucccccaucauuuaaaaacacuuccuuaaaaucccuggagccagaaucacuggaucauuggauugguuaguuguuuuuuuuuuuuuuuuugagacagagucucgcucuguagcccaggcuggagugcaguggcacagucuuccucacugcuaccucugccucccaggucccacuucaagcaguucuccugccucagguucccaaguagcugggauuacaggcaugugccaccaugcccagcuaauuuuuguauuuuuaguagagacgggguuucaccauguuggccaggcuggucuugaacuccugaccucgugauccaccugccuuggccucccaaagugcugggauugcaggcgugagccacugcgccuagccugguuagccuuuuugaugugauucgcagugaagcaagacugaaaggauauacuccaaaauauuaaccguagguggugaaauuagugauuggcuuuuuuuuucuuuaugccucucuguacuuucuaaacuucacaaaauaauuauguaauacuuuugaauuugccagcaggaaagagagucuagugaccucacuuuucugaccagguuacugaugugguugaaagcaggaauucuuuuauuguguggaucuuuucugucccucuuccucuuccugucugcuaugcauuagcagucaaccuccaucguggggaaaaagcugauaaauguggucuuaauggauuuagauuuuuuuuuuuuuuuuuaagaauuagcaaacauuaagagguugauugguuaccacguggugaaccugaggccuacuuagaggccuuuggcucccgaaaccacauaucuacauuuguggucauccaggugcccuuuaagacauuuggaugcagucauuuaucaucuguauguuguguuccuucgucgucuuuggacucauuucauaauuuccuuucuugccuuuuacuuagaugcaaaaaucuaaccuuaucuccaguucacuaauuuucagugaguugcugacucccaaguucucagaaggugauugaaaaaugagcaguugaugugguaauuggguguuuugaggacuaaucagcuacaaucagguaaaccuccaggguggcugauaaccauaugcugacuggaaggaggguauuagugcuaaucagugguuuacuuucagugggcucuacugaggcuccauccuaaggaauaaaacaagcugcaagcuuauaacggagaugaagagugcagcaggcaugccguuuuuauuagaguuaagguucaguacaaauccaggauggcuuucugguuuuaaacagggaaagucacuggaaaagcuggugugaaaacaaagaaugaccuagaaauuuggugcccauuuaugaugcucccccuugcacauaaguggguaguuagaaaugcccagaucaauagugacagcaaaaaauauuucaaguaugggucagugaaaugauauagcccuuuuuugguuauuuugaguuaugugggauuaaacauguagcucaguuuggaagcccagagaccaaaaaaaugguucauuauuugguauuuggaaacuuuauaguaugugcguguguuggcuuggcuguauuuggcaaguaggcauuuguucuagccagcccacacuggcuucaguccugaggccucaacuggacauauauucuuaguagugaauucaaagggugcaaugcgagggacauugagaacacuuucaaaaagaaaugacuuuaugcuaaacuggcuggucuuagucaugugaccuaagaugauuuuuauagaaacauagccaguuuucuuuuuuaaaaguuuucucuguccucccuacccccuuucucccuuccuuccucccucuuuucuuuugcacuuuugagauugguugauguaaaaagucauggguuccuccccaacccuaacuggaacugcuguugcuuguugcugcuguacauuuuaggacaaaaagucuuuuaaaagcuggaaaauagaagcagacgggucucguuugcuuuggcagagggaucaacuuucccucccaaguagcucuggguaagaccuaaucuccaaaggugaucuuugaagucuuaaguuggaaguggcagcagcaacugugcauuuaaaguguucccucagucuuccuuguuauuuuugcacauuuacuuucuaggaaguaguuuacaaauggacaccagccauauuccgucuuuuucucaggucauucagagucuugcucccaggugggaucaaggggcuccugugguccuugagacucuccggaggauggcugugccaguacaaccgccucagccccuggcagcuguagaaaagcugucugaggaauucauguacuuauguucucuggccuuuggguaucugacauauguaggaagaaauaaaaagcugcacccagcuagcucuacaaacuauuuagaugaaaguugaaaagaugggcuuuuuauauuguuaauauguaggagcaccagcaucuggcagugguuucuugcugcugaauagauucuagaugggaacagaauggaggaguggaauggauuggucccuucugucaaggaagccucagagcagaucucaagugcuuugcugacacugacuuuuggugccagcauuugccuccuguuuuuuagcuccucauuucacaagucuguuccuugggugacaggcuguccauuaguaguagccaacaugcauuccucugagugggcuuccugacccagcgagcugcagcaguuuacuugggucuguuuuccaugucuggaccuguuacugacccuccagagaucaaacuaagaugauuaaggagagggaaggcugcaaaacugguguuuccuaucccucguuguucagauuggaguagcccugcuuucccucugcuuuuggacuucugcuuuuucuuugacucugauagucuugggcaaggaguagugugagaucuguucaccaaggaggcaaagugccuguccuuaggaggguugcacauuuagaacuuuggccucacugaaugccaaaaaaggugaaguagucccagaauauuagaccuuggaaagacuaacccagaccucucacuuuaaugucagugucacagaaacucagagagguuaaguggcuugcucgagagugcacauugcucaggaggauuucacaccagaaccaaaggcuuccugggggcguauucuguuccuauugacuugguuccucaggaauauacuuaggcauugauaggauguuggacauuuucuucuuggggcaccaggaccuccuuagggguaggggaauauccuggcacacaucauagcagagaacaguagugagaccagugauggaaaguggcgaguuuagagucagacugccuggauuugaauccuucuccuccauuggcugugugaccucaggcuaccucccucaagcucuauucacuuccucccucuguaaaaugaagauuauauugucuuccuuauagagucguggauuacaugugauaauucaugccaauaaauauauguaauuauuuuuacaauauuguuauuaauauacauuaauaacaugagccaaccauaucaacccucucccuccuccuuuccauuucaugcuuauagacauuuaaggaccagaauuaaaccugccuucucucugaaacuugcccauggaaagucuggcagacugguuuuauuuuccagccuuacugcuuaguaguuaagagaccuguuuccuaaucuaugaaagcugcaacaacuauuuucuugagguuguugggaggcuugaaggugaugaugaauaugaagcauguagccccaggcuccacagauacugauuucacguccccagucccucccuaccuuucuuuccguaauaguaguucacacuucucucuccuucuccugucugcauuuguacagagucucagugugaguuuguccucuguggugguucuguucuguaagacacaguugagaguaagccccuagaagacagggacuugccugguugucauuucaugaucugccuaggagaugggaacaacuuccugaucccucuuuggagcuagagcaacccagggacugcagccucugggauugcccuuugggcucagcaguggccgcuccaggccuaggaccaggcagccagccaagcccauccccaggaacagcggccagcgcuggcacaggggaggaaagagucuggaggcugaugugcagaggagggagggagaggcagagcagcugggcugagacugagggagagaagcuggaggcugaucuugguccagcagaagcugagcagagcugcugucuuuggucuuucagguaaacacucaaagcuauaaguagaaaagaaaaaaagccuagaaguugguuuccccagugcauggguuuuuuuuuuccuucuuucuucugccuuuucuuucuccacaucccuccuugucucuggcuccauucaacccauuugugucccuugcuaaugcaggagaauggucacuuauugugagcagaccugaaucgcuaugggagaucugggcuggcuccugaaaagagcacuguucuaggagaagggagacgauucugucaccaaaguugugacaauaauuauaacuauuauagaggcuaacaccaaccaaaugcuuucugugagucagguauugagcagagcauuuaccugcguuauuuauucuacccaauagugcuuugagguacaacugccucgauuuaaaguuccaugcggacaguucccauuauuuggugagauugccauggcaauggcaaugguuugucuugguuugucugagcucauccucuucaucacugcgcuucuguuuccuccauuccuaaauagacuccuugaccucaguuugucuguguuuaguuuccuguaaaauggggguaauugcuucacagagcuacauuuauauauagcuuucuuaauguauuaacaaauaccaaaugauauucaggacuaauaaugcucuguugcuguugaaaauuuggugcugggauguccagauugugcugaggcuguccacuucagagguggcagugauggggaggaggaccaacugggaaggcaguuccauuaaauuaguaacugaguggaaagcuagacauccuuucuuuugcagagaucuacagaguugggacuaaguggagaggggaaggaguuuggaacuggcugaaagccugcuccagguuagggacugggcauaaccagcaauucauuguccguugggcacagcagauacucagcuugauuuuauucaggaucaaucacaaggaaauccuguguuguggagagucugauccuccaagcauuacuggguagugguguauuugaguaggaucagugcuguggcaagauaaucgguuuuggaacaagcccugggccagugacucagugcagggauaggaaguccuggccagcugggccuguggaaucugaggccuggagcccauuguucagaugggguaaguuggggcuuccaacaggcuaaccagauacuacugagcuacuacuacuacugauacaguaacagcugucauaucaaguguuuucucugaagccauguaccuuuaaucugcaguuccucacugaauccuuucaagagcucuaucaggcagauaucauuuugcagauugaggaaauucaggcuuccauuagggucaaacaauuagccaguggcgcaguugggcguccuuuucagagcuggagcuuuuaacugugcugguggacaaaaacgucacacguuuagggcaucuggacuaauucucguuuccacgucugguggggcugagccugggugcauggugcuugccuggaucauggcagcgaguaggagauccuucuugagcaccgagcacagaccauguguucucucuccaguggcugauggugagauuugcugcucugggguugcuguggugucacuccugaacuuggggccgguccgucauguguucucucuagaugcuuugcugggggugggcucagcaaucuagccuagggguaaaugucaugguaucuugagccagaugugugaucauggguaauuuacuuuccucagccucaguuuccuuguuuuuaaaugaggcugugaugaguauaugugaguucauguccccaaaagugcuuagcauagugccuggcaccguaucaagugcucaauaauugaugacugcuauuauuagcuguuagccaucagcuagugagucuacgggagaccuucaacuuuaaaacacuugaagugcugccagccugggccauggggcugggcacugugauggagccuggggaaagcucugggagagcaaaaguauuuucccagagaaggggguagacacagaagaagguagaccacugggcaguaaucagaguaaucgggggaccauacuuaccagaucuggagauauuuucuucuggguuuagaccaccacucgccucaacacucaauggaaugggggcauuucaaagaaagagaccagaguggaagaacgauccaaccuucuggcauuugcugauugaucaucuguugaaacuaauuuucuucuccuuuuuuucaucugcuggucauguuaaaagcuuucagguuucagcugguucugcugugucagguagucaaaagauacucuuacauggagggcugguuggcucaaugggauuagggccucuuugggagccccaucuguucugucccuaccugaaggccuuggcgccaggauuuggaggaagcugcuaggaugaagcaucuguccagugggggcggggugaguggccugggguaggugggucagauggaggccaggaaauccucuuaucucgcugggugcccaugccucacucagcagcaggagcugagcaguaaacccuggugagucagcgugccugggaauuagaguugccagucugugagcaugugggguuuguguaaguuugggccuuuuguuucuuucagcauucuagucuuuaggaacacaaaucuggaaaccaggcccuccacaugguacaguccuuguuuugagauaauucagcucgcacaguugcuucccuuguaccauggucuuccaagaauuaaccccuugccauuugaaauuguaaugaguuguacuuauggcuuacuagcuguagucuuaaagcauaaaaagucuuuuaaaaaacuuacuuaggaugguuguuuuccauaccaaaagcccuuauaagagcuucaguguauuuuugaagccuaaguaaaacuacaagucuuugagggcauguuuggacauguauuuuugucauugcucucuuugcggguggagaaggggacaggccuugauaugacuaaucucuaauaacuacaggaaugauugugcucuucauuuuaaacuuacuguauacucagagcuuauccucagagagaauuccucuugaagacgacccccaauuuauccaggcacuauuuggaggaagccaaguauuuuaggcaaaguuuaaagcuccagccuuucauaaaaaacaccuucugucccacugccgguuuucaaagaucuuuuaguuuggaucauagagguccaugaaagcucccuagaccuggggaggcccgggugacugacguugacuucuguuuagugucuguuuccugcuacacuucuggcuccugguccacacuucauuaacaacguaauuucaguggcugccauuauuauagcaguuggcaaaguuuuauaaauacuaaauuguacauggauuuuccaacaaaccaguugaagguaggaauaagaguccuaaguagccagagucaucuuagagaaaucaccucgcuucuggcucagaaaugucuagcaauuuguuuaaaaaaccacuuuuaaauuauauaaauaauuaauaaaccaccaugacgaguuuguuauguaucagugcaaacuuuucuuuuucaucuagcaauuauccuaccauuuaaagauuguauuuggguaaaucuguccuucuuuuguuuuucuauuuuuuucccacuuuuuucaguuuuuucuuuuuuucugaauauccugagcauuuuuauuuauuuauuuuugguaacuuuuuuuuuuuagcuuuuauuuuagguuuggggguacaugucaagguuuguuacacagguaaacaugugucauggggguuuguuguacauauuauuucaucacccagguguuaaguccagagcccaguaauuaucuuuucugcuccucucccuccuaccacccuccacccucuacccucaaguagaccccaguuucuguuguuuccuucuuuguauucauaaguucucaucauuuagcucgcacuuuauaagugaguauuugguuuucugucccugcguuaguuugcugaggaucauagccuccagcuccauguguguucccacaaaagacaugaucucguucuuuuuuauggcugcauagcguuccgugguguauauggaccacauuuucuuuaucuuaucugucacugaugggcauuuagguugauuccaugucuuugcuauugugaauagugcugcagugaacauucgcaugcgugugucuuuguggcagaaugguuuuuauucaucuggguauaugcccaguaaugggauugcuaguucgaauguaguucugcuuuuagcucuuugaggaaucaccauacugcuuuccacgguggucgaaguaauuuacacucccaccagccguguauaaguguucccuuuucucuacaaccuaaccaucuccuguuuuuuuuuuugacuuuuuaguaauagccauucugacuggugugagaugguaucucauugugguuuugauuugcauuucucuaaugaucagugauauugagcuuuuuuucauaugcuuguuggccacauguaugucuucuuuugagaagugucuauucauguacuuugcccacuuuuuaaugggguuauuuguuuuucucuuguaaauuuaaguuccuuauagaugcuggauauuagaccuuugucagaugcauaguuugcauauuuccucuuccauucuguaggaaucucuugauaguuucauauuugcuaucucucgauaguuucuuuugcugugcagaagcucuuaaguuuaauuauuauggaucccacuugucaauuuuugcuuuuguuuugauugcuuuuggugucuuuguuaugaaaucuuugccugguucuauguccaggaugguauugccuagguugccuucuaagguuuuuauaguuugggguuuuacauuuaagucuuuaauccaucuugaguugauuuuuguauaugguguaaggaagggauccagccucagucuucugcauauggcuagccgguuaucccagcaccauuuauugaauagggagucuuuuccccauugcuuguuuuugucagcuuuguugaagaucagaugguuguagauguguggccuuauuuuugggcucuccauucuguuccauuggucugugugccuguuuuuguaccagugauuuuuucaauuuuuuuacacagggucuuugucacccagguugcaguggaguggugcuaucccagcucacugcagccuugaccugggcucaguugauccucccaccugagccucccuuguagcugggaguacaggugugcaucaccacacccaacuaauuuuuuucuauuuuucguagagacagggucuugcuaugucucccaggcuagucacaaacugcugcacucaagcuaucugcccacccaccuugccucccaaaauguugggauuacagaugugagccacugcaaccggccccaguccuucuuuuaaaguggagacaugcuucuuuggaaggcucagccuauaggcccuauaggacaaucacauuuauuguggacuuggcuugcauucuaaguacagccuugcugaggaccugggggagaagaagcuccucaguugggaaacuugguuuggaguauaggcuugguggaugguuucuauagguggauggaguagggcaaagcaagggcauuucaccuacugugugggauaggcccagaaaggaaucuggagagaucagaggcaaauuucauuuugcugcuuggcuuaggccccugcuuguagucuugacaaccucaucauuagggcauuaugagacuauuguucugaauauggccaccccuucucccuacucauccuacuuaaaaagaaaaucugagaauguuggcauuaggaauuagaagaugaacccuuccuuugugccuucuggcuuaacccagguccaaauaacuuuucuuaugugauggcaaguuggcaagacagauuuccucuggaauauuucugucagucuuugaugcauucuacauaugaaucggccucuuugaaaucuauguuaccuuaagaauuuuaggaauuucccucauugguucuccauaugugccccagccucugcgucgccaaggugaaguuacggagcuggccugugaaggggaugaugaacucagggucucucccaugguucguuguuggcucauggaaauagagcggugaaccagugugcacccuagaagguaggguccauaccccauuucccccacccagaggugauggcuuucuaauuuccuuccagguuggcuggcuccucuggcugauggcauguugagguacaugggccagcggcagcgagggcauccaauccagagggguccacucuagaggccaggccaccagcaccaugggccagugugucaccaaguguaagaaucccucaucgacccugggcagcaaaaauggagaccgugagcccagcaacaagucacauagcaggaggggugcaggccaccgugaggagcagguaccacccuguggcaagccagguggagauauccucgucaacgggaccaagaaggccgaggcugccacugaggccugccagcugccaacguccucgggagaugcugggagggaguccaaguccaaugccgaggagucuuccuugcaaagauuggaagaacuguucaggcgcuacaaggaugagcgggaagaugcaauuuuggaggaaggcauggagcgcuuuugcaaugaccuguguguugaccccacagaauuucgagugcugcucuuggcuuggaaguuccaggcugcaaccaugugcaaauucaccagguuagucacaaacacuuuaugucaccaggugagcaguggaggaaagggaacagcauugggcaguggugcccagcuaggauaggacuggguuggcuucauaggguuuuggguaaguuuuuauuuuucugaucagguucucuaaagcuugaaucuuuugagccaaguugugguuaugaugcugagaagccccucuggacucuaaggguuuaaaauauaucucucuggcucugcagcagaccuacugaauaggaaucucagcagggaaggcccaggcacuuggauuuugauagagauucaugucugguucuaauguguacgcuaugguuuuuuuuuucuuuuucuuuuucuuuuuuuuuuugcagaauaacgccuuugccuaauucauaggucaaauuucaggccuaucauagcauuauuuggcagcuucugaguaacugggcacugcucaucuuugccuuaaaugagaaauaagccagggugagccagguggccaaguugcugcucggccccacugcugucuuggaccuuucuuuucuuuuacuccuuuacaugucaguucacucacuugauauuuauuguaugcccagcaugugccaggcacugugaguaccaauauaguaagugccucuggggaggggauacaccucucucccuccaugaagccacuugcacugugaguaccaauaugguaagugccucuggggaggggauacgccucucucccuccaugaagccacuugcacugugaguaccaauaugguaagugccucuggggaggggauacgccucucucccuccaugaagccacuugcacugugaguaccaauauaguaagugccucuggggaggggauacgccucucucccuccaugaagccacuugcccuuucugguacuuagcauguugcccgcccucagccaggccuguguauaauaaggucaguuggccucaguuacuaagcaguagcugugcauauuguucuggucauaugucccuguagaaugugguuuguagagcacgggguugugaauaagaacugacugugaggccuagccauacaauuuguaguuugcaugccccccaccccaggaagguuacccuccagaccucagaggccucaccucuucagcagauacuacagucccugagaagacgaucaaugcgagaccaugcuguaagcugaaaggguuguauagauguuaaaaauacauacauaauuuuuguuuuuuaauaauagaauuuugaucucuggugguagaauuacucagguucagaauccuuggcuccagaagucucccuuggcaaucucuaaaaauauaccccaaacaaacaacccauagagaaucagaagggaaacaggaagccuccuccucuggaaggagaaagaauccgcagcuuaaucgcuauugcagagcgggaaacagggcagggagcaggagacuugaguuuagcuuugggaagaugaaugaaugaauaaaugaaccauuaucagcugccaaccgugugccaggcacuguuagaagcagaauaguaauuuguuuaguccucaccaaaacccuaugaaguaaggugguauuuuuaccauuugacaaguaaggaaauaggacuaauuaguuggaggaguuagaauucaaauucagaccaucuggccugaaagccuugcucuuaaucacuauguauauugccuguaaauaguauaguuuauaaugauuaauuguccuuuuccuuucuguugcaggaaggaguuuuuugauggcugcaaagcaauaagugcagacagcauugacggaaucugugcacgguucccuagccucuuaacagaagccaaacaagaggauaaauucaaggaucucuaccgguuuacauuucaguuuggccuggacucugaagaagggcagcggucacugcaucgggaaauagccauugcccuguggaaacuagucuuuacccagaacaauccuccgguauuggaccaauggcuaaacuuccuaacagagaaccccucggggaucaagggcaucucccgggacacuuggaacauguuccuuaacuucacucaggugauuggcccugaccucagcaacuacagugaagaugaggccuggccaagucucuuugacaccuuuguggagugggaaauggagcgaaggaaaagagaaggggaagggagaggugcacucagcucagggccugagggcuugugucccgaggagcagacuuaguggcucugucccaggagcagcagcaaggaucugccagcugcccugcagccaacugaggaauuggaccauuuuggaaauuacugaagauccggauauuuucuacuuuacaccuuucucugccuuguaucugaaagggcucuaaaaugcuguaucauguuuuaggcacuuucuucauuuuuuugguuauuuugguuauuuccuuuuuggggggaucucccagaauauuugaaccugguuacauguuguguaucuuuuuuugaagccuucagauagaauaagccugccauuucuugcacaaauuuagguuuuuuuuuuguuuuuuuuuguuuuuuuuuuuuuuuuuuugguaggggagggcauagagcagggcggggggaugggacuguuagguugaauuaacauuacaaaaugauacagugccagaucucaguuucgcauauuguuuuucagggcaggucuguacuguguguagugcuguuuacauagaugaauuuagguuguaauaauuauuuuuaaagauuuacacagauuugaauagcaguguuaacuguuaaccacauugcauuaauucccaggcgauuuagagcucuuggagagccaaggccagccaagagcauuuguagucuggugacaacccccuuuuaagcuaauuuauccagaacccugauuucccucacuucuugcucauuccuucuuugaccuauugcauuucauguugaguuuuuccaucaacaugcugcaccugucagucaagugagcauuuuuuaagaacacauuguacugagaaccacuuaagcauugaaugcggagaaagcagugcuaccucaguuuugcuggaaguagacuucuuugauaguuuucuuucuuugaugaaguuucuguauuuucauguuguaaguggaaauacuuuuuuuuguuuguuuguuucauuugccuuggagccaaaguuucuguuccugguggucgggaaacugccugccggccaacugacuugaaggaaaacugugguauggagcucugcuugaauuuuuuuuuuuuuaauauuuuuauuuuuuucuuugaauaucaucagcuuacuugucuggcaagggcagaagccugggguuggccugaacucugccaaacaaauaucaaaguguauuuaauaguuaaauuugugcccuuucccuucuugcugcacccauguugucacuuaacccccaggaguuauuuauuaucuuuuuguuaaagucaggcucauuugggguaaugugaugacuguuuagguuuacaugacccuccucuccuuucccuacccccaaauauguauauauacauauauaaaauauguauauauuuuaccuauauaaaauauauauauauacacauauauguaucuauauuccuuuguuucuuugccugcuuauacuggccauaaaagagggagcugccuucaauguauaaaguauaagaagagugccagggaaugccauaauggaggcuuuuggaucugaauuuggaccauuucacuaaagagaacaugaguuugcucagcccuuuccucacaagagggagggccccgguuccccagacuucuccacgcgcuggcuccauaaaggccagcuuuggccaggcugccacaggggccugaggagcucacucugggccuaccugguuucaguuagaggguccuccuguuauuuuuccauuuaaaaaguauguccucagaaaacuguacuggaaggauggguggcaggaacuuguauaguucagcuuccaacacuuuggaacagauuaaaaagggaaucuuuuaaauaaaaacguauaaaaauauuuauacucuugagguaaugagacuuugucuguuaaacauuuggagguuucucccuuaaccuaauaccccgcugcgucccagguauguuucucagccugggcaggaauugcauguuuugaguuccauugugagcagccuuacagcucugggcucccaucuuaaggauuauuaaagaguuuuggcaguugguauuuuucuaaaacugauauugaccauagggaacauacuuggaauuuguuuuuuuuuuuaaauccuaaaccugacaguuccuccuucagaggggcaaaugggaaacuuuaagaucacccacgguauaguacugcuagaaagcugaagggggucuugggccagaugccuggcuucuguucuagcuaaauaagacucuugaauaagucuccaggggucccagcagguucugugggaucaguuguagcuggguacccagacugagguuuuaaaaagacugcuuuuucauuaagccaguuugcaacucauuuuccccgguucuggauuggguagugguugacugagggaaaagccaggcugcucuuggccagauaaggcccuuuccaucccagaucagaguguaucagagaaagcugcacaaaagaggcaggcagcccaggacccugaguacucuggagaaacuagguuccuuccccacccuuuaagaagacauuccgugcauuagauguacuagaguggauguauuuuguuguuuuuuaaauuaacuauuuagccuccucaucccccaccaaaaaagccauuuaguuauuuuuugguuauauugauccauuugcaaaugagaagccagaaaagggagcagucagggagggacuuacaaguuccuuucaaguuugaguacuugaugcucagcaaagauuucaagcuucugcaguagcucugggccaaugcuugacucuuucaugaccacaagaaaugcaguuuuucugcaaagggauccaaggugagguguguguaggguuugaaguuauacuucugggaagugaaaagucuuguuccuuucaaccuagaaauagguuugccacuuaaugagugagcaguaagucuguguaagaggcugaaugcaugccccucagauaagccaguacacuccuugcuuagcaacagaacaucagggugauguggagaggggcaggauguggacgccacuuuggaaaucggcaacaucugagggcaacaacaaacaaguguguugggaaauaagaaauaacucaguuuugacaacuggcuuugucagcuuuugugauguuucuuuagcaguuuauuggaaagaugguaugagaugacgugcugcuucauugaauugcucuuucccccaucuuugccaaaucucaauguaucguucuuaaccccaccuccuguaaggggcuuugcuaugcuucagcugguugucucagcagcugaagugcugcccaccugugugaguuggguccaggaaaccaugucugcccuucugauaagggaagaugaaucuagagcugggugaagaucuaaauuuuaaccaaaccccugggcccaggaaaauaacaauugaaaauguacaaggcaguguuuucaauauuaaacuuccccaaggaaagcacaaacuagucuuuuuggaaagggagaaaggauuaagccacacaguauuagucuuugaagcaguacuggucucuaggggcuggugccaaaauggagucccauaguaguuacacucgauggccucauguacuauauacugugccaaauuguauuaaacagugguggggaguuacugggauaagaacuugucuaaaaguuuacaaaccaaaacagaucuguuagguuggugcaaaaguaaguuuuugccauacuuaauguauugccauuaaguauggcaaaaaccacaauuacuuuuacaccaaccuauguauuuaagaauguuugguuugccagauuccaaaugaggucuucagugcagcaaagcccaaaagguguagacucaguuaugcaauuauaagguuaaggcguagaagaaagcugcugcuagguuuuuguugcauuuuacuugacugcucugcuguuuuucuugucucucauguuugguuagcuaugacuugagcaucuugguaacugacaaaggucuuccuugggggacuugaacaucuugguaaaugacaggucuucuuggaggacuccagcaguaucuuguuuaaacgacugaaaggacuauuaagguuguugaauuguguuaauugggacucauugaggaaaugcgacauugauccuccucuuauuccacaguguguuuucugaucauauaaagaagguuccgaaccauccaucccccucagaguuuauuccccugguaagcuguaauugcauauccaguuuaaacuggacugggacugcauguuggugaggaucggcagggguuuucccccuuuucgaaagaugaaauagauucuugagcacugguugcagaagccaaaauaguucaaauagcuuugcauaaccauuggguucugcuucugauucaggugcugggcaucauguccucccuauucuucucuucuuggaaacccagccuaucucauaaauaccuacuuccgccacccauccaaccucccugcuccuuucaacacaaaucuuggauauugccaaaggaagccauucagcagcugcugggguuuuucaucccccugacaugcauacauuugcucugggagaagugucuucccucugacccugguccccagcuccgucugugcuuaauugcucuuaccuguugcacuaaugaauaugacuagguuuuaaagggggaaugugaagcaauaggcacauggggcuuggaugaauuggucccacagauauacccugccuuaagccgcugaggugaugaguccacugcucaugugacccuccaccuuuguggaucccucuugguuugugaccagugugucuguuuguugagguuguacaaacuugacaaaaguuaauacuuuuguuuguauuuucugcacuguugcacucuccaaauggccccuugaguauuuuuauugacuuguuacacacauuuuugucuuugaugucuacauuuuuuccuuuaauguuuuuuauuuggaagguuaccugcuguuggauuuaauaaauuuguuuacuugaauauugauauuucuacaaaaaaaaaaaaacagugacuuuauucuggggcaaaauuuacccacugggagcuucuaccaacaugauauugaguaacaauuuuuauucuuugaaaaacaauccagauaaguacaggauccucagacuccaaacauggguguugaccucccacauaccaagcuuaguaggguggcuuuugggggucucagugcuuagaggcaaagagcaaauaagucuucacagggccacugccuaaauagucuuaccuuugcaacugaugugaauucucaugaggaauaaaaagugaaguugagcaguauguuaaaugcaugaccccuagauuuaacaguauggcagugcauuaag

SEQ ID NO: 15380 - RNA, 3347 nt, Homo sapiens
cgaauauaucauaggacccuuagcugaacaacaggaccaaugaucccaaguucaugaaagcugucaaauuccauuauaacuacguggaccaguaggaugcuauuuaaaagaugguaugacuaacuggcuacaagaaucuuuccaauugcaauuuuuacaccguuagaccuccuucaaguagauaugccacagaauacuucaggagcuuuauucuauuguguacauauuugcugucaucaucuuguucccaaagaggaaccccgucccagcauucagacaccaugugaaaggcugaaagcaaaaaucucucagaagucuuucucuguacaauaacaugaucaaccuuccagcugaaacagguauuugaucuaaaccauaucccaugaaacugaaagcccaaaucuaaccugaacuuggcuacccucuugguuucaauuccuaucacugagacaauuucucuuugauuuuacaugccgaagagccuauuaagaaaguguuuaaguuucaaagacugacaggaaaugcucauguuugcacaucuuuauuugaauacguucucugcagguugaaacuugaggccccaagguuuaggcuuugauuuuuuuuuuuaaguuacuuauuuucacaaaugcucauguagcaugaggccccagaguacauuaacaugugcaaagauaagcagguaauuaaaaauggagcucuauaccuguuggaaggcacugugguacugcaagcuuugcaaaguaagacaucugaugauucguuccugcccacuucccacccacaugaccugccaaaauugcugccaccuaauggccaccacaaugcugucuauuaaaacccugcccuagcagcuaugcccuauuuuaagaaacaacauaaaaaauuuauaaaauaaagcagcagcaccauaaguucuuucagucaucaauaagucugaagacucaaagacaacuauggccccagaauaaacugcgugcgcucaugcacacacacacacacacacacacacacacacacacacacacacacaaauguugcauccaacaauaggggguccaugaaauuacaugcaacuuuucugaauugcguucagugucuugacuguucugcaaccaacauucaauucucucacucaaaaaccaguugcacagauauugcagcuccuucagcugcuccaguauagucaugugccuuccaggagggaaaguacaugcauuggaugcaaaaugacuagguuuguacagcccagcucuaccaacucucuagcucacacuuaaccauauuccaucucagucuucucaguugaaaacgggaacuaaaacaaaucacugugaacuaaaugacuauaugcagaagaauaaaacuagauccccucucucacacuauauacaaaaaucaaaucaaaguggauugaagauuuaaauauaagacaugaaacuaugaaacuacuagaagaaaacacuggggaaaugaucuaggacacuggucugggcaaagauuuuuuguguaagaccuuaaaagcacaggcaaccaaagcaaaaagagacaaaugggguuauaucaagcuaaaaagcuucuacacagcaaaguaaacaaucaacaaugugaagagacaauccacagaaugggaaaaaaaaucugcaaacuauccaucugacgagggauuaacagccagaauauauaaggagcucaaacaacuuaauagcaaaauaauaauaauaauaaucugauuuuuauuuuauuuauuuauuuuuuuugagacagagucucacucugucacccacgcuggagugcaguggcaugaucucggcucacugcaaccaaucaccuccgagguucaagugauucucuugccuuagccucucgaguagcugggauuacaggcgcaugccaccaggcccagcucauuuuuguauuuucaguagagacaguguuucaccauguuggccaggcuggucucaaacuccugaccucaggugauccgccugccucagccucccaaagugcugggauuacaggcucgagccacugugcccgacucuaaucugauuuuuaaaugggcaaaagaucugaauagauguuucucaaaaggagacaugaaaauagccagcagguauacgaaaaaaugcucaacaucacuaaucaucacagaaauguaaauaaaagccacaacgaaauauuaucucaccccaguuaaaaugguuaugaaaaaaaaaaaaaacagaauaaugaauggcaaggauguggaaaaaugggaacccucguauacuguugguggaaauguuaaugaguauagccacuauggaaaacaguauaaagggcccucaaaaaacugaaaauagaacuacuguaugauccagcaauugcacuacuagguauaugugcaaaggaaagaaaaucaauauacuggagagaucugcacucccauguuuauuguagcauuauucacaauagccaaaauauggaauccaccugagugcccauccauggaugaauggauaaagaaaaugugguacauauacacaauggaauauuauucagccauaaaaaaguaugaaacccugucauaggcaacacgguuggaacuagaggucauuacguuaagugaaauaaaccaagcacagaaagacaaauagcacauguucucacucaugugugagcuaaaaaaguggaucucaggaagagagagacaguuaucuucucuagguaguuaccagaggcagggaaggggagcgggaggggagaugaaaagaaguggguuaguggguacaaacagaaguaagaccuagcguuggaaaaaucaguagggugacuccagucaacaauaaucuaauguacauuucaaaauagguggaagagaauaauuuaaaugaucccggcauaaagaaaagauaaauauuuaaggugauauaauaucccaauuacccugauuugauuuuuacacauaaugugaauguaucauauuaucacaugucucaaaacuacauauauuauuuaucaauuaacaaaaaaaugggacugaguucugcgaugaaaaaaaaaaggucacggugaagaauaaauggcugcuucauaugagaugggucucaguucacgugcugacauguguuccauguucaaccaauccaaaugccacuucccucuaauucagcacaacgcuguuuuacuucuucacggcacuuacaacucugugaaauucuaauuugcugacuuauuuauugccugcucccucuaauagcaggcauuuuaccugccuuauucgccacuuuacccugugcaccuaggcuauguggcacauggcacauugauaaguaucuguagaaggaauaauagucacugauacu

SEQ ID NO: 15381 - RNA, 22930 nt, Homo sapiens
gugcaacagcagaccaaugguugggcuuaucccucucucuaauuuaugguugaagccaugguucagagagguuacuuagucacacaguaaguugccaucaugcucuauagcagugguucucaccucgggacgauggggccuuccaggggacauuuggcaauauuuugagacacaacuggaggugggggggggcgguucuuguaacuggcaucuaauggguagaggcuaggauauugcuaaacauucuacaauccacagcucagaaacagaauuauuccgccccaaaugucaauagcauacuauucagaaaccuuacucuauagggcagauuuggggccaggggaaacaggggcuccugcuccgacuuggauccaugcaaaccgaggaauuuggauugauuuaucuugucucucucagccuggacuuuuucauguguaaaauggacauccaauccaucugaaaggaucucacuggcuuaugacauucgcauuugagcagucaugguuaaaaacuuccagccagggugauacuucaucacgugugugucuugagcgccagagacguuccagagcagcugguuuuaggcauacaggaggggaaacccugacacccuuggaaaacucauucucggcugccagucugccugucuugaagguggucugagcuuucucacuccaagccagucgugugggaagggacacucucugagccucaguuuccucagcugucaaccucucagggcuuguucuaguggcuccgaaagccagugggagcgagcgcgcuuugcaaagccuugggcgccgggccuuggcgcgccuuugccggauccuuccggccacgggcggggcgagcccagaggagaagagccgaggggcggugcccgggccagggggcggaggcaggcggcucuggcucccucucgggacgcucuuuccuucuuccucuuguuccuccuccugccucucuucgcuucgccugcaaacgcggugggggcugcucggcggucaggagcaggugagagcucggagcuuggggguggggguccgggugccccggguggcuagaccccucucgccgggcggggacagaggaggagcgcgggggcgacggcgugagcgcgcuaucggggucccacgcccguagcuuucugccccgggguuaguguaaggggcgucuccugcuuaugagucgccgggacggggcugggagcgcacgaggagacacgauuccuccccaccccuaaaugcacacucaccccgccaccccccaacacacacacacauacacacacacacuaccacuagauuagguaaaaugguagcuagcaccaccacaccccgagacugugccccuuucuggggaaccuggggaagacgucgaggcaaaccucccuaggauuauugaaaacgggcgccuuccucaccacccagccccucuucuccaccgagguccccuuccccaucgcugcagagagaucugcaaguaucaaagggggcuucuuuacccccaaauuaauaacuaaguacucgacuccccucugaguucccauuauucagucucugugccuucugggacgcggacccccucuccaccugcauuucacucccuuccuccucuccuugggucucccuggcuuuugaacgcugaaaggcugggcccggauggggaggggcggccagugugagcucgaggcgcccuguagcucccaucccccaaccagagaugugaccccuccucccagcuugaacuuucgagguagccguuuuccccuggagguucgggggugggagggccaggagauuuauuuggagccuuggaaggggaaaggguuagcugguguuggccuggcccagucccccaggcgugaagaaggcggggcacuccuuggccgcgccggguucucgcuuucccuucucgggagacagcuccgugccuggggaggccccuccgaggagugagugaccagggggucugggaauugguggccagguagacgcauuugaaggcuguggccgauggcauucgccccacgcacucucucaucggacuccccaaaccggucuggguggcacuugaggcucccaggccaaaggagaccuguaaggggaacuccgcuuguuucugcuugcugcagagaugagauuaugggaacugagugcugggaacaucccaaguucaagaccuacgccagaggcagcuucaaagagagaaugugggguggugggauuaguccccuccucaacuuuccccuccaaaggguuucuuguuuuacaaaagggaaguagcagaggaugucuagcugggaugauuaaaaugugcuuuaauuugcauacuagacccuguacagcuuaguaguagauaaaauuacccccuauaugauaaauaaaugugaggaucucucaauuaauuuuggccacguggacacaaucuuuuaagcauuuguacuguaggucaggucaguuuaaagggagaaauggaaaagauaucucuguguccagccaguucugggaaauauaaaauaagaaugauuuuuuuuuuauauuugaaaacucaacaaggguuaaaaaauauaucuaauuuaaccaauugccuuuauuaaaaauaaguaaaaauuguaugagauugggacaccccucaaaauuccaggcaguuuaguuagaguauaauuacuguggugaggucugcccccgaggugcaguucuccuuagcagggauagacuuacccacaaguaaguagaugaugauguauggaaugauggaauugggagccaaccuguacaguaauaaagaagagaaacaggucaaggcuacuguuguacaaggaaagcuuucuagggagaauaaaaggcaaugagauuugaaauaguguguucagcuuucuugcuuucuguauauuuucagcauuuugucaagcuaaaaaauaaacauaagcugucagagauaauacuauuaacauuuuaucaucuuuuuuuaaaaguaucauacacaucuuuucacaucacuaaacagucacacuaucauuuuaaugacugaauuuaucauuauuuaaccaauuuucuccuaauggaaauacaguuagcuacuuuccaauguuuugcuagucauuauauguuauaaacagggaugcaaugcacagccuuuuaguacauuuugagauaccuguuggauuauuuccaucauguuccuggaauauaaauuccuggauugaagugugugcaaucugaaauuguugugaauauugccagguuacccuccgucugcaugcccaccaucaagguaugaggaugguagaagcucucgucgaaccagauggaugaagaccacuaacggcuuuuguuuccucugguaacagcaagagacagagcgacaugagagauuggaccgcgggcugcacuggagaauuuacugguaggauaauucaucccuaaagagauugaagugagcuucagaauggcaaaagaggagccccagaguaucucaagggacuugcaggaacugcagaagaagcugucucugcugauagacuccuuccagaauaacucaaaggucaguuuccaaucacuauguauaauggaaaaucccaauauaacacuagcauaaacaagauagaaaguuauuucuuucuccaguagaaggaauuuggagguaagucaagaaucuuucuggcuuaccgcccugccaugucuaugcugugaccuucaaacuccuugucugagaugacugcaagagcaucagccauuguauccaucuuucaggcaacaggauuugaggaggggggaagagagaagugcaagccaccuacaauuuaaggagacuucugggagucgcacacaauacuuccaauuacaucccuuaagccaacauugagucauuugccacuaauggcaaaugcaauucuuuagcuggauaaagaagucugugcaacagauaucauccuuuuuuugguuuuguuugguuuuguugugaauuuugcccuaucuguuacccugaaaaugagagacaaaagccuacuucaagauuugaguucauuguuccacuaggaauccagguccgauagaaauaugaugugagucacguauguaauuuagaauuuuucuaguagccacauguaagaaguaaaaagaaauagguaaaauuaauuuuggcugggcauaguggcucccgccugugauccuagcacuuugggaggcugagguggguggaucacuugagaucagaaguucgagaucagccuggcgaacaugguaaaaccccaucucuacuaaaauuaccaaaaugagcagguguggugguaaggccuguagucccagcuacucgggaggcugaggcaggagaaucacuugaacccaggaggcggagguugcagugagcugagauugugccaccgcacuccagccugggcgacagagcgagauuccgucuccaaaaaaaaaaaauuauuuuuaauaauguuuuuauucaaccuaagauaucaaaaauauuucaacauguaaucauuuauacaaaauuauuaaugaaaaaagauucuugaaacauuguaccuucuuuuuugaacucccucuucaaaaccccccgugcgcauauuuuacacuucuagcacauuucaauucgaguuagccacuuuuuagguauucaguggccacucaguggcaaugagacuucagauagcguuauguuuucuugcauauuuauccuuauugcuuucuucuauaugucuuucagcauuuugucagggaaaagaaaacagcuuucagagauaauacuguuaacauuuuguaugucauucuagaccuuuuuucuaugcaauauaccuauaaaaauacauauguauauguaacaaaaugaacuauuuugugguguauuuuuuuuuguauuggauagcacagcgggucuacucgaagagaugcuuguuugcaaucuacaacaauaaauucuggacuugcuccagaauuuauuuggcacucuuuguggauuuaccaagcuauuuuuaaauuggacaagcagcuuucucgccagcuggcggggacucuuguuauuaaaaguuagcucaguaagaaggguccuccugccuguuccacauuuacagcugauucucauuaaccaugguaguuacguucuauaaaguuacugcagacacugaauuagcacauaccaaaccaucgcuccuaggggaaauacaggauucaguugcugugagccuccuguucacaacauuuuugucagcugaucaguacauaaccucguuuuauguguauuucuguuuaaagacauguuaauauauauuguugaucauuaacguugaacucagggccaacaacaguacuaugacucaugucuuaaacaaagcuaaucacacacauguauuuucugcauaaggcacaucacagccuucucaugguuaggaacgcuagagaacacuucagcacuacacuuggggaccauuuucaacaguaaaaucaccaaacuaaagcauaaacguggcacuaaauagaccacagugacacuuguuuaaaggaugaaacaggaaggcucggugucaccuugcuugaccucagcugggaauguacguggcaggugacuccacuuuuugcuguuguggacguguccacuaaugaccucaaaagcacugcaggccaggcgugguagcucacaccuguaauccuaguacuuugggaggccgaggcggguggaucccuugagccagaaguucaagaccagccuggccaacaugaugaaaccccuucucuacgaaaaauacaaaaauuagcugggugugguggugugcgccuguaauccuagccucuugggaggcugaggcacgagaaucgcuugaacccaggaggugaagguugaagggagccaagaucacaccacuguacuccagccugggugacagagcaagacucuaucucagacaaaacaaaacaaaacaaaaagcacugccaguauucauuuugagguuacaaauaaauuucagugaggaggcaaauuuacaaauauggaaucaugaguaauaaggauugacugcauauuucuuggcacugacuguaugccaagcacugcacuaggcauucacccuggcccugucugaacuuaguuaauagucacguucaccugccuuuuuuguuuguuuguuuuuguauuuuuaguagagacgggguuucucaccauuuuggccacgcugaucuccaacuccugaccucaggcaauccacccacuucggccucccaaagugcugggauuauaggcgugagccaccgcaccuggccaccagugguuguaaaugguccugacccuucgucuuucuccuguuaggaagagauaaugaaucauugauuguuuuuugcauucugauaccagggaauuugccuggcuccugaaucauccaaguuucagucuucauguucucaaauacuggccacuuugucccuaguuuagaagccaaccgccuuugucugaccuugggcaagucacuuaggcucacugaauuuccaucuccuuuuuuaaaauuuuuuauuuauuuuuuauugagacagagucucacucugucuuccaggcuggaguauaguggugugaucauggcuuacuguagccucgaacuucuggucucaagcaacaccuccagccucagccuccugaguagcugggacuacaggugcacaccagcauacucagcuaauguuuuauuuuauuuuuuggagagacagcaucuuucacuguguugcccaggcuggucucaaacucuuggccucaagcaguccuccugccuuggccuccugaagugcugggauuacagaagugagccaccaugcccagcugccaucuccucuuuucuaaaaugagcaaugucaggcucagagguuuguuaugaagauuaucugagaugcuguuugaagcuuuagcacagaggguggcgcauaauguugucagucugucucagccuggccuuccugggcucugcagugcugcacugugcuuacagagccuagauuggguaaccugugucuaccuccaggcuggugauggaaaaucacagugcauguuacugaauaauaaccucucccacuuuccaucuuuccauugcaucccccucuguugccaugagaaugaaauguuaauugcuacguucuaccccccugaguuuaaauaguguuaggucguucuuuuuuaccuaccucguagcauuguaggaagaaauaaaugaggaaauaauacgagaggugcuuaaagcagugcccagcaccugaguguuuaaugaauguucucuguuauuauuaggugugguugaaucguguccuccccuccugggacagacuggcuggagcucagcuguacuuccugggagaagacaauuucuggguuuaaucaucugaaucuuggucucuuugcauaucuaaaugacuuucucuuugauuauagagcccagacucggaaaagacuaagaauggcggggcaugguggcugaugcuuauaauccuagcacuucgggaggccgaggcgggcagaucacuugaggucaggaguucgagacuagccuggccaacauggugaaaccccaucucuacuaaaaaauauaaauauuagcuggaaaucgccugaaccugggaagcggaaguugcagugagccgagaucaugccauugcacucuagccugggcaauagagugagauuccaucucaaaaaaacaaaaggcuaagaaaaagguggauuccuuaaggacugaaguggaacagucuugccuguuuccuuuuauaucccugugccauacagucccuaaguccuguguauuccuucuuuugucauuccacuuucauacccaucuaccccucccccuucucuucccucucugccaucagccuggacuugaccacaguauaucuugccugauuuccugcaaaucuuucuaccugccucuugcacaugauugcuagguucauauuucuuaaaucauuccuuuaaucaugucauaguucugcucaaaugacagcaguuuguucccuguuuuuuuuuucccagaugaaauuuaaaugagugcugucuagcagaaauauuaugugagccacauauauaauuuuaaguuuuuuaauaauuacauuaaaaacaaaaagaaacaaaugagauuaauuuuauuuauuuauuuaucuugagauggagucucgcucugucgcccaggcuggaguacaguggcgugaucucggcucacugcaaccucugacucccggguucaagugauucucccgccucagccucccaaguagcuaggauuacaggcacgcaccacucugccugacuaauuuuuuuguauuuuuacuagagacgggguuucaccauguugaccaggcuggucuuaagcuccagaucuuaaguaaucugcccaccucagccucccaaagugcugggauuacaggugugagccaccgugcccagccagagauuaauuuuaauaauauauucucaauuuaacacaauauauccaaaacacuauaauuucaacagguaauauaaaaaaguauuaaugagauauuuugcauuuuuuuuucuuacacuuaaagcacaucucaauucugaugccaaauuuucauuggaaauauuuaaucucuauucagauuuuauaaaacuuacaauucagcgaaauagauucacauacccaaccuauuggaaacauacuuaaaauuuuuccaacaacugaaucaagucucagcuuuaaaauuuaaauuaaauuaaauuggaaauccaggccaucagucacaggaggagcauuucaagugcugaauggcgcagguggccugugauggacagcccggggauaagcuagcaagcccaguguccuggugucccagccucacaaguuccuuccgcugcacagcccuucccucgcuggcgcagcauacucacggguguacugcugccucccuuuccuggagagcccaucugcucuccccacugugguucuuuggauuguaaagaucaggugacacagggagcaucaaauaaggaugcauguggauucgaacuggaaagaagucaggaccugagacagcgcaagggaccagcccacauucuguguggugacucccacggcuccuccgccucucuuucucuuucagcugccccaacacagcaggaucucacuggacucugaugauggaguguccaggcugggcagugcuggcuccaaggugauuccugcuacagucaucucuggcuagagaagcggaauagcaagcucuuugguggcuuuugucagaauggugggguagcaggaggcagugaggucagcgggcauuaugccguccuguggccuggcagggagugaaauuggccaugccucgagaguaauccuuaggagaccacgcugaagcccaagaccaauggcuguggcuucuuggcauggccucuuuuauuuaagcagggugcagcuugcacuuuaguuccuucagcaugaaccacaaaccccuccugccuuccaacucgcccugaaaaucccacuguuuaaaccacuuggguaaacucuucuuccuaggaggcacauguguuuuggggaccugaauuaugucuucuuuucaucuguuggccugcaaggccguagggaugaggcucaggaaggaccaguuaugauggaaggagguucuggaauaaugguuccuuucaagugaacaggaucuagaauaccaguacugaggagagagaaggcguggagccuaaggaggagagggggaaacccaucuuugcggauuugccuauggccagcucugcguuaaagcagucucccuccauugagucagaucgaaaauuccuuuuugcccggugaaggaaaauaaacuauuaacacaacauaaacuugcauuagucacaggcuguggccaacuaugguaaccagguugaugacauaaaagcauuuuuacuugaugugguggcagcuguugcaagcauuggacauucugaguccaagaccuuagguuuguuuuuuuuuuuuugaaaaggagacuugcgguggggcgcgguaucccacgccuguaaucucagcacuuugggaggccaaggcggguggaucgccugaggucaggaauucgagaccagccuggacaauauagugaaacccugucucuacuaaaaauacaaaacuuagcugggcguggugggggcgcccguaaucccagcuacucgggaggcugaggcgggagaauggcuugaacccgggaggcggagguugcagugagccgagaucuugccauugcacuccagccugggcgacaagagcaaaacuccaucucaaaaaaaaaaaaagaaagaaagaaaagaaaaggagacuugcucugucauccaggcuggagugcaauggcgccaucuuggcucacugcaaccuccgccuuccaggcucaaacgauucucgugccucagccucccuaguagcugggacuaccagcacgcgccaccaugccuggcugauuuuuguauguuuaaaagagacaggguuucaccauguuagccaggcuguucuugaacuccugaccucaggugacccgccugccuccaccucccaaagugcugggauuacagguaugagccaccaugcuggccaggccuuagcuuuuaaugcugagauuuugccacuuggaggcugugcgacucuagacaagugauuagcuuuuaaugcugagcuuagcuuuuaauagacaagugaauagacaagugauuagcuuuuaaugcuuacuaauagacaagugauuagcuuuuaaugcuuaauaaugcuuuuaauaauaaugcuuuuaauaauuauaauuauaauaaauaauauauaaauaauauaauacauauuauaauuauauacauauauaaauauaauauauuuauauaauauauaauaaugcuauaugaauauugauaacuaauauuaguauaauauaucuaauauaauuauacaauauuauaauuaugauuuuuauauuacauuacaauuauauuuuuauauauaauuauauauauauuuuuaauauuauauuauauuuuuauuuuauauauuauaauuauaaauauuuuuauauuuauauuuuuauaaauauaauuauauuuuuauauaaaauuaaauauaauuuaauuuuauauaauuauaaauauuuuuauauuuuauauuuauaauuauaauuuauauuauauauuuauauuuauauauuuauauuuauuuauauuuauauauuuaaauauuuauauuuauaguauauauaauauaauauauuauauuauauauaauuauaaacauauauaauuauuauauuauaauuauaauuauaaugcuuuuaauaguaauaauacuuuuaauaauaauagacaagugauuagcuuuuaaugcuaaucacuuuaauaaugcuuuuaauaauaauaaugcuuuuaaugcuuaauaauagacaagugauuagcuuuuaaugcugagauuuugcaacuuggaggcugugcgacucuagacaagugacuuaguucauugcuucucaaacuuuaauguguaugcacgacaccuggggaaucuuguuuaaaaggcagucugauucaucagggccugagauucugcauuuccuuuuuuuuuccccuuuuucuggagacaagaucucccucuguugcccaggcuggaaugcaguggugcaauccauaguucacugcaaccucaaacuccugggcuccagugauccucccaccucagccucccaaguagcuaggacuguggguaugugcugcuaugccaagcuaguuuuuaaauuuuuuguagagauggaaucuugcuguguuguccaggcuggucucaaacuccuggccucaagcaaucuuccugccucgacuucccauaaugcugggauuacagaugugagccaccacgcccagccagauucuguauuucuaacaaacuccuagaugauccaaguagcuaagccuauuugugucugaguggcuucaacuaugagaaccucagcuguaaaguaggaggcagaugguauguaccuuacaucaaugcaccuuuaugccgaagaggucuucucaagaguguguuuggcaggagagccaugacugggucuuuccuccuuucacaaggcuugaccuuggguggggaccucagacuugccaccucuccacagcugccuaagauagcugccugggugacucaugucuugggagaagucuuguuguagugacuuuuuuuuuuuuuuugagacggaguuucgcucuuguuauucuuauuaucauuuuugagauggagucuugcucugucucccaggcuggcgugcaauggugugaccuuggcucacugcaaccucugccucccaggcuggagugcaauggugcaaccuuggcucacugcaaccucugucucccagguucaagcaauucuccugccucagccuccccaguagcuaggauuacaggcacacaccaccgugccuggcuaauuuuguauuuuuaguagagacggggguuucaucauguuggucaggcuggucucaagcucccaaccucaggugauccgcucgccuuggccucccaaaguguugggauuacagacaugagccacugcacccggccuguagugacuuguuaaugcauaagccuucuggcuuuacgacuucugccuuguaauucccacagcuugggcagauucauucaaccugggguuccgauguguuacuuaucccuggcucuuuguccuuugccuacaggugguggccuuuaugaagucuccagugggucaguacuuggacagccauccguuucuggccuucaccuugcugguguucauugucaugucggccguuccuguuggauucuuccugcucaucguggugcuuaccacccuggcugcucugcugggggucauaauauuggaagguagccuguuccgucauucaccccuuuagaaaauaauucaauugggagaaaaauacuuuuggggccauuuaaaaauuuuuuuaaggggcggggucuuguuauguugcccaggcuggucucaaacuccugggcucaagugauccucccacgucggccugccaaagugcugggauuauggccaugggcuaccaugccugguugucugccauucuugucaaaaucacaucaagcaaggcaacuuaucagaguagguaaaacauagacucuggagccugcauucaaaucccaccuccaccacugugauuuggggcaagugguuuaccucucugagccuuaaauucuuaauauguaaaaugcagauauaauaauacaaucucaaaagguuguugugaagauugaaacuuauggcuccauaaaguccuuagcacaauacacaauacaugucacagaguagcuucucaaugaaugcuagcuauuauuauuaagcagagaggccauucauuccacagugaguuauugggcaccuacugcaugccagaugccucgcuagguacuggagaccaccuucauccuuccuccugaaguuccacuaccaacagucaacuucucccuguauuccuaaguuaaaauuacugggaaagcaaaucugauuugcucacuuugacuuuucaaaucagaucacacaccccaggcaaguggccaaagagaugguggccagugggucaggugaucacuucugguccauuccguggcuucccagagcuaagagcacccagggcuguuuauuugccccagggacaaggcaguuuacacuugaaggagaaaguaggcauggucaguggaugagccaaauacagccuggcagagugguuuuugaguaaauguugauagauagaugggugaaugcaugaaugaauggauggaggaaugaaugaguaccauaagaaaggaaauuuauagagaaaggagagagccauuacauuuuggugguaccaugcaaagcuuuacagcagacaagacuuuaaggaugcauaacaacuuugccucagggugggcaaggaagggccuuuuggacaggggaacagcaugugcaaagccucuagaauagugguucuugaaccugaguguauuuaaaucuuuuuuuuuuuucuagauggaaucuuacucugucgcccagccuggaauacaguggcaugaucucaacucacugcaaccucugccacccagguucaagaaauucuccugccucagccucccaaguaguugggauuacaggcaugccccaccaugcccgacuaauuuuuguauuuuugguagagauaggguuucgccauguuggccaggauggucuugagcucccgaccucaagugaucugcccaccucggccucccaaagugcugggauuacaggugugagccacugcacccagcuccaaguguguauaaaucuuacuuucuuuaucaaaauacagacuuuggaucuuuugagaccaggaguucaagaccacucugggcaacauagcgagauucccuccaucucuuuaaaaaaaaaaaaaaagaggccggacacaguggcucaugccuguaaucccaacacugggaggcugaggagggcagaucacuggaggucaggaguucgcgaccagccuggccaacauggugaaaccccaucucuacuaaaaauacaaaaaauuagccgggcaugguggugggcaccuguaucccagcuacuugggaggcugagacaguagaaucacuugagccugggagguggagguugcagugagccaagauugcaccauugcauuccacccugggugauaagagugagacucugucucaaaaaaaagaaaagaaaagaaaaaagaaagaaagaaagaaaaaaguggugugugucuguagucccagcuacucagaaggcugaggugacgggaucgcuugagcccaggcaguugaggcuguagugagcuaugaucaugccacugcacuccagccugggcaacagagcaagacucugucucuuaaaaaaagaaaaaagagaaagaaaaugcagacuuccaggccucauccagagaguguuguuuuaguaggucuggagugggguuuagaaaucugaauuuuucacgagcuuccuugaugcaccugauucugaugcaggugguuggcaccacacuuugaaaaacgcugaucuaaaauuuugcgaaucuuuaugaacaggcagcacaccuguugauguucucuuccuuccagccuuuucagggucccucccugaaaccaucacuguggcugugggaggagcacugggcuaacuggccacucacaaagcaaagggaaggaugucagccauacaauacuugccauguuacuuguucuucaugaucuuuuccuucuaccuuuuauucuuuucccccccacaggccccacauuaugaaaaaauguauuuuccuugcacguauuagaugguaauucauuaauauuccuauucagagugggaaugguauauuaaaauggcauauaaaaugcuccauaaaaaugaccaaucagaccuuaagauuaaaaugugaugguuuacaggcuggauuuucaaggaugccaucaaaagcugcauuuagauuuugcuuuagccugcaugaccuuuauaccuauagcuuguagguaagaguaaauaauggcauuuauuaugcacuuugagacauuagagauaauuuaccucccccaguacugccuuggcugacuccucgaggggaucccuuuggaaguccaucucugaccuugaggguaagggaaucucaaacuccagcacuuaugggcaagacaaaaugagcaggcugguugugguggcucacgccuguaaucgcagcaccuugggaggccaaggcagguggaucacuugaggucaggaguucaagaccagccuggccaacauagugaaaccccaucuccucuaaaaauauaaaaauuagcugggcguaguggcaggcaccuguaaucucagcucgucaggaggcugaagccgggaaucacuugaaccugggaggcggagguugcagugagcugagauugcgccacugcacuccagccugggaggcagagcaagacugucucaaaaaagaaaaaaaaaaagacaaaaugagcaaagcagcccaugugugaugcaguuugggaauuggggggacuggaggcaacgggagggccagccaguuguugccaugguuugaugcccacucagguacccauaucgccuccuuuuuuuaagugaugcuagaaaucuggguuuuugugggaaaucuucuuacuuuaauaaucugaguuagcgguuguuauuuuaaacagacugacccagggucugccaguuuucaaccuguuugagaugaacccuucuccuaaccacguucuccuccuaggauuggucaucucuguggguggcuucucacugcucugcauccucugugguuugggcuucguaucacucgccaugucggggaugaugauagcaucuuauguaguggucuccagccucaucagcugcugguuuucucccagguaaauacauguccaugaaauaauuuauuuuuuuaaucuuucuacuuuuuuguuuuuuugagacaaggccucacucugucacucaggcuggagugcaguggcaugaacauagcucgcuacagccucaaccuccaaggcucaagcaguucuccugcuucagccucccaaguagcuggggcuacaggugcaugccaucaugcccggcuaauuuuaauauuuuuuauuuuuuguagagacagggucuugcuauguugcccaggcuguucucuaauuccugggcucaagcaauccuccugccuccaccucccaaagugcagggacuacaggcaugagccaccacaccuugcugaguaauuuaaucuuugccacuugaggggauuuucacaaauaaaaccauaauccuaguugauguccagaaggaaacuuguaagacccagguguuucucauaguuccccauguaugccaggcaucaggugggaauuuaccauggaauuuuaaacaaagcaauugcugucauuuuccaucacguauacacauuucauugucauagcaacucuaucaguauuauugauuccuuuuaaaagauguccauuuaauuuacaaaugucaaauuaggugguuuucuuuggcgggguggggcagagaggcacaggagaaaaaugacccacgagacaugucugucacccaaagcgguacaguaugggagccgugaaucuucuguccccaaagucugucaauccccucugcucuugagaaugugaguuucucaccaacugagugugagccucauguuugaauauauagauuuuuguuccuacaauauggcucuucaaugccagcuacuucaucuggggccuugagugaaagaacagcgaucuacuuaaaugcuggagggaaaagccagcuauguuggcauuacugagagacucuguguuugucuacaaugugccacccaccuaagggauuuucaaaggagauuuauuuuaaugcuuuauuuuuguccuuuguguugauuuuagaaucuaagucccaaguucaucauacuucauuuaagcuccugcuaaauugaugauagugcuacugagcacuugcucugugccagggacucucuuaaacacuuuccaggccuuaugucauguaauccuuaacaauuuagccccuuucuauuauaaggaaaauuaagccaagucccuuaagcugagaguagcacagaagggacuuaauuccaggugaguuaauuccaaagcccucuuaaucaagauacaaagugacucucuaaaacaggaguuggcaauuucuggaaagggccagacaggaaguauuuaguaaguaauauagucucuacuggaauuucuggaaagggccagauaguaaguauuuaguaaauaauauagucucuacugcaguuagucaacucuguugccguagcaugaaggcagcacagaccaggaaguaaaugcaugggcauggcuguguuccaguaaaacuuuauuuacaaagacaggcagcuugcuggauuuggccaaccauugcucuauaagaacugauauccugaguuuuguuuuucuacaaaacagcccuugaacuccuuaccaaaaguuuauccuguuauuauuccuauguugaaaaauaaagggugaaguggguauaauauaaaauugcucaaggauggcucuuauaggauugcuuaauugaaucaacccuggagucauaaucaccuuuucaaaaaucgcuuugaucacucuuagucuuuuguuuguucauuuguauuuuacuuauaaaauggggucuugcuguguugcccaggccauucucaaacuccuggcuucaagcaauccucccccguuggccucucaaugaacuggaauuauaggcguaaggcacuaacucacucccagucuuaaaagauguaaaaggagaaauauuggccuauuuugcauauugagggugaugcuucugaaauaaaauuccucccugccucugaacgcugcuguaacagggugaguucuuaaagauuauaccacaggaaguagcagaaucugacucccuacuuaucaaugaagaaauugaaaaacaaauccaggauuuguacuugaucuccuuaucuuccccuauugcugccaaccaauuguuuccacgugggcagagguucuuaagcuuuuuguucucaagucccauuuuaccuucuuaaaaauuauugaggcaucugaagagauguuauuuaugugguuaauuguauuaauagcacuuugggaggccaaggagggaagaucacuugaggccagggguuuaagaccaaccuaggcaacauggcaagaccacaucucuacaaaaaauacaaaaauuagccaacugugguggugcgugccuguagucccagcuacucaggaggcugagaugggaggaucauuugggcccaggaguucaaggcugcagugagcugugaucacaccauugcacuccagccugggcaacagagcaagacccugucucaaaaaacaaaugaaaugagcugaaauauaaaauaaauaacuaacaugacauaaaacuauauacaauaaaauaaauuaaaauaaacauaacauaaauuacauuaaaucaaauuaaauauuagcuggugcaugcuuguggucccagcuacucaagaggcugaggagggaggauggccugagccugggagguugggggugcagugagcuaugauuguaccacugcacuccagccugggugacagagcuagacucugucuggaaaaaaaaaaaaaaagaauauuaauaauuauuucuuuuuaaaaaauuuucuuccucauuguuucuuguucugaaauaauuauucuaugagaaaucauagcauaaauuuuaaaaauaucuauucauuuaaaaggaacaauauuaccuguugauauaaauaacaaauuuuaaugaaaaguaacuauauuuuccaaaacaaaaugaaauuugugagugguauuauuuuacauuuuacagaucucuuucauaucugccuuaacaguugucagccggcuucucguuuguguggcugcauucauucuguugugcuauguuguccuguuuggaguauuugaagaagaccuagcaucacuaacaugcgguugggagagggaggcaaagcuuuuuuaaacgauuguggauauucuaugauaguccaccaaaacuccguaagugauaguuucuuaaagguuagcugaaaugugaaauuuuucuacucuauuuuauugaaaucuucaggucugugucacacuuuaaauugaucuuuaucaugcaugauuuucuaacuuuacccauuggucaaugggagaauaucaauucauugagucaugcagaucuuccaaauauauuuugaaaaauugcacuguucccuugugagagaaugugagugaaaaaggcauauaauaggucauguuauugugaacaugguuuucaucugagaacccuugcauuagcgaauucuuuuuuuuuuuuuuuuuuuugagacgagucucacucucacccaggcuggagugcaguggcuugaucuugguucacacaaccucucccuucuggguucaagcaguucuucugucucagccucccgaguagcugggauuauaggugugcaccaccaugcauggcuaauuuuuguguuuuuaguagaggugggguuucaccauguuggccaggcuggucuugaacuccugagcucaagugauccacccaccucagccucccaagaugcugggauuauagguguaagccacuguacccagccugcauuagugaauucuuuauaacucaaaaaaagauaacucccucauuaaaugaucgaaagcauggaauggggggaagaggagcuauauaauuuauuucaugauuuaauggaauuuuggcccuaaaacauaaaagauaauacagcuuaaauuuuuaaaaaagaaaagaaaaaggaaacaaaacuguaaguuucccuuacauaugaaacccaacuaaacaauauuuagaucaaauacacugaccugccuccuauguagaucagcuagccucugaggggcaaaaccacacugcuugguuauggagacugcaagaccuuccagggccugcagcucaggagaaguaggggcccugggcagcuguguuuauuugcagagccaccaaacucacuaccccauaucauaaucuuccaaaccagccugagcauaacuagcuuccuuacaucuuuacuaagaaaaggaaaggcuucuuucuuaguuuuuuguuaucagggaggaaugguuuagguggcaaauaaugaaaaaaaccaaaguagauacuaguuuaaacacacagggaacuuuuuuuuauugcuuaaugaaaaacuggagacagcccagggcuggugcagccagugugguaucaacauaccaggcaccuuuugccuuccuguguugcuauccuuagcccauugguuuccuaccuuauggccacaagauagcugcugcagcuccagaucuaccagcuaccuucaaggcagcagaaaaggagaaaaaaauggagucugacccuuuuaaaaaugugaauaaaauauuucccaggaccucucaccacuauacuucaaaagacuucauugacuagaacuuugucagauggccgcugguugcuguucuccugauuguaggucucacgagaucugaugguuuuauaaagggcauuuccccugcacaugcucucuugccugccgccauguaagaagugccucugaucuuccuuugccuuccaccaugauugugaggccuccccagccauguggaauugugaguccaugaaaccucuuuuucuuuauaaauuacccagucucaggucuuuauuagcaacauaagaacggacuaauacaauccucccccgaacuccuuuccauggaaggugucaagaaacuaauugaaaucagaagauauggucugaauccccgcccugccauguuuucagcuguguggucuugaacgggcugcuugacuucucugauuucaguuuuuguccauugguaaaauagacaaaauggcuacucuuaaucuaccauucucacuggguuguugugaggacacagauaauuaagaaaaacauaauaaauauccaaauuagaaaauggaaaaggggccguaacccuacuccuaaccuggucauuuuaaccuccugugcccucaguuucuucaucuguauaauggacauaggccuggugugguugcaagaagcagcuaaaaaucaggaaaaagaacaucauguauucagcuaugcacacuuccaacguugcucuuuacugaggcccuagagcuaacgaucucuucuuguuauccgacaggccacugacacagcaaaacaccaguugugacuuucugccagccaugaagucugcagaauucgaggggcuuuaccaggaaugagugacugcucagaggccgggcuucuuuucaaguacugcuggaucauacucaccccuugggauuauggcuuagaagaagggggcuggguaggcaagcacuccuuggcuguguccucucgcuuuuucacuuacuuguaggaucccgcagcagccaauuuagggauuguguuguucuuguguugguucccauguaaagaagcagcagagaaaugcgaugguucaacagcucgcccugccccaaguaugcagacuugaccuuggcgggguccugggcuucuagagucuagcccguugaccccaaagccucagggcuuauguccaacggucccauugggagcaacagugauuguuuauaguuuuuuguuuucagaaaugagggcagcuguuaauuuuuucacucaugugaaacaaaaugaaaaaaaaaauccaaaacagaacaagcccuucugugguauuugcuuuuuaucagaaagaacagcaacauuuggccucuccaaguuggaaaauagaguccaaauguaacuuuguggccaagaguauuuucaaaaaagucuaaagguguaguuuccacuguaacuguugaguacuguuaaguacuguuaaucuuuuacauauuugcacuugguacuguuguauuguucuaaagagcuuguccuuuaaguaauuucuuucuuuuuuuuuuuuuuuuuuuuuugugacggaguuucccucuuguugcccaggcuggagugcaauggugcagucucggcucacugcaaccuccaacucccagguucaagugagucucgugccucagccucccaaguagcugggauuacaggcacccgccaccgugcccggcuaguuuuuuuuuguauuuuuuuuaguacagaugggguuucaccauguuggucaggcuagucucaaacuccugaccucaggugcuccaccugccuuggccucccaaagugcugggauuacaggcgugagccacugugcccagccuaagccauuucuuaaaauaaaaaugcuaaaggacuaguaaguaaaaauaaaacuuccuaugggauuucccaguggaauuacugagugguuuauuugcguggcauuucauuaaauauuuauuug

SEQ ID NO: 15382 - RNA, 541 nt, Homo sapiens
uuacggucugcugcauauuuacugccuugaacuggaacaccaccaggaccuguaacauuugcugccuucgcacccuuuucuccuucaacaacaucaaacuccacagucucuccaucuccuacacugcgaagguacuuccugggguuauucuucuucauggcagugugguguacaaauacaucuuccuuggugucguuccuguggaugaaaccauauccguuccuuacauugaaccauuuuaccguucccaaaaccuucguugcgaugaccuuuuugugcccgccggcaggcgccgccgaugugaggccgcccgggccaccgcucccugcgccgcugccgguagugccgggcuuggugucggcggcgcugagggcgggggcggcgggcggcugcugggucucggccucgcugcucaugguugcggugauggugacugcggccggcugcggcagcugcggcuccucccggggugugacgguaacuaggccggcggcggcgguggggcugcucagggcucucugggguccgcucuccgcucccg

SEQ ID NO: 15383 - RNA, 4003 nt, Homo sapiens
uuuuuguuauugcagauaaugcugcugugaacuuaggccuuggauaacaaaaacuucucaaaugucauaauaaccugacauucuaacugaagcguaucaacuauuaaaggaauuccuauuuucaaaagcacugugguuaaauaauaguggcauucucuacguuuagagaaggaaacuaacaguaaauucauguguuaugugcuuucccauaugucaucuuaauccucuaccugugaaguacagggugguguuuuauagacuacaaaaccaaggaucaaaaggcugaacaccuuacuccagguucuguaacuagcaacuggugaaucuggguuucacagccaggcucccugacuucagaucuaggacuccugcuguccugcauugccaguguggcugaucuaaagggaauaaaaauaacuugucccgcuugcaugauuccuuggcucaaacaugagcagcuaaaucuaugguuugcuucuucuggauguggaaugcaaacaaccauaaaagguggucccuauuuagaaacacuuuccacuuuguugagagaaaaaaaaaaaaaaguaagaaaaaccucccacuuauuaaguuguuugugucaaaucuuccaucauuccccucucauuguugagcuuucucuuuguaaucauuguucacugguuuuuggguuugguuugguuuuuggcugcucacugcagccucgaccuccugggccaccaucuucccaccucagcuucccaaguagcugggaccacaggcacgcaccaccauuucuggcuaauuuuaaaauuuuuuguagagauggggucucacuuuguugcccagacugguccugaacuccuggccucaagcaguccuccagccucgaccuccaaagugcugggauuacaggcaugagccaccaugccccagccuguugguauuuuauagugccgacuuccuugauggaugaagcuagaugagggcauugauuuuacuggggcccuuucaggauuccagcacccagggaaauuuucccaaaccagcugcuccucaccccuacucccaaagcacuuaaaacucaacuggaucccuucuacuggacugguaggaauuuacugguuauuggaguacucuaaguugugcagagguucgugguucaaacauuuggaagucccucaccccaccccaccccccgccaccacccacuaguugaucaucugucuacauguuacugcugagacaucaguugucccaggcuaaaugaggcaguaguuuuacuguguucgucucacacuuggggaaugacaaacuuuggugagcuaggaacuccugugucuggacucuucccugaaugcaccaaggacccacuuucucuuagauauugccaucuuaccaaaguauugccaccaaacauggaacaaguuucuacucccucugauuuuuagaucucugauuuuuuuuuuaaucugucugggagaauaucaucuccccuuuggcuuuccugagaggcauguuugccuaauaccauggucccuuugguuucaaaaaaaaaggcucuuucuuuuuggaaaaucguuccuuuccuaccuucgggccaugugguuucauggggccaauuucacguucuggcuucagagcucgacagaagccagacuuggacagagucauggugacagauucagaaauuagcauggcaugugacuagccugggacuuugcuggaauagaguugcuaaguuguaaggaaaaguuugguacugcuggcagccacaccugaagagccuccugaucaagccauccuagaagaaaggaagcugagaaaggaagacaguucuguuaacaucacuuuagcuuuuggaucaagucaucccugaagccagaacuaucucuggauucuuguguuauuuaagcaaauaaauucuuuuuuuuccuuaaaccaguuugaguuggguuucuaucucuuuuaacugaaauaagcuuuacacucccacuuuccucaugacauuaaacacauuccucaccuccccugcuuuggcaugucacuuuaaucuuuucguuagcuuaggcuuuuacaaaagacagaaaaaacaguuacuucaggcuacugcuucucaacacaacccaaagcaccugcuccugguuugaaaugggggaaagaaagaaaacaaaacaaauuaauaucugaaauauauaucccaccauauuccuggaugggaccacgcuagagcuccuaaauaaaagaccagagaugagcugacccugauccauuuccaagagccuaagguaggagaaaugucuguugugcucugaugcuuuccauggaugccaucaugaucugcaucccgaagggagccaagaaagaugguacccacacagcuuuccucuugaugagucauacagucugaaagccuuacucugcuuuauccaccuggcagagaucuauugagaauguguguuguguaggcucaaguacaagaaagcaggaacaaagaguuuccaguguuggacuuuacuucuaugcacaguguugaaaacccauguaugcaggaagcaaagaaaggugugagggugguagacgaccugcuuggggcucccgugccuaaaaaaaaaaaaauguugucaaaauuagccagccccuuccacccaaaauuuccaucaagaugggcacaaggacccucaucucuuguucaccgaguagccauugguugcucacagccacuuaugaccuucuuaccucuuucugaucuuccucauuuucugccuuauuggugcuggccacauaacaaaugcuguggucuuauacauggugcucucaaccccagugaccagugguugauaaggaguuucuauuuugagcacguugguuguuucugaccuggccuauaggcauggcugcuggggucaacaucugaaggguguucccuaccauaugaugacuaccacaaguggcauauguucuuuauuuuugagacagggucuugcucuguagcccaggcuggagugcaguggugcgaucauagcucgcuguagccuugaacucuugggcucaagcgauccucccaccucagccuuccaaguagcugggacuacaagcacaagccacuguaccugacuaauuuuuauuuuauuuuauuuuuguagagacagagucucacuguguugcccaagcugaucucaaauuccuggccucaagcaguccucccgccucagccucccaaagugcugggauuacagacaugagccaccacccaaccucauguucuaacugauaaaacuuacaaguuuauaaaacuuauaaaauucucagaaagugaaaacugauuugagaaaugaccuggauaugaaaaacuaaguacagauccuuuagcgacuuacaaguugguugacuuuggugacaucacuuugucucucuugaccacuauaaaagaaggguuuggagagauucccagcuaugggccaaggacuaguuacaucauaaucaccuggggccauuguuaaaaagucacauucccacaccuuuucacaguucugaaucaaucuccugaaugggaauguuuuccuagcaaacaauccaggugauucucaugggcauccgggcuuaggaaccacuguggcagaugaucucuucugaugcgaagaggucacugagcuuggcuguguuagccagguuuagguggggcuggaccggguagggauaggggacugucugaccucucccagggacuguguucagggaacccaagggaaucugagaaggaagagaaaguuaccaccuuugacacauguggcagaguucucuggaaccucuccucuguuccuaccacaggaaggccacaggcacgcaccagggcuguacuggccuaaaccauaguucugugcugacugagagguucugaaauuagaaaagaggucuaaauccugcuuccagguuuuugugagguggagaaaagcagagugaccugggagaagugguuaucaacaacacagcuggugacuucuucccuggggugaggaagguuuuc

SEQ ID NO: 15384 - RNA, 28701 nt, Homo sapiens
ccggggaggguucugccaaagugccacguugggcccggcggcggcgugaagacuggcggcugcgugagacuccggcuccaggcguucgcaccguaaugcccggccguuggggccgucgguaggcgcgaggcgagucgaggcagccggccggucggcggccgccggcgggaacggggcugaggcggcgcagcggagucugggcggcggcgcgucccgcccgagggcggcucuggcugagggcggaggggccggggaagagcccggggcagcggcugaggcgggacggcggcgggggccgcugccccuagaagacccagccgagaugcuggcggaaaaccugguagaggaguuugagaugaaggaggacgagccgugguacgaccaccaggaccuccagcaaggugagggcgggggcgccccgcgggcgggcggcggccuggcccgggaggcccccgcugcgaaacuguuaaaaaguugcuuuuuguggcggcggaggaugcaggugccgggaagggcucaggcucaccuggcggcugggccggccgugcccgcggaucccgcccgcaggaagccucggcacggggcccacggccuugcuaaugcgcaguugaauaucagccccgaggcgcgugggggccagggacgagccaggcaccguuuuaagcgcuuuccguggauuagcuaguuuaauccucacugcauuccuccgaggcagacccgggugagccagugugucccgcaguaaguggcauagcccgagaagccgccccgucgcaggcugucuagcccagcgccuuucauggccagcguggagggccggcugcugcaggugguaguuguuuugcggcguagcgggagcugugcgcuccgcaccguaacuccaggagacaguaacuuuuuaaaaauuaauguuugaggguacaugguagguguauauauuugugggguacaugagauguuuggauacaggcacgcagugugaaauaagcacgugauggagaacggggcguccaucccagcauuuauccauugagguacaaacaauccaauuacacacuuuuguuaucccauuuuccauaugaggaaagcggagauuaaaacgguaaaguggcuugccuaaagcuaagugugggagggaguguuuuuugaacccacacacucagaagaagaguuguagucacugcucaaaccccaucucuuccuuaccauccuaguuuacaguuuuuuucaguugggcguuaagcuguuaggcauaguucaccagaugccaauugaaacgacagaagaaagagcgcaucuaucucugccacuuuucuucaguuugcacgccagcuuucacuuagaaacaggccugccgauggugucuccagagaacaaucguagaguagcccacucuuuggggccaguggggccccuguuuuucuuauacuaauagcaggagcuagcaguuggggaacacuuuuuaugugccuaacacugauaggcccauaacacaguugcucauuuaauucucccaguaacacaauagagguaguaauguuggggagugcuaggguucuccuuaagacuccagagcaaacguucuuaaccgcuauacugaguacugaacaauccucaggaauuuuuccaggcaucuucaguuucugcaauucuguguaaaugcucucagcucuaaucuugcaaugaaaauuaacaucucauuuaguugaauauuaaaugaucauguugcuuguucaugcuaaccacugaacauggcagaagaaaagaauguagaccugaauaacucagaaaaggaaaauaaaaugagcaccucuuuuggaggaagauaauuucuuaaauuaacaugcaaucacuuuaaccaaaguaauucaccuuuauuacacuuacagaguccaagcuacuuagugguugcagugcaguguuuggcaccaucuucuuuauguccaagagacaaauuuauuauacauauuaacaaaccuguuuucagauuuccccguaaggauugauggccuaguuugauaguuucuccaggauuugugaggcaaccacuguaccacugcaguacuucccuauaauuuaauuuguaucaucacaacuaaauauuucucuuuccuguauuuaagaagcauuaaucuuuaagggcauagagggggcagguucuuuuuucuuguguuuccagcaucuagcauaauacuuggcacauacuggaagcucgauuuuaauauuuguugaacugcacugaagcacucgcacagaauuguuuucauggcucucuuccaucaggugccuuaguccacgcugcauucucccgcugugggagguuguuaggaacaacagcuguaacacuucaaucuaccgagcagcaagugcaacgugucaggguuacacgaggaauucucuuuaaccucugaucaaaauaaagucaucagcucuucaaguuuaaccuuaaaaacacaggucugggcugggcgcagugacucaugccuguaauccuagcacuuugggaggccgaggcgggcauauaaccugaggccaggaauucgagaccagccuggccaacauggugaaacuccaucuccacuaaaaauacaaaauuaggugggugugguggcaggccccuguaaucccagcuacucgggaggcugaggcaggagaauugcuugaaacugggaggcggaguugcagugagcugagaucgugcuauugcacuccagccuggaugacaagaacgaaacucccucucaaaacacacacacacacacacacacacacacacacacacauaucugaaccucuuuacugccaguugcauuucuguguuuuucaaagggcuguuacguuaucacaguggacuuugacuuaacccucugugucauaaccaacuauauggaguacgaguagaagaugugaaauuccaacaauuguaacuugugaauauggccugucaaagaauaaaggcuacagugugaauaaaaggguauccuuuccccaguuuugcuaaguuauauguuaacuccuaaacuuuuaacagauuuuaaaacuuguucauuucucaaaaauguauuaucugcucuuugccagguauucgccugggcccuggggccacagcaccuccccacaugaguggauagguaggauuccuacucccauagagugaauguuccaggaaucuguucacuagagaagccuggaggugccgccucaugggaugugcccacuacagcgccucguacauuguaggcccucaguagacacuugcugcugaauuaaguuugggagcaggucuguccuguuaaacagauuauucagcaagucuagugggauuuuaugugcaggcaucuguccguuuuuuaacauccucauuauuauuacugagcaaggcuuauuuggagagaacugcuuaaaacuuuuuuuuuuuuuuugagguggagucucgcucuguccccaggcuggagugcaguggcacgcucuuggcucacugcaaucuccgccucccgcguucaagccauuuuccugccucagccucccaaguagcugggauuacagacacgugccaccacacccagcuaauuuuuguauuuuuaguagagacgggguuuccccauguuagccaggauggucucaaucuccugaccucgugauuuacccgccucggccucccaaagugcugggauuacaggcgugaaccaccgcaccuggcuggaaaacaacuuuuaaugauccuguucucaguaucuuacaacuauagaauguuuuccuuuagcaguaguaagccaugcucugaauagauugaaucuuuguaucaaaguuuccuaggguauccguuuuuaaauugaaauugcuggaaauuucuaaccucaguaaacucuggucuacuauucauaccuuguuagaaacauguaaagcuuuuguguaggcaggaggagaaaacccuuugcuguuacaaaacucuuugaugaagagacugucuuuugucagagagcugaguuggcucaguaggaauacugacaauaaucucuguggguaagaucuuuucugggacagcaggagccuucagugcagguaaugauggugcuugcuuugaaacaugccccugagaacaagguggaaagacuucagagacuggauuuucuuuuaaaccagcugcuauugucauuuggugagcugugcaaacuuagaauaaggauucagguuucuguuauguggaucaguaaaugaacucuuaguuuaaaggaauccuaaaauugcaggaugaguacauccuccuuguguacaacuauuuugcugaaucacuguuuggaggguuauuaaaacugacaacaucauuuuucuugauauuuauauucagguuuucugcuuucccaauuauaguaacauuggcaacaggaguuaaacagaagcaucacuaaaugacgcauuugacuuuguaauaggaaaaacuuucagccuuacuguuagugaauuacuccuacagacuacagcugccaguacuaauuuuuugccuaaagcauagagcugaguaucuguuuaaagcuaacaguuuacaccauuaaaaauauauuauuaccugcaaagacucauuagugaaagaauauucaacauaugaagguauugauauguugaaauucucaagccugcaauaaaucuacaguauuuuuaguaguugccuaaaccaggccaguucaauaggauuuagagaagacccucuuaaugaaaauucauuuuguaauccuguagagaugaacagguguauaaggcuucgaaacuauauuauuuccuuuucuuuugugccuuaauuaaaacuauaagggacauucaauauucuauucccuccacuaauuauuuagaaaacuuucuugggcuuacugccagcuuuuggccucuuuugguuauggaagccagcugcuacucaacaggaaaugaacuuuuuuuaaagacaaaguccggugucuuuaagcuaacagaugaaguaauauccuguuauacagugugacuucacaggagcuuucuuguaguugggacuuguuaaaauucuauccuuaacagccuauaaauauuuaggagaucgagacuucagguuucugagccaggcuggugcuuuguuuuacuggaaauaagguuugagauaaggacaagucucaaauucuuuuuuguuugcuaucuacuaaagagugcuguccuugguaucucuuucugcaggagcagggaagagguuccuggcuacucuuaaguagcacagguaguuccauaacugaaugaaaguggugauagucucaagacagucuggauucugggagagguuucagcccaguuggguuuuguuuuuuuucuuuuuuuuuuuuuuccugcuaagagacaaggucuugcuauguugcccaugcuggucucgaacucuuggccucaaacaguccuccugccuuggcgucccaaagugcugagauuacaggugugagccaccacacccgguccuuggcucaggcuuugauugcugguuaagagcaucuuuggugaaucugagccuucccagugaggaauuaccacuucacacauuuaagaaggaaagacuuaaguaauaccuagguaauguuuuuauacuuugucuuuaauacagugugguagcuuccauaugggucuauguauacacauuacacacucugugaguacaaaaucauuuuuucuggaacauguugagccauacauaguuccuuuuucauuuggugaaaacaggguauuaacuugccugggguuguaugugcuuucacuagcagagcaggcaauaaaaacccaaauaguugaacucuaauuucucauugcaaucugugaaaacaaguagaagaaauuaaguaccucaacaaggggaacauuuguauucucuaccuuaaagaagccugcggaccucucuuucaauugccuuaaaacucugcagaugaagauaacaaagaaucgugaugagagugagagugagaaccuguugaccuaagaguuucuguuugaucugugacucaccuuggagcuugauuaggucaauuaacaguuuugugcuucaggcugucucaucugagaaacuggacuaaauaccuuuaaagauauaaagacuaaugucucuagaaaacaaaaaguaggcugggggcaguggcucaugccuauaauccccagcacuuggggaggccgcggugggcggaucacuugaggucaggauuucgagaccagccuggccagcauagugaaaccccaucucuacuaacaauacaaaaauuagccaggugugguggugggugccuguaaucccagcuacucaggaggcugaggcaggagaaucacuugaauccaggaggcagagguugcagugagccgagaucgcaccacugcccuccagccugggugacaagagugagagacuccaucucaaaaaaaauaaauaaauaaugacaagaaaaagacuaaugucucuuaaaugcuuugagcuauuuguaaaaguucuguguuuuguaaauacaaguuauuucauagauuuaauggaagucuuuauuuuuuauuuuuuuauuuuugagacagggccucacuguauuuuugguagagauguaauuucaccauguugcccuggcuggucucgaacuucugagcucaagcaguccaucugguucacccucccaaaaugcugggauuauaggcaugacccacugcaccuggccucuaaagucuuaaugaauguaaugacuaauagacauuguuaguuuugaaaucacaagagaauguauuuuagcaccuaucuaccaacaguauacuguuuuauuuuaaauggguguaaaauguuuuuaaaugaucuggaguugggugugguagguuuugcugcuuuuuccagagugaaaacuaaccaaguagaauacuaauuaugcacuugaguggacauuacaacaacuaaugcuguuguuaccauuuacucaaugcuaaguuuuacuaugaguagugguggauagccauuaagccuuauuugucaaccucuaaaaauuaaguuuaaaaaucauuauguagugaguuuccuuguuuuuaugauaaauuuuuuucauaauacuuuuaugacaauaacugaggcuacuuuccaucauaccuagaauaaaauuuaaacuuuaccuaccaugggcuauaaaauccuauaugaucugaucccucaugcuucuaucauacuggcugcuugucagguuguagaauaugccaaauucauggcaaguucuucauccuucaagcuucagcuaaaaggucuugucagaccuuccuuaugaccucccuuucuaaauugggcccuaggcugggcacaguggcucaugccuguaaucccaacauuuugggaggcugaugugggaggauguguugaggccagaaguuugagaucauccugggcagcauuguaagacccugucucuacaauaaaucaguaaguaaguaagcuggguuugguagugcaugccuguagucccagcuguuuggcaggcugaggcaggaagaucacuugagcccaggaauccaaggcuacagucagccaugagugcaccacugcacuccagcauggcaacagagcgagaccgugccuaauaaagagacagaaaaagaaagcccuuuguucauuaucaccaaauccagguuuuucucccccgcuuuaucuuuuagacuuuauauugaauuggucaacaaauccuuuagcuuuacuuucaaaacaugucagaauucugccccuccucucccaucuucaucucugccacccugguccaagccaccaucaucucucacccagacgauugcaguaucuuucugucacucugcucccaccuuugucccauucacccuguauaacagcagccggagugauccuguuaaaccuccauuggauuccuucauuuggaguaaaggccaaacucuugaccucuuuaguuaggcccuccgcaaacuggccaucuuggagccccucugauuugagucuucccccuccccucccugcccaauacauucugcuccacccuccucagccuccuuaaugacucagucaugcuuccucccaggugcuuugcacuugccuugccucugccuggagugcuguuucccugauggauacacaugggucacuuauucuguuccuucacacauugauucuaauguggcccuggucacauguucuuaaauuucagccucccacauccacacuccuccuguacuucuuccuugcuuuauuuuuuucucuuuagcauuuaucgcuaucaaguuuuauugugcuguuucucccaguagaauauaagcuccaugagggcagggauauuuuuuuaaugugaguuccuuauggcuccugggcaccaucccagugccuagaauagugucugauauuauugaguauaugcaugcaugcaugaauacuguuuaucacaguaugugaguuuaguuacucauuugucuggcuuccuccacuaaucugggaaugucagcaaagcaggacuucauuuuauucacuguucuauagcuaaugcuuagcauagugccuggcaacaaaaacauucauuugugaaucaaugacuauuaauaguacuuugcgugcguauugcaacuuaguuuguaaaguacuccuuuauguauuauuucauuugauuuucacaaucuuauauugauaagacagucaucucucuaaacaagaauacuaacuauaggggccuuaaagucaccauauugaaaguguucugguaaaugauagaacugggccugagacuuaccugcccagagugcagugcauuucccacuguaucaaaggacugcuccauaagauuuacuaugcaaagaaguauuucaaugacguauguuacaacuaguguccuuucuuauauuguuaacuaaauuuucauuucugggaguugaguauaauauaaacaaauccuguuuuaugggcauuauaccuaagaauagagagaguugaaaaaugagguuuaaaauaaaauaugguucugugcuaaauggaaguaugagcuacugacauguaauuaccucaaaaaccacauuucuguuuugcuuuucuaguugcucaucuuacagaaggacacgaagagaaguagagugaccuggggcaguguucuuaaugcugauguauuuuuccuuuucuugacuuaauaaauuuuaguccccuuaggaguccaggauauaugacaauaaacuuuaacaguuguauucacagcaggcaaauucaugggaacuuuaaagauuuuugaaagcuccaccuauaccuuggcucaaggguccauucaaaaaaguagacugucaggauaugaauacauucauuguacuagcaaauaggauuuuagaaguaacacugcggaaugaucauuccugaacaaauaacugcaucuccauaaaguagaugaccauuuuucacuucuuacaaguauggguacauaagagaauacauuaccugcuggaggcgucaguuuaacugaauuuuaaguagaacucggguuuccuucugugccacuccaccuuccauugggaugugacuuaaacuacauguucuuuuuugaaggacuggguuauauaaauuguugaugugagaucauuuguauuauucuaagauucauuuguugugcuagaucuucaacuugcugcugagcuugggaagacauuacuggaucggaacacagaguuggaggacucuguucagcagauguauacaaccaaucaggagcaguuacaggaaauugagguaauucacuuggcaggagaguuacacuuuugacacuucgauguguugcuguuaugccaaucacauacugguaaaaaagcacuugcaauuagaugcagcauuuuauuuuuuaacacaaacuuuuuugagaaugagaaccgccucccgaguagcugggauuacaggcgccugccaccacgccuggcuaauuuuuguauuuuugguagagaugggguuucacuguguuagccaggcuggucucgaacuccuguccucagaugauccaccugccuuggccucccaaagugcugggauuacaggcaugggccaccacacccggccuaaaacaugcaauauuuaagauauacagaaugggguaagagaacaauacagugaauacccauauauccaccaccuagcuuaaaaaagaagacugcccacacucuugaacuucccaccggagagggaacuuauaccuccuccuuggugacauaucccucccaccuacuaccaaaccauauccuaaauuugaaaaaaaaaaaucauaguuccugauuucacaguguguucagauguuuugcuccauucaaauaaucauaaaauacauguugcuuucucucugcugugaucuugauuuguuuacauuuuugcuggauauuuuauuaaaaugcuacauuuuuggcugagugugguggcuuaugccuauaaucucagcacuuuaggaugccgagggagacagauugcccaagcucaggaauucgagaccagccugggcaacgugguaaaaccccaucucuacaaaaaaaaauacaaaaauuaggcuggugugguggcgugugccuguagucccagcuuacuugggagacagagguggaagaaucaccugaaccugggaagucaaggcuacagugagccaagaccgugccacuguacuccagguuaggugaugggagcgagaccuugucucaauaaaaaaauaauaauaauauaauaccuuuugcccagcuuaacaaacuaaaaugaaagaugcuagacuagggcauuaaaauggcccucuaugcugcuaaucuuauaaauaguccccuucaaguaguucaguuauguguaggccacuugacuguaaagauaaucacggauauuaaccagugucccaucagaacaccuuucuccaugucccaacccaugcuucccccaaaaagggucuguacuuaaauuauaagcuccucccccuuaaauugguacaguagacccaggacuuuugugucugugcacagaaaaauguaaaagacucuagaacagugaagcaguucaucauaaugaguacuuacuaaagcuuugauuauuuccugaaccaggugcugggaauucaaacaagcggagaauuacacaguccuuccuuagaagugaucacaucauacaguuuuaaacuuuugaauacaaaucuaucaucaaaacaaaggcaaaugugcaaucucaguauccauuaauuuuaccuaguaacauaaaagguguauacaguagacccuccccuugagcaggauuucugaaauacacuuuuauaauucuaggaaaguauggcuugcaaugauauugaagucaccagguaccauuuuuagcauauucuacaucaaaagagcguacaauauguuuuacacuaaauugaauuuaaugaccuacuguaggccgggcgcgauggcucaagccuguaaucccagcacuuugggaggcagaggcaggcagaucacuugaggucaggaguucgagaccagucuggccaauguggugaaacuuugucuguacuaaaaauacaaaaaauauggcaagcacccauaaucccagcuacuugggacacugaggcaggagaaucacuugaacccgggaggugaagguugcagugagcugagauugugcaguugcacuccagccuaggcaacagagcaagacuccaucucaaaaaaaaaaaaaaaagaccuacuguagaguuugccagaaaccuaaaaugcagagaaacuaggcauuuaaaaacuauuaaacuaggcuaggcaugguggcuaacgccuauaaucccagcacuuugggaggccgaaguggaagaauugcuugaggcuaggguuugagaccagacugggccacaaagugagaccgugucucuagucuaaaaacaaaacuauuaaacuagccaaauguuuuacguggucaaggaacucuuuccuacuuuguuucguagacuuuguuuuuuaacucagugggagauuucagaauaguccuaaacgaucaucacuguuuguauuuguguagagacauagucuuaauuguauuaucguagucuaugagguuuauccgaggccugauuauugcuaauaguuaauaaauuguauugauguuuccuguuagagcauuuauaaaacacuauaacugguacuuauuuuagcauaucuuucaaguguagcugaaagaaguguaaauauuuguaaguugggagaaugaugccuauugauuagcauaggagauuacaaacaacugcuuuguuuucugugguaucgaggaugauuaaacauuuaagcuagaucauugguauucugaaaguauccaaagauaucugagauucucuaaaucuacaaauaacacuuuauuaucuaauauuauccauaagauauugcaaagcgucauggaaaugaaauaauccaguucagaccuucaugauuaaauagguauaaaauucagccgggugcgguggcucacgccuguaauccuagcacuuugguaggccaaggcggguggaucacgaggucaggaaaucgagaccauccuggcuaacguggugaaaccccgucucuaguaaaaacacaaaaaauuagccgggcgugguggcgggcgccuguagucccagcuacuugggaggcugaggcaggagauuggcgugaacccgggaggcggagcuugcagugagccgagaucgugccacugcacuccagccugggugacagagcgagacuccaucucaaaaaaaaaaaaaaaaaaaaaaguauaaaauucauguauaaaacuauucaggagauuuagcuuggaauauuucgggaaacauauucaugagucucuuguuccuguaauauguaguccacugguuccuagaucugagcauugcacaaugcaguauuuuacucuuuauccaaagcuguuuuuggcuaagaauaauuacucucuuagguuucuucaccaccauuacaguugacuuucuuuuuucuuuccuuuuauaaguugcuucaugaaaguaaguuuccagucucaguaggggagaugagauggcaguaauggcuaagcccacuuaccagccaggggauucccacagacuguccuugcugccugcuccaucacaacugugccugggcagauguagagaucacgauguagauuucugaggucucucuaauagccuaaaagaaugccaugugcucuuguaaaaguaaccaggcagcuaaagagccuacuuccuugcuaaacaaugacccuugcauauguuccucuuauugcaaccuucaggaggcccccuaaacuuuauaagggcccucuccuuaauuugagccuuuucaacguguuucuccuucccuuaaacuuuuuauugaaaucuacauuacagaaaagggcauaaauccuaaguguauaguuugaugaauuuucauaaaguaaacaugcccaugcaaccuauuccuagauaaggaguugagagcauuaucagcucaucuggucaccacccggugagcuagcauccuaaguuuagcuuguuuuugaccuuuacgugaauggaaucacuuguacaaguuuuaaaguaacuguuuagaauguuuauugggaauuagauuacaaaguaauacacagcuuggcgcaguggcucacgccuguaauccuagcacuuugggaggcugaggcggauggaucacugaggucaggaguucgagaccagccuggccaacauggcgaaacccugucucuacuaaaaauacaaaaaguagcugggcaugguggugcaucccuguaaucccagcuacucgggaggcugaggcaggagaaucccuugaaccugcagggcggaggucacagugagccgagauccugccacuucacuccagucugggcgaaagagugaaacuccgucucaaaaaaaaaaaaaaaaaaaaaaaaaaaagaucauuuuuuuaauucagaaaaauauauaguugaagaacaaaaagucagcuccuaucccaccaccagugaaauuuaaaaugagacaguccagaagaauggucugggaacaaacucaucugagcgaaugaaaaauagugcagagaacuggugaaaauacuaggacaagaucccuaagauucugacuuauuauggaaauagacaacuuggacacugccaaaggguauuuuguaaguagaaccacaaauauucuuucaaagacucuuggaggguuucaaacaauccuccuaaaaauugaucaguauuuuugguaggcaucauuuuuaauguaaaaacgaaaaaaacaaaaauuuccuuuuaugugaaaacgaaaaaagauuaaacuauucaaaauaaugguuaaacuggcuucagagaagccuguagccugucuuacuuuuuuucagugcuaauuugaaaaacuuagauaauuuuuuaagaauccagagcaaguuuuuucuguucuggguggaaggaggggaggagagaacucuuacuugggagaguaaugagaucagacaccauuggauucauuuacacuuugcuacaaccguguaagcagccuacagccuuguguuuugguuacuucccugcuuagacaccugcauuauccccuacaggaguugugccuagcacucaaaguagucuggccuucaaggcaucccuucuuucaagaguucaugcccucuuuggaaauggaaaaauauuuugugcugcuuuuacugcauguaucaauauucuacugcauaugauacuuaauugauuugcuuuauuuuccuuuccccuuauuucccauugcaacagugagcacuguuguguuuauucauggucuuucacacauacuagguaaucaauacuuuguugaaaucaguauuuuaacagaggagaaacagcuuacaaagcucuucuaauaacuccuaaacuuuggguuuccaccucuggagauuuuuaaggcaggcagaaggggcucuggccucuguuuuaggagauucagguuuaaacccucaauuuuaauugcaaauagcuagagaauuuagacauaugaauuaccccucagauucucuuugcuccguuauggaauggugauaaugcuuacacugcuuugguguaggaguuuucugaggggaugagauuauggaggcauauauauuuugaacaguauaaauuguuacuuugguauaggauuuuucugaggggaugagauuauggaagcauauauauuuugaacgguauaaaucguugcauaguuuaccaauguuuuaagaauuuuaguagugagccgguggcgguggcucacuccuguaaucccagcacuuugggaggcugaggcagguagaucacgaggucaggaguucaagauaagccuggccaagauggcgaaaccccaucucugcuaaaaauagaaaaauuagcugggcgugguggcgggcgccuguaaucccagcuacucaggaggcugaggcagagaauugcuugaacccgggagguggagguugcagugagccaagauugcgccacugcaguccagccugagcaaaaaagcgagacuccgucucaaaaaaaaaaagaauuuuaguagugaaaaaagucuuuaaaaauuuguauggauauauaacagcuuuacauauaucuggggcgccugugacguuuugauacaagcauacaauguguaaugaugaaaucuaaacugagauaaccaugaccuccaacauuuaucauuucuuuguguugggaauauugcguaucuuuucuagcuauuuugaaguauacaauaagauauuguuaacuauagucaugaaagaacuuaaauucugaaaaaauaaaucuuccagaauuacuggaaauagacuuuaaaaacaaucuaaucccacaauuuuaauaaugggauuauaggugguuucuauuuucauguucaugccucccgccaccaaauuucuacaggggaaauauauuucaucaggggaaagagauuuuucaaaaguaauaggaaauauuucuuuauuauuguggaaguucauuuugauaguaaauucagaggauuuaggcuguaauccuuaauuucaggauaaucccaacacugcuuacaagccagauuuccacuccauuucuaugcauuuuuacuuggggucguuuguuucuaucuuucccugcguuccagguuaggauuccacaauugcaaauagguauuuauguaauucugcuggccuuuguuuuuuaaagauuuaccuuaauuguaaagguggccuguuuguagcuuuugugcauaacuggaaccuuguacucauaguugaggugacagucugugcaaauuccuagacagugagauaaacccaaggcauuuugcuauaaguugacauuuuugcccacauuucugcuaccccaugacccccuucccccacuguuuugcuuuaaaugucucccuuuccuguuuacuauggcagucagauucauuggaggcuguguaucaaagagaaaaccagcaugucagcagcaugucuguaccuugagaugagagguaggaaauaagcuaacccauuuccuucuagauucagaaaaaaaaugaagcacugacuccauagaccuagaugucuggccuuacaucaguacguacuuagagagcucaucauuuuucuuuaaguugcugacugguuuugucagacucuucuguagguccccuauaacugaaucuuggagaagugaagggcuuuucugauuaauuuugguuuuauauaauaagauuaagcuccuaccaugugaaaacaagcuccuugacauucuuuagauuguuguuaaagccaagucaucuaaaaccaaaauaucacaaguucuuaaaugguuucauuauguuguuaucacagguaucacagguuuuuauauaucaaacaaggaacuuucuauaguuucuuaaauggccuguuuguacuuauuugcauauugacuuguuuccuguauguuggccacaacucuaacuugaacauccuaucuguaagagaacaacaacuugagacccaucugguaucugguaggaacuguaaaagucucccccucagauuaccggggcaauugcugccaugggaauaaauacagagaaauaaucuauaaauggaaaagcggggagagaauucaugguuaauaggcuguuuucccaagagggcuaaagccaaagcccuucucaaaaccuuucaguuaaaucccccuugacaucucacagucugagucaugccaagcacaauaagcuguugugaagaaaagucuagaaacugccaguucgccaguauuuuuuuguccccuacugugugucaggaauggacuagauacacaagagccuuccauucuuagaagacuacaguacuggccuggcacgguggcucaugccuguaaucccuucacuuuggcaggccgagucagguggaucuccugaggucaggaguucaagaccagcccggccaacauggugaaacccagucucuaauaaaaauacaaaaauuagccuggugugguggugcaagccuguaaucccagcuacucaggaggcugaggcagcagaaucacuugaaccugggagaccaagauugcagugagcugagaucgugccuccagccugggcaacagagugagacuccaucucaacaacaacaaaaaauugaauauuauuguauuguuuugagagaaaucaauuuaggguaccuugggaaugcugccgcuuuagaccugcuuuaagguggucuucuuuuuuuuuuuuuuuuuucuuuuuuuuuuuugagauggagucuuguucuguugcugagguuggagugcaguggcaugaucuuggcucacugcaacuucugccucgcagguucaaacaauucuccugcuucagccuccccaguagaguagcugggauuacaggcauacacuaccuugccuggauaauuuuuguauuuuuauuuauuuuauuuuauuuuuuagacaaagucuugcucuugucccccaggcuggagugcaguggcgugaucucggcccacugcaaccuccaccuccuggguucaagugauucuccugccucagccuccugaguagcugggauuacaggcaccugccaucaugcccggcgaauuuuuguauuuuuaguagagaugggguuucaccauguuggccaggcuggucucaaacuccugaccucaggugauccaccugccucggccucccaaagugcugggauuauaggcaugagccaccacacccagcaaauuuuuguauuuuuaguagagacgggguuuugccauguuggccaggcuggucucgaacuccugaccucaagugaucugcccaccucggccucccagagugcugggauuacagccaugagccacagcaccuggccaaaguggucuuaaaaggcuucugaagagguuauguuugaaaugaggccagaaggauaacuggaauuuauaaucuuucuuuggugccauggaucccuuugauuaucuaaugagaucuaggauaauccucuuaaaauucauugaauuacaaaggaaaccuguuagaaugaaauaccugucaaauauugaaaaaaguaaauuugugauguaauauagauacguauuaacauauuuaauaacaagaucuagaaacuaccaugauuucaaauagugaugaauguaggcaguaaaucaagauuucugcaacuauagugcaauaugaaaauaccugugauuucuguugaugaugaagucacagauaaaccuaauacuacuagugguuuauugccucugucaaaagaaaaaauuacgacaaacauaguauaaagaucuuaauuagcuuuuauuugagauucuaaaguugggcaacaccucauucuuagagaaugaggguuucaaugagcugagcagaggaaguugguuuuauagacaggggcugaggaaagcagaaacagaaaacaaaaaaugggugguuucaaaguuaauuuauuuguaaagguuaaagcagagggaagucccuuaugcuggcuaaaacuggcauguuugggggcuuggcuauuaucucuucuaauuucucagaagucagaugaacaacuuugcuuuggcuugcugacauggaacuuuagcacaagugacuccauuuugguuugguuuguugggccuagggcagggacucaguccaaaccaguggucuccuauaaauuuuaacagaucuauuaguacuugaaagaaaugucaaauuucauuuagaaguuaacaaaaaugaagauguagcuguucagacccuuuaaauucauccauguucacagacccucuaaagucuauccauggaccccaggcuaagaacugcuggcuuagguggagcagccaggagaacugcauccccccggauaggggaucguaaaggcauuagaggagggaggcacuugccuugcaguggggcaacuccaaaaaaggcaaagauaucuccccuaagugugaaauuuuaaaaaaaucaauagcuaacaaaugaagcuggaaaaaccacuugagacaauugggaaaauauuaaugcugaaacguaauagauguuaaggaauuauugaguuuuuuucccuuaggaauugugguuaaaauaaaacguccuagaaauguaugaagauguauacuugagaugccuuggauuagcuuuaaaaugauuggaggacgaggaaaguaggagaguagagaugaaauaagauuggcuguauguugauaauuguugaaacugguugauggguacgugggaguucauuaaaccauuucucugcauguauauauguuugagauuauccacaauagaaaguuuuauuuauuuauuuauuuuuagacauagucucacucugucgcccaggcuggagugcaauggugugaucuuaucucacugcaaccuuugccuccuggguucaagugauucucaugccucagccucccaaguagcugggacuacaggcgugugccaccaugccuaacuaauuuuuuuuuuuuuuuuuuaaguagagauggaguuucaccauguuggccaggcuggucucgaacuccuguccucaagugauccacccgccuuggccucccaaagugcugggauuacaggcaugagccaccacaccugguccacaauagaaaguuuuaaaaugcaguggauaagauuagccaucuguagaaauucaguauuuguuuggacugagaaguuaggaaggaucacucaagcaagguuaagguaacuaguuuguaauuucagggaauuaaugauuguuaagaacauaccaaagugaagcguuaugaugaugaaugcugcugugguacaguuaaaauauaaccuaaucuuaguggauaacugcaucuaagcugagcccuaugcagggagacggugagcauuaagcugaagagucaucauugauccagugaaugccugugucuccuagacccaagagaaaaggacauuggucagggcaggggacguccaggauuuuccauguccaagaucaacauuucucuaagugugaucucuggacugccuguacuaauaucaccuggguuuguugcuaaaaaugcagaauccuggcucuacuccagucucagccguuugaggggaagggacccagguucuuacacuuuaauaaaucuucuuccaggugaaucuuagcacauguaaaguuugaaaacuguagcuuuaaauaaagaugacaguagcuucuccuuauugagcaauuuaccaucugccagaucucaugcugagcucucuacauauauuaacguuuuuguaaauuauauauuuguauaugucagggaggaaaaauauuuuuuuccucaaccuucaugagugcuuaguuggaaaggaccccugcaacaaaagacagauuaacaagagaaaaacaagcuuacuaacauaucuauuucauuuauaugugugggagauacccaggggaugagucauucucagagguggcuuugaauuccagcuuauguaguaucuucaacaaagaaugguaauuuuuuagagaagugacaagacaaaggggaagaacuuugucuaggggcagaacuugugggaaggcaaguaaguggugauaaaggcccguuagcaaagcuuguuaguguggauuccucuggugcugucuucuggcccauaaaggucuaaaguuguuagugguuaaccuuuguucucccugguagagagggaggaggcaggaaccuuuuuaugccaaagacgcaugcuuuggggugacauaguccagucucucccacacacauauuuaucuuuacagccuuaugaaguaguugaugaggagaacucacauuagaaaaaugugcuugcuguagguuacccaguucuaaacagcaaagcaagaccucaaaccagguucugacuccaaagccugugcucuuagcuacuauaccacugccucccaucagacuccucugaucccaugucuaccagagacucucauucaugaaucggccuuucacaugcccuuuguggggcagcuguguccuaauagaggaugugaauauucuugucacugggcaggaacaguuccuguuguauauuaauaaauuaaugucuggcuuaugcauuagccuuuuuaaagguaguucugaguccuaaagaauacuugauaauuuauacuugauauaaagaagcuugaaacauuucugcagcuauuauauauauauucuugugauucuaagccuuuuuuccgcuccuguggaaucucaucaauuccuaagagauugaacauguucccaucaaugacaagaaccuacuauggaauuacuagcccgagggcaggauuaagggccuacuccuuuaguucugagaaagcuucacgcaugagaauuagugguugauuuccaaaggaccagaagaagcuggugggaguugaggcagugaagacuacacacaggcuuuuauagaccgugccaugugcucaccuuucucauuuaauucugccaguucuacaugguagguacuaacagauccacuuacuaauuccgaacucaaaaagcucuauaaagcaagauuuuuuuuuuccccuuaaauuugcaacagauucauuugguaguagaucuuuaccugaacugaugugaggcuguuuauagucuuaguucauacuuuuugaugcagaaauauuaaugcuugauuacagggugcugcccagaccucacagguauuauaaggugucagcugugugucagguaugagcgccauguugucuuucuaaaauuuaaagaauuuuccaaaacacuuuugacuucaagaguuucagaugagaaaguugaaguuagguuaaguguuuguucaacucuuugcugcugaguuauguaaauggauuugaaaaaaaaaaagccauauaugcuuuuuucaacacuuuaagggcccguugagugucauuuagcccauuguuuguuagccuugcaaauccuucuagaguuguagaaaaagccucaagaagaguguguuguguuguguuugagacagucucugucacccaggcuguagugcaguggcacgaucucgguucacugcaacguucaccucccacguucaaaagauucucaugccucagccuccugaguacgugggauuacaggcgcgugccaccacgccggacuaauuuuuguauuuuuauuagagguggguuuuugucauguuggccaggcuggucuugaacuccuggccugccuuaagcaaucugccuguuuuggccucccaaaguguugggauuacaggugugagccaccaugccuggccaagaagaguguuuuuaaagucaaguucugagucuuuuacaguuugaucaucaguaagcuucaaaccauuucuccccucuuucugguucuguccagggaaauacugugacuuuuuccuuuggaauauauacuguguuuuagugucuucagguagagcugagcagggagggaaucaaggugacuuacacugcggcauuaagguugggauuauuccccuuuauccuuggccauuuaggaagcagucuuagcaggaccagaauaaaucaucugauaaauuucucgugaauaaggaggauaauggugauaaaacucucauaaaauuaaaaauaacaggagucuuugaagcauauuaagcuaaaauauauuucucgucaaagcaacauacuuuucauuuuuuuugguccagaaugccucauucagagaaagagauugauuuuuuuuuccaaauuaagauccuccacauagaaauaggaacguuuuacacuguuggugggaguguaaauuaguucaaccauuguggaagacagggugucaauuccucaaggaucuagaacuagaauuaccauuugacccagcagucccauuacuggguauguacccaaaguaucauaaaucaugcugcuauaaagacgcaugcacacguauguuuauugcggcacuauucacaauagcaaagacuuggaaccaacccaaauguccaucaguugauagacuggauuaagaaaauguggcacauguacaccauggaauacuaugcagccauaaaaaaggaugaguucauguccuuugcagggacauggaugaagccggaaaccaucauucucagcaaacuaucacaaggacagaaaaccaaacacugcauguucucacucauaggugggaauugaacaacgagaucauuugggcacaggguggggaacaucacacacuggggccugucgggguggggauagcauuaggagaaauaccuaauguaaaugaugaguugaugggugcagcaaaccaacaugucacauguauaccuauguaucaaaccugcacauugugcacauguacccuagaacuuagaguauaauuuuuuuuaaaaauccuccacguuaggcuuuauuucuguuaaacaugauguuuuugcuuaaacuuugaucacauguuccauguuuuuugucuuaagggauuguuaugucucacuuuagauuuuuuaguugaauauuaauuuuaugcaugguauaugcuuuggaaaauuagccucacaaugcacugggguauuggugagcauuagaggagcuaagcauauaaaggacagccugugcucauuucuuaugaagacagggaguuuaauuucuucuuuucuuaaaauaaacauaugguauugugguauaauaaaaauuauauauuuggucuuugucccugguuucuggcauagaacuccuaaaacccuuggaauuuccugauagguugaggucuggucaccagagaaggcaaccacaugauuagaggguuagaucuaucagucccagccccacaaccucuggauagagggaaggguuggagcuugaguucagucaccaauggccaauaauugaaucaaucaugcugaugugagagaagaccuggagaaaacugaaaugggucuaaaggagcuucugggcagugcugggaggccagugagcccagagauggagacucuaugucagccccaccccaacaagaguuggugcugacaaucggagaauugguguuggaacagcagaacagcagguaucuuuuuuuuuuuuuugagauggaguuucauucuuguugcccaggcuggagugcaauggcgccaucucggcucauugcaaccucugucuuccagguucaagcaauuuuccugccucagccucccaaguagcugggauuacaggcgugugccaccacaccuggcuaauuuuuguauuuuuaguggagacgggguuucagcauguuggucaggcuggucucgaauuccuaaccucaggugauccacacgucuuggccucccaaagugcugggauuacaggcgugagccaccgcagccagccaagaaacagcagguaucuuaucuguuugugucaccugguccugaucuucucuuacaguaucugacgaagcaaguggaacuucuacggcagaugaacgaacaacaugcaaagguuuaugaacaauuagacgucacagcaagggaacuggaagaaacaaaucaaaagcuaguugcugacagcaaggccucacagcaaaagauucugagguaaauuuucuagaaucugacaaggaaggacuagggggaaguucuuuaguauaaacuagaauagaacauggcugcaguggguuugggucaauaugggauaagguuuaauuuaauucuuuuuggagaauggagauuaaauagacauccuuuccaauuaagaaagcccagugugagugguuugcaccuaaucucuccucaccgcuuuugcccuugauucaauaugacaagcagcaguggcuucugucuguuccucacagccugacugaaacgauugaaugccugcaaaccaacauugaucaccuccagagccaaguggaggagcugaagucaucuggccaagggagaaggagcccgggaaagugugaccaggagaaaccggcacccagcuuugcaugucugaaggagcuguaugaccuccgccaguaagagccugccuuucuguggaguuacagcagggacugucucaugucauuggcacauucugauuuccaguagauugaaaguaccauuuuaagaaaagucacuuagcuauuaagcuaccauugguuugaacaaaaucacuuaaacauauaaauuacagaguucuuagauauuaguaguucucauuuugaaagucuuggaacacuuauuucaguguuuuuaauguauuaaaucauaguuuaagaugaauucugauagacuagauuugggaguuguguuuuacauuagagugaagaaaaacagaaauacugguaaaacaaaaauucaagcgaacaggagauuuuuugcuuaaagaaguaccuuuauaauuuagaguuauaagucugaaucuuuaagaaguauuuauggaacacuuguguggcaagcuguaugcuagacccaaggguuggcgagcaaaauaguuucuaccccugugagcuuucagucuaacggaacggcagauaagcaaauaaaaacacaaauaaauagucaaggugcuucagacugagcaggagaaaccaggugguucauuuggugggucucaaccuuggcuguacaucagaucaccugugggguuuuucaaaaugcaaauaccaacacauuuccucaggccuaaaucagaauuucuaggugcggguaaaaagcugcccaggcaauucugaugaacauuccugguuaaaaaucaccacagcaacaguaauuugcuguagugauucaaucguaguuacauauuaugaaucauuuggagagccuuuagaaacccucaggccagguagcagaccaacuagguuggaaucuguggguugggacccaggcaccaguacuuuuuaagguuucccuugugaggucauugucauacugcuagaauagauguucucuaguacuuuuaacauuaaaaaaagauuugucacaaaaauugaguuugcuuucauguguuuauuuaccagccucacacaauuccauuuuagccacugcuccaaguguggcuaaaaaccaaucacuguuggccgggugugguggcuuacgucuguaaucccagcacuuugggaggcuaaggcaggaggaucaccugagguugggaguucgagaccagccugaccaacauggagaaaccccgucucuacuaaaaauacaaaauuagcugggcgugguggcgcaugucuaaaaucccaguuacucgggaggcugaggcaggagaaucgcuugaaccugggaggcugagguugcaaugagcugagaucgcuucacugcacuccagccuggcgacaaagugagacuccgucucaaaaaaaaagaaaaaaaaauuagucacugucacagcuccucaaauuuauuuaguugaaaaaaaaucaccagucuuccucucgucauuuucaguggaccuguguaauauauucuuucaauauuuuuuucccuagacacuucguguaugaucauguguucgcugagaagaucacuuccuugcaaggucagccaagcccugaugaagaggaaaaugagcacuugaaaaaaacagugacaauguugcaggcccagcugagccuggagcggcagaagcgggugacuauggaggaggaauaugggcucguguuaaaggagaacagugaacuggagcagcagcugggggccacaggugccuaccgagcacgggcgcuggaacuagaggccgagguggcagagaugcgacagauguugcagucagagcauccauuugugaauggaguugagaagcuggugccagacucucuguauguuccuuucaaagagcccagccagagccugcuggaagagauguuccugacugugccggaaucacauagaaagccucucaagcgcagcagcagugagacgauccucagcagcuuggcagggagugacaucgugaagggccacgaggagaccugcaucaggagggccaaggcugugaaacagaggggcaucucccuucugcacgaaguggacacgcaguacagcgcccugaaggugaaguaugaagaguugcugaagaagugccaagaggaacaggacucccugucacacaaggcugugcagaccuccagggcugcagccaaggaccugacuggagugaacgcccagucugagccuguugccagcggcugggaacuggccucugucaacccagagcccgugaguuccccuacaacaccuccagaauacaaagcguuguuuaaggagaucuuuaguugcaucaagaaaacuaagcaggaaauagaugaacagagaacaaaauaccgaucacucuccucucauucuuaauugaaccucuagcucuacuacuaauuugccuauugccuaucgccucucucucccauucagacaaguguuuguagacucugaagccuaauguuacucaugacguuugccucauugcuuugcuuauuuagcaaaugcauacaacgaggaaaggagguggcuagugguaucaguucucugauccacuuccauuuaagcuccccaggaaaucccaugacaaacuggccucuggcuggcgcgcugauuagacuucaguuccugaaaaggaccaguggagggaagagcuauacuucuggagaaguaggccuggaguuacuacaguaugggggaaaagggucgaguuagaacaaagcuaaggcaauuccuauugcuuccuugcgcaacuucucaaaacgaugaaagucagaaggcugucaaacucaaauaucuuugcaaacaguuugaauacugugaauucauuacgaagaauguucgagagaaagcaggggucuaauccaaaagaaaugucauuaaccaauacuccaaguccuugaguuuuguuauaucugaacuaguugaacugugacugacagguaauccuaauauauccaaauccaacugaauaccaaauugagauggcaaauuuuuguuugauauaaguuagcuuguuagcauaugcccuagagggccuccaucccuguauucuaauguuuuuacucaaagcucuagccuuuaggauaggugaauauguaaaucuuuuaucacuuucucaaauucaaacuaaaggggaaagaucaaaccccuucccuuccuaccuguuuucugagcuggcugacuugccagccacaagcugcucuugcagaguucuuaccauuccuguaaauguuuugacuuguugcagaaauuccuaucuacuuuauuaagcaguauugaucugacuguggaaacauccucucacuugcauucuuuuaacuuaaaacuauuuaagaacugauguuccgauuauuguauauauuuuucuaaaaaccaaauaaagcuaccuaugaaaaugaacagau

SEQ ID NO: 15385 - RNA, 774 nt, Homo sapiens
auugcuucuuuuuuuuuguuuguuauuuaguuuuuauuucauaaucauaaacuuaacucugcaauccagcuaggcaugggagggaacaaggaaaacauggaacccaaagggaacugcagcgagagcacaaagauucuaggauacugcgagcaaaugggguggaggggugcucuccugagcuacagaaggaaugaccuggugguuaagauaaaacacaagucaaacuuauucgaguuguccacagucagcaauggugaucuucuugcuggucuugccauuccuggacccaaagcgcuccauggccuccacaauauucaugccuucuuucacuuugccaaacaccacaugcuugccauccaaccacucagucuuggcagugcagaugaaaaacugggauccauuuguguuggguccagcauuugccauggacaagaugccaggaccuguaugcuuuaggaugaaguucucaucuucaaauuucuccccauagauggacuugccaccagugccauuauggcgugugaagucaccacccugacacauaaacccuggaauaauucugugaaagcaggaacccuuauaaccaaauccuuucucuccagugcucagagcacgaaaauuuucugcugucuuugggaccuugucugcaaacagcucaaaggagacgcggcccaagggcucgccgucgacggcaaugucgaagaacacggugggguugaccauggcuaauaguacacgguuuuccucggcggcggcgucugcaaagccaaguaa

SEQ ID NO: 15386 - RNA, 16937 nt, Homo sapiens
acgcaauuaauuaucaaacuuuaaucgauugacuaaucuuacaggauaaacaauaagacagcuauucaagguuacacuuuaaaaaaaaaauccagcagugcaaaucuaauagacuaaauacguucaucuccucccaaacaggcauuugauuugaaaacagaaaccagaacagagcauacaccacaaggaaacaugguacuuacaaauauugucaaauaauucagcagaacucuuuaagaaaaaaaaaagguucuuagaaauugagaaagcaguagaaccacccagccuggcagaucaaucuaccagauguucugcaugcgagagggcucccaaccaccuguaacuucagaaaggccgccaggcacuauuacgaaggaaacaggugcagauccuaacuggagaugacuuuaucacaaagccuuaagacaaagggaccauccucuuccaagacaacaggugugaacagaggcaaggagcgagaggagagggcucccucagcagauggguggaaagcaagccugcccuugcacggcccuuggcacacucaaucuacccccuuucccuucucugccccuggcaaagaaaggcugggcaagugcaagagcccagaauggcuccuccaggcacaugguuaaaguaagaguaagaggaaaacaagccccuucugggugaaauauggcaacuuuucugagacauggcaacgaggcagaguuaaucucuuuggcccucaucagguaaagcagcaacuaaggagccuacucagggccuuacgugggccccuucuauguccacaagaaagugcauccuuagcucaguucaacauuuaaaaagagcuaacgcuacuugcaaaaggcccaccauggauucaaacacuuaauaccaaagagguccagcaacucgcgagucugucuguguucugugaucugaagcagagcuaaggggggccuggcucacagggucacgcucuucugccaaggcgccucagggagggaaaaaaaggcaugaugaugucugugagccagaaccugcaggaggaccaccgguagagauucuagaagacaaagaagcccucaggaggcucugagagguguccaaugucuaagagacggccacccccuccaucucuagcuucgagucaacgcuguuacagucacucuccggaaaccagcucuuccuuuauccaccugcacggccccugccacagugagggaaagaucuggucccucugacaguaaggaaauuguauagaaauuauccugaggaaaaaaaaaaccacugugacgcuaccuaaaagaaagaguauuucaauuugcuuacacagauuuagucaguacacuccagacuguaagaaauguaugaagagacugcuuacggaacucaaagacuaaacagugaauacuacuguggcccagacacggaucgaaaacacuucucccaguggcuucuggugcuaugucugcucucccgagagcguccagcaaggucuuccaugcagacagggugaggagccacagagcucaagauuguugaagcugauuuagugagcucuguaaagcaauacucaaacagcuccguacgaaaaggugucauuuacauuauuauuuauauauaguaucucgaaguaaggaaaaaagcaccauuuuacugaaaauaaaaaggcucacgcaggcuuugguccuccugaaaugacaccagccugagugagaagcaguuggcccuuggggagcggggagaugauggaacgcugucaccggcaagaagggaggccaaguggcccggcaagccacaagaauggggcaauaaggggagcagguggaggggccucggagagcagccaggcuagucuggggauggagccaccugcucugagagaucaaaaguaggugugcggcacugucaggacaagucucuaggacuggggcauuggcaaacaaaaggggcaaugucugacccgagaugauguucuacuuaaugcaucucauuucccccaaaaccugucaccugcagacagaggcuuggacaaguagcucagauguacucuuuuccccaggaacugcaggccgacaaggacagaaaagcugcaaugacugcuccuuucucaagggaugaaaaaacaggcuguuucuuggaugcugcacuucacaaauguacuaauugcccccaaaaaagcaaagaguagauuuuccugccuagaugcaucacuuggcauugacuacaccauggaaagcaagagucugucuaugugggcuggauuccugaacuacagcuuagaagggaagggcguagaauaucaucauuaacuggcucacaaggaauagucaucuugggcgaacacaugcuaauacguuucacagaaugaggggugacagccuagaauccaaaaugugauguuuggaacauuucucgccaaaccuuacuaugaaagccugcaaccagugagaggagaacugcaaagacggcagcagagaaacagcaaacagcacaaaagagauaauuuaccaagagacuuucccuccuuucagaggcaaccaagccagaaggagaugacagaaguucacguguacagagaacagaagggcuaaaaccagaagaaggugagcuaaucaugaaagcaauuuaucccauuuuuguuguucaauaacacuggccaaccugcuagggucagaugucuucuucagaaaggcagcaucucugaaccugggauaaaggacacuugaacugaaugcaugagcagaaggacccaauggagaagcauaauugaaaucauccuuggacugcuuaagaauuucuugaaaacuuccaaagaaagaagguuaucuggaucugcagcuauauggcuguauaacuaucuucuaccuggcuccuccuggaagaggucuuugucugcuugggagcuggggcuguugagcggcacagcccaggcacaaccaugccaggcugggccucuaggccaagcucagugaggggugcagacaaucauccaaccagcaauggaacuccuuggagaugggggcccaaagggcaagacauuuaaacaggagucacugggagauacucugcugcucaacgaacaccacagcaagugugagagcuccuugcccaagacugagcagcucuuccucucccaccgugcguucacaggcagcagcagcacggcgggagggagcccaggaaaggaagcguugaugagguaccaaaagaagaacugacaucuuuggguucuuaaaacaaaaacucaaauugaggaagcgagagaaugaaaaagggaaagaauuaaaucugaaucaauggacagaaauauguggcuuacuaacccacccccauuuugcauacaauuuuauacaaaaaaggaaaaaaaaaacaccccaacucauugcaaugcaguccaaauguuugcaaccaaagauguaugaaaauauuucaauugaaacugcuuuuuuuuuuuuuaaaaaaaacaaagcuuuugaucauucccuugucaacauaauuggcagaucuacucucaaacacacuuaagaguauuccacacaacauguucggaauucagauuuauugauuuccaucguauugacuuuaaaaaugguaugaagcugacugcaagaaagggaacugguaauuuuaaguuaaaauuaagcuaauggugaaaguacaucaccucuggcuucagucaccacaucaccucagauugaauauagauuuuuuaugaacaaaguuccagaacucugaaauccagggaugcugcaggccucucccggcaauguccuucacuuugggucagucuccugggccagaggugaaagugcuuucaaaaauacugccauuuccccagcacagugucuuugauugcauccacauauugaguuggaacccaguacacccaguaguaagaggcuuccguggggcccaacugaaacgccuggaagggaaaaaggaaaaccaagcgguacuucagaggucgggagaccaagcaggcaggacaaacaugggugaggguugggaugugaguuaauuaaaaagggaagaaaaaccaaacaaaacuuugcacguggggagcauucucccaaccaaaaacaaaaacaggcaggcugaggguuaagcugagccaacccuaaagcagcaguucucaaaccugaguggucaucagagccauccggggggcuugcuggaacauggaucagcaggcuccaacccugugaaguuucuaauuuggggaggucugggguggggccugagaaacuagcaagcucccaggugaugcaacacuacugauccagggaccacaguuggagaaacgcugcccuagaaaaccugucacacaugcucaagaaaacagguaugaauguucauugcagcacugucugaaaccacaaaaaccuggggcaaccuacauauccaucaguaagggaaugcagaauucaaagugacaaggcuuagucacaccaauacuggagcucuuuuuaaagagguaucaacuggguccauauggaucuacaguuaauacugacagauucuuauguugaaccaaagaaaagcaaguuguagaacaauacauaauaccauuuacgaaaacuggaagcacaaaacaacacuccaucuuguucguggauacacguguaaaucaaagaauggauagaugggaaggacgcacgugacacaugacgaugguaaugggggaggggaagacaguggggccaucauugcugugaauaaacuuuauuucuuuuauuuaaaaaaauuaaagcaaauuacaaaauauuuacaauugccacuucucagugauggauauauggguuugugacaguuauucucuuucuuuucuguauuuuauuuuuauuuuuucugagcuggagucucucucuguugcccaggcuggagugcagcggugcaaucucagcucacugcaaccuccgccucccacuuucaagcgauucuccucccuuagccucccaaguagcugggauuacaggugcgcgccaccaugcccagcuaaauauuuguauuuucaguagagacaggguuucaccauguuggccaggcuggucuuaaacuccugaccucaagugacucacccaccucggccucccaaagugcugggauuacaggugugagccacugcgcccagccucuuuucuguauuuuaaaaacauuucucuaaaaaugaaaaagcacagccacaguuuuccaacugugaaugaugacauguuaauuuagcuagagaaauagcaucugcccaaagagauaacuaaguacuuucauuaggacaaagguaaagguguuuggaaaagagaaggggacuacuagagcuauccucugccagaaauaacucgagagaaaugaacauuucaaugaaauacuaagucauuacccauccacaccaauuccuccaaagacguccaaaacaguccacucaacuuccuuggacucccuaccaccacacugcuugaaaagucaggcuacaaacccuacagggugugacuggcaacacaaacuauucaaaaaggagugauggggcccaguuaaaaacauucaaguccaacuguuuuuuuuuguuuuguuuuuuuguuuguuuuuugagacagagucucugucaccuaggcuggaguguaguggcacgaucucugcucacuacaaccuucgccucccagguucaagcaauucaagcaguucuccugccucagccuccugaguagcugggauuacaggugcccgccaccacgcccagcuaaucuuuguaauuuuaguagagacggggcuucaccauguuggucaggcuggucucaaacuccugaccucaugauccgcccaccucagccucccaaagugcugggauuacaggcaugagccaccacgccuggcccaacuguuaaaacagaaaaaaauaacugaccaggccaaaccaauuugucugcaauccuuguaauaaagacuacagagagagggcugggcauggaggcucacgccuguaaccccagcacuuugggaggcugaggugggcggaucgccaggucaagagauugagaccaucuuggccaacauggugaaaccccaucucuacuaaaaauacaaaaauuagcugggugugguggcgugagccuguaaucccugcuacucaggaggcagaggcaggagaaucgccugaaccugggaggcagaggcugcagugagccgagauagcgccacugcacuucagccuggugacagagcgagauuccgucucaaaaaaaaaaaaaaaaaaaaagacuacagagagaguagggguggaagggcugccaaggggcaucaucacuuccagaagacaaaaccccaagagccccacagccuagggacugcacucccagcuacagccuugcuacagccacacuaggcaggaugccaacagggcugccucccuugcccaccauauuuuaagccccuuugauuuuuuucuauagcaagaggaucuuccaacacaucucucugccugggacuuguuaucccaaucuacuggucaaaccacuaguuccuucuuuucccugggaugggcugauguggcuucaucacugugggauggacacugaaaggccugccuccuuggaugaacaauggccggaggccccgcccucacauuacagcugcucaggccaggccccugaugggcaacugcagaaucaacuucguggucaauguggcuccuccaaagagcacugggaaaauuuuggaaacugccuaagcugcucauuuuaccagaugaaugaauuuuuugcuuuguucugcagaccugcacaacaccuccaaacauucugucuugggaaagaguagccugcucucugcagaguggguucuaugcagaauagacgcuccacagagcccgucuuccccacgaggcccucagccacugggccuggaagagcggcaucguuauuacagaaaagaggcugucuggugcccucaccaacaccaaggcuaagggcaaguuuuguuuuauaagcaagauaaaacuuauaaugaaaauccacaagccauuccuccucuuuauauuuauuuuccuggucuagaaacaacacacgacaagagggaggcaagagagacuuuucuaaaagagguaagagaaaacauauccccuuuaaacugauggaagguguguguggggggguguaaaauaaacagaacuaggaauagaggccauggauuaaguucuaaguagaugaagaaaacaucagggucuuaaaaaagugcaucuucuggagacugaguuuucuuccguuaaacaagcucaguuaaaacuguucccugccaggugaagugggagucuagugagaggggcugaacucagccagcgcuacuuaccaucaugugguagucuucauguccuucgauagguucacugaccacauuuuuuauggagcccaugggcaauuucucaguccgcucuaaguugagagggauuacagugauuauucaaagggcccuccuguucuaacuucucugacucagcagucccucaucagggcugguggcugcgggaucuacaguaaacucaagugacuggcgccaugcccucuggggacaacacgacagggucuucugaccagugcacauagggcuucgugugggagcugggaacuccguaggagcaagugggaaacuggguuuggcaaugguauaguaaaggucucugagggcagaauuguaucuucccugggauuauuuuuuaaaagucugaugguuaauaaauauccaagaaaggccaggcgcgguggcucaagccuguaauccuaacaucuugugagucaggauuuggccaagguggguggaucaccugagaucaggaguucgagaccagccuggccagcauggugaaaccccgucucuacuaaaaauacaaaaaauuagccaggcgugguggugggcaccuauaaucccagcuacucaggaggcugaagcacgagaaucgcuugaacccggggggcagaaguugcagugagccgagaucaugccacuuuacuucagccugggccaaagagcgaaacuccaucucaacaaaaaaaaauauaaaauaaauaaauacccaagaaauuccuuuguaaccuuaugcaagcccagcauugacuaaggucuugggcaguagggagagucaagaggccuacgaacaaagaggcaacacguuccccuguggcucucacaagggaaggggagugccuggauuuuagggcuagauucuauaccacgacccugcucccuuccccggccucccuccucgaguccuccgcacucuauauucacacacuuuuaugaaguucucuuaaaacauuuauaaccuuuugugauuaacacuugagauaccacugaucacauggggucagaagacauugaggcgaguuuaaggaggauggcagguaagagaagggggcagcaagggaugccuggagugagaugagacugccgggagugagccaagugaagcgggacugggugaggucaggggaggcgaggugcaccugcacaaggggacauggccauccuggagcagcagacaccucagggacgggggcgcagggggaggggggcagggaggcucagcaaacagcuaaaccaaguggaaaaaaacuugcagccuuugcagaaagaaaaaucuggaaagauagagucuaaaaauagauaaguuggccaaacagacuaggaauuuagagaccagcguucuggucuagcuggggacuuaagacauuuuacuucaguucugugggccucaguaucugaaaaaugggggcuggggagaagggaccugaagauguuuauuuagguuuggacuucuaguggcucuacaacagucggcccuaaagcaggaccugggcagcagcugucuuuaagauggaaacuuuuaaaacaccuuucauccugaaaugucuggagauuucacaaaaauauacaacagauuucuggcuucucuugaaaacuccaaaaauugggcaauucuggacccacacuccugaucacuacaucagaccuucagccagauucaacuuuccuacgagcaggguacaugcucuccuccagcggcuuccgguuuccugccuggagcuuguucucauucuuuugaggcuguuagaacugccuccuccuacacaagcuagcagaguuuagucaagaguagcagcccuuaagggucacuuacucagcaaagcgccccacgaagaggccaacucgcugcugggauggucauuccauagccgcuucuucuugccagcagaaagacgaagccaguggcuagcagccaacucccagaacaagcuguccucuuaugagugcuuaugacacuuagguaacaggacugggcaagugacaagacugccugccccuugggcuccagagguacagugcuaugggugggaaugaaaaucuuaaccuuguucaacccuagaaaacaugaguaguccauggccaugcuccucaacaagacuggugaguaaggaggcuuucaagggcucagaagccccaacauauugagcuucuucuacagcucucccuuuaggccaaagcaggaaggcggcugcuccuacuagcaaaaagaaaacuuccaauacagggucaggaaguucuuguucugucaguuccugcaguuaugauguguucccuauacaacuuccugacacagaaauauuccccaaggaaccaaugagcacuuacagacuuaguucccauccagacuucucugccugcaccuaucuucauggcagggucuuuccaggucagccguagcaacugccuucaaugaggcugcccacaagcaaaaguagagguccagcaagaggcaggaagucuaugcacuucagcaagugaaugugaugagacagaacuaagcaaaaucaccugcaaaguugacagaggcugggcagcuuacuacugauaaagggaagauggacaggcucuacagaagagaaugaucuagcagaggguucaaaggcccuugcaaaaacuggggggaacccucagauauucugcaaaacuugcuuugaccaugcaguuagaguugaaugugaaaugaagaaaauagcaaguuaucauaaaauugauagaaaacucaagcauuuuuggcauuucaauuuuuguucauuuuaacaaucaguauaggguugaacacugauuuuuguguuuuagaugauuaaaaacucucucuucccaccaccccugccccaauuauucuccauaaaacuuggucccauuuuaaguggagucucacuaaauggucugucccugaaaccagugaacgucagaugaugggacccccuauacuucucuuuagcauuuaccucgaacacugaauaccuacagugcuggucagaaacaggugauuuaggcauguucgguucccuccaggaaucuaacagggggacagacaagucagagaguaaugagugcucuggggauauaaacgaagcgcucuaugaacagaagcggcagcaagucauuuggaggguggggggagaaucaaggaaggcuucauucagagaggacauuuaaguagggccuuggaagauuuuauuaauaacaaggaaugggaaaaaggcauuccagguaagggcacagcaugagcaaagacaaggagcugugcaaagcacacugggagcuucacagagagaugcggcuaaaauacacaggggaccacagggcaaacgggccagaagcuggaaccaaaauuuaaacuaaggcccaguguugagaacacugaacgcuaugguuaggcauuugaauguguccuuaaacagccaaagguccuugagcacggguacccaggauaaaaagcaguagguaagauggacaggacagaagaaaacacagauggggcagugaaacaggguaacucgcuuugaacagaccaaguuuaaagaugcuugggaacuuuaacuggcacaacaguguggcaaagaaagggacagacaguucugcaguguaacuaacaagacuuuguaaccaucugggggaagggagagggaggacagucagagacacuucccagcaaacagcaaggcugauccagacaccgugcacaggcggggguggggcaggcagagggcaaccaggcggggagggagaggcagauuccucggcagcgguuaggaaaacuucaccuacuauagggucaaacucugaccuacaggggccaggcaggugacaaaugaacaaagcuggcuacuucuaagauaaaugggaccaugaagacuguaguauggcccacuggaaaccaccacucggcucuaguggaucgaugccaugugagaaugcaggccccaaagggccagaucauuugaguuuucaagagaagccaaaaaaaaaaaaaaaaucagauuagugaaaucucccaauuuuuacagauugugugucaucccacaaaacauuuuucuguggaccagauuuggcccuugggccacguguuugggacccccaaaucugugugcaacugaagagccacuguuugguggaucagcccuaagaucagacugaaaacaaugagggaaaacgguccaaacaaaaggcgagcaucuaaaagcaaauuuaaaagccagaagcaagcaaagcacaguggagagagagguuucagaaggaggggugaaaucgcacucuaaaaugugagugcugcugggugccagaggcaggcagugggccagcaaggaggcgaggaagaacauaccuuuagugccaauccacagcuggucuuguucuaguuuaaaggugagucucacuuuuccuccagauuuauuguacaugccggacagcgguaccguuggcaggcgcuccugaaggcacgagagaaugguaagagauggagggacagucagaaaaaaagagaagggggccaagcgcgguggcucacgccuguaaucccagcacacugggaggccaaagcggucagaucaccugaggucaggaguuggagacuagccugggcaacaugguaaaaccccgucucuacuaaaaauacaaaaauuagccaggugugguggcacaccccagccugggugacagagcaagacucugucucaaaaaaaaaaaaacagggaaaaaagagaagggacaggauuggaggaaccucaagucagacgguggggcugccucauuuucagaaugcucacaaagaaauccgccuuaccugggcccccuuaacagauggcaucacaucuucagguuuuccuuuauccaacacuuuccuguguugcuauaagucagaagagagaaugaaaugaaacagcugacuacauuucgucguguuacuauucccuugaaagagaggaugaagaaagccuuaguguuuuggcucaaaagcuuuuaaugacgacagacuauggauccuuugaaacuauagcacagugcuguccagcagaacuuucugggagggcgaauauguucguaccugugcuagccacuaccuacugcugugacuauuacacacuugaaaugcagcuacuaugacugaggaacugaauucuuaauuucauuuuaaccagccacauguggauagcuaccauauuagauaucaaaguucuacagcaaacgggauuuccagauugcccuccuccccucaaaaaaaaaaaaaaaaaucaccacugaaaugauuaaaccaucaaacuaaagagggcgacaaaggguguugcucuccuagcagacaaaaaauggcacccaccuuuuucaacuuaaacuuccagagaacacuauaagaugcugguaauccgucuaacugccuaggaggagcaguucuucaacaaauggagacccagcccaucgccgaaguuuuccccacugcccuacccuuaacuccagcuaaacaggaaccuggaagagccaccuuucagaaagaaaugcuuauuacucuauaaccugacauuaagaagccucuaaacuccaccccuaccaccugccccaagaacucugaggcagcucuucaaggauucuaaguucagggccccuuaaacaguucuccugccuggcccaaaugccugagucuucuuucuucuccaucuguggccuuauaggcauagccacugcuuggaaggcuggaacuaggggacaaugaauggauagaagguaacaauuuaaucaaauguaagcacuaggcagccacaagccagcccaaauccucacuggcaugguggaaucccucugggaggaauaaacucagcacugccagacugcuagcaaaaagucacuccagacaucacccccagaccccuuaauaagcugguaaaaaggcaagggacuauaucccucucauuaggucaugugaugcaucauaauuggccucaaugaaacacagcagcaugggcuggaaguacaauucgagucacaccuuucaaguaccuuuugaacaagauuuccuguacuguggagaacaguucuaagccuguuaagcuaccauuaguaacuaaaaaccuguauuuaggaggcauguuaugcuccaagggugugaccauugcgaccacuccuaucugacgugcucacauuucacuauuucauacauguggcaaagaaaaacaggaauaugagaagaaacucaaucgguuucaagacacugagaccccauaugugggggugaagucuccaaaucaacaccuuuuagauaauuaauauagguuuauaaccccuuaucugaaacccuagaguuuugaacuuucaggguuuuggaauuuuuauaaagauaauauugcuuucaaauacauaacaaucuucucuguggggucuggggcaguaccuugucaccaaagaggaaaauucacacuaauucuggucagguuuugcuguuaaauuuauaaaaacacuucucguuuuuauacuccuuugggguuuuggaagcacacaugggggauuauggaucuguaacacaaacuguguccuuuucuuacuguuggucauauaucuuagugucuauggucacuaaaugauguugauugaaguuuaucuacucuacuucagacacaguugagaauaccugucuuccuuggaacacuaggaagaacgaucaggaggcuacacagcaaucaguauaauuugccagguaaaaagauaacaaguaaugauucuuacaaccuguuccuuccauaguaaaauaaucucacuuuuccucguuacgugaaagaauguuaauggcuaugaugagcacaagacaaggcaggaucucuugcagccaaaagaacagagaacguaaaaaaccaagcuccuauuucacagaucaggacaaaaaaauaaauaaacaaauccaucaguguaguugucuuccuacucagcuucauuuagcuuccugaaacggucagcuuuaggggaaccuccgagaguuguugauuuccaugccuagccaggcuuguugacuuggggaaagccacaaaccaaaaagccaaauguaagcacuuguacaaaaugagggcuuacuucuaguacugguaguuuucucuggcacuaaauaagagagagaaacccacgucugauuccuuucaacacauggucugaagccucccuuuaccaaggucuuauccuaaaguagguagacuugagacacacugacccgccagaugagacaaaguugcaaaucucagguaguugucaccuccacucugcggcacccaacugcugccauaaauuuccaucaugggcccuguccaaaaaggagcuuauucuagggagaauauaaccagccacggcucaagaggacaaagccucaaauuucucaagaccaagaagcacaagauggacucacuuucugccugcagagaggcuccuucuuguucucuucggccuuugcauccugcugcgcagcaucuuuggguguguuuacugcuaaaacaucauugaugguggagccaaccaccaugaucuuggccccacuggucacuuuuauuucucucaauguuuuauccucggggacgagucccuuauacaugacuuucugcauggcaggcgggagaccuugggaaaagguagaagguggacagugaaaggaaggaaggacagaaaaauguauggauacuacacagcucuuugguaacagaccaaaaagugaauacugccuccaccaccuauuagcuuugugaacuugggagauuuacaaccucugaaccucaguuucuagaacuguagaagauuuauuagaguaaguccuucuguacagaccuguuucaaggauuaagagaccaaugcggggcauuuaguacgguggcuagcauugaauaauuguucaguaaguacuagcucucauucuuuccaaguuguuccucagucaucuaaaucauucacauauuaagugagaauccacaggcaucagagcuacagaagccaauagggacaaaacuccuguucuuaauggagauuacaaggcuacauguagaaagcuuuaaaaaaaaaaaaaaguucaaggccaggagugauggcuuaugccuguaaucccagcacuucgggaggccgagguggguggauaaaauaaaaaaaacuagcccggcgggguagcgggcaccuguaaucccagcuacucgggaggcugaggcaggagaaucgcuugaaccugggaggcggaggcugcagugagccaagauggugccaguacacuccagccugggcaacagagcaagacuccgucucaaaaaaaaaaaaaaauaggaaaaagaaaagaaaucucagauggcaaagagcuaugaacaagguaaaauuaagaaacagaaucgacugugaagaaccagcaucaaagucaauagcagcguuuccuaaacuucacuuagaagaauuaccuaagauauuugcuaaaaauaaauuccuggcuacaucccagacccacugaaucagaaucuccugggaaagggcccagaagcuguaaaacaagcgccuuaggugauuuuuuaauuagagauguuagagcaacaucaaugagaaacuggggccuaaacgucagacuucggcuuuaaucccagcucugcaacuuacuagcucuauaaacuugagucucuuuccccagcugaguaaugggcauccaaguauccuucagaagacugcuguaaggauggggggaccugaugcaaggaaagccaccaggugccuaguagggugcaagggccaucaggaggcgggguggggaagacuggcugucagcgccacaggaauuaccuguaaucgaguggaucuucuguuucagcucggagccugugcuguccagggggaacuucacgucaugcuuggucuuauuccagaugaucuucaaguccaccagcucccugcccgcgccgccgcccgcgucuucgccguugcugaccgaggccugggcugcgggguccccagggggcugggccggggccggcugcaggcugccucgugcggcgccggaguccucggccgccgcccccgccgcggcuucagccuccaggcaguugacgggccgcgcgggagccucaguagccacagucucggccuccguguccaugccagguuccuccaugccugcaaggggguuagggggugggcgcucgccgcgggcugggcuugggaacggacgcuguccgggcgccgccggaccuccguucccgagccgcgguucucccucccgggccgggccgcaucccccagaggagcgaccgcaaccucagccccggcccggcgcccgccacccccgccgcacucaccauccggggccccggccgccgccaugaugauuguguacaacacccaccgcucccgcagaggccgcugggaagaggcgagcuggcugagauuggcccccgcagcagccccuaaucucucacagcccggccggaaacagguggagguuucuauggagacccgccuccuccgcucccagguccggccccugccacgcuuucgcuuucccaagcugaagggggcggguccgggaaauagcccuuucucuggccucugcccccugguggcgagugcggccgcagccguccaggggggcgugggauuucgcgcua

SEQ ID NO: 15387 - RNA, 11539 nt, Homo sapiens
cgcaggcuuuuguaacguucccagcgccgcguuugaauucggggaggagcggagcggugcggaggcucugcucggaucgaggucugcagcgcagcuucgggagcaugagugcugcagugacugcagggaagcuggcacgggcaccggccgacccugggaaagccgggguccccggaguugcagcucccggagcuccggcggcggcuccaccggcgaaagagaucccggagguccuaguggacccacgcagccggcggcgcuaugugcggggccgcuuuuugggcaagggcggcuuugccaagugcuucgagaucucggacgcggacaccaaggagguguucgcgggcaagauugugccuaagucucugcugcucaagccgcaccagagggagaagauguccauggaaauauccauucaccgcagccucgcccaccagcacgucguaggauuccacggcuuuuucgaggacaacgacuucguguucgugguguuggagcucugccgccggagggugagugucgcugcuggggaacuggaacugccugcggggcaguuggagcgcccagaccuggagcugcuggaaagaguacccagcaagggagagccugggacuuggagcugcuagagaagggugcugggagccucccgcuuacguauggaaagugucuuugguaagggcuucuuggcucugggagcugcuagaggaggggguuccagugaaguggagucugagucauguugcugauagggaagucagcuucuggacgcgaggugcuggggggaggggugcugguaauggacgcuagggcccuggaguacccagggaggagucccagguuagugaugccgcgcccugggagcuucugggguggagcugggucaguggggggguaguuggagccagacuucgggccuuccgggggagauacgagucaggaaagggaucuggugcuggggacucggagcuuccggaguggggcugagagaggacccccagguaaggggggaagcuaguaggagaaggggugcugcgaaugguuguggacaguguuaaggcaggguccagaugccgcugugcuggagaaggaauggggugggggcauagggaaggagagaaacccaccaagaccccucuuucaucccuugggaguccagaguccaguccugugcuuccuuugccugguaacccucucccuuccccaccggccucaauccaccuccccaucccuccugcccucuccuucccacccacagucucuccuggagcugcacaagaggaggaaagcccugacugagccugaggcccgauacuaccuacggcaaauugugcuuggcugccaguaccugcaccgaaaccgaguuauucaucgagaccucaagcugggcaaccuuuuccugaaugaagaucuggaggugaaaauaggugaguugcugagccugcaggggugcuugacaucacuacaagaggcuggaauuuggaggaggcugggagaaaggaaggagacaacccacaagucaguaucuugccuacagaugcauuauuuuuuugugccccaaugcaauauuuuuuuuuuacaaagaauuugaauuuguuuuuauuuuuuaaauuggaagguuugauugaacaaaaaguuugauucagaacuccuuuuaaacaggugaaagcuucaguaauacgaggacagcauuuucuuagggcagcccuuugcugggcuggaaaacagcuguccccuucagacuucuuugccacagucucuacuccucccuauucuucacagacuugccaagucuuggagguuaacuugcuugauccuugaaggcauuggaguuuuacuaucccugucaguuccuguuucaaagcauagccccuuucuaaaaggaggggugagaagugucacuggaggcaccucccuggugucagcaugggaggaagauuccugggcaagccuugcuacauacaaggagcagaggcuugugggaucagauggcccugguucuggauggucaaaccuuaacuagccuucugcauugacagaugucagaggcuggcaucuaaguaccaacucuuccucccucugucccaggggauuuuggacuggcaaccaaagucgaauaugacggggagaggaagaagacccugugugggacuccuaauuacauagcucccgaggugcugagcaagaaagggcacaguuucgagguggaugugugguccauuggguguaucauguaaguugggaguugucucuggaccaaccuggucucagcaggggcaacuuugggacauccuaccuggcugaccuuuucuguggaccuuucggccugcuuuacagaaagccuacuccaagggacaagucauccccaaacaaagccuaauugucauaucuuucccugucacugguguauccugucggauuucugcagccuaggucauggguacagcggaggaggaggagggagagucuccacaaccuuacuguaguccuuugcuagaguuguccacagggcagcaucaccaucaucugggaacuuguauacacaaucucaggacccagacuacuuacuggaucagaaucuggauuuuuaacaaggucccuuggugauucccuugcacaauaaggucuuaaacaccgaugagcauuagcauggugggggaaauuaggccaggaguuacagauggaaagaugaugugccaguggucugucuggauuaagaccaucagcagcgguugguggcaggcagaggcuugggccuuuucagguguuaucuuucuuguuuugggccuagguacuggagaguuagaaaugaguuguagcaauggcuuucauacgucuuugcagugggguuuuuucaaaugaaaacuugaagacuuaaguacagaacugcuaaagguggagcugcuucuguaagcgcagguagcccuuugaccuguuuugcaugacaggcagcaucugaggcccuugcacagaguccuagaugaccacaggcuauagcuaaaaaaucacuggcccuuaagaauccuggucucaccauguguauucugcugagggcuuauucuagccaaugucauggcuucuggggcugcucaguggacuuagggauugucuucaggggccccagaguuagagugaguguccagaggaugccugaccuuuguucugacccugagaugauuucucucaugucuggguuguggcugggagacuggugccaaauccuaccuugugcuuacagguauaccuuguuagugggcaaaccaccuuuugagacuucuugccuaaaagagaccuaccuccggaucaagaagaaugaauacaguauucccaaggugacuaaugaugcuuuaaguuuacauuuauuuuguuuuccccagaagcuguuuauggagcccagcaauauccuaggaccagaaauaggucuaucccaccucuaagguagccacagagcuugagagggccugugucugaaauugcauacagaacuugacauguaugugcacauaagcauuuuuucuagggggagagaguuggcagauucucaagagauuggguaacccaaaaguuguguaaaaagcaaaaaacaaaggagguaggaaggaguaggaggcaaaagugcuuaaucuuuagaaaugguuuaucuuaauucaaauggauucugccacuuagcgagaucacauugggcaaauggccugcaucuuuuuuuuuuuuuuuuuuauuugagguggaguuuugcucuuguugcccagugcaguggcaugaucuugacucacugcaaccuccaccucccagguucaagcgauucuccugccucagccucccaaguagcugggauuacaggcacccaccaccucgccuggcuuuuuuuuuuuuuuuuuguauuuuuaguagagacgggguuucaccauguuggccaggcuggucucgaacuccugaccucaggugauccacccgccuuggccucccaaagugcugggauuacaggcgugagccaccauacccagccuggccugcaucuucugaaccauaguuuccauauauaaaguggaguuccugccuuggagcaccucacagagugccuugcauguggugagugcucucagaauuaugaaucacugugaaucccagggcuuccuaauggcauaguugugugcauuuucuuuuuuuuuuuuuuuuuuuuuuugagauggagucucgcucugucgcccaggcuggaaugcagugguacaaucucggcucacugcaagcucugccucccagguucauggcauucucccgccucagccuccugaguagcuggaacuacaggcaccagccaccaugcccggcuucuuuuuucuguauuugugguagagacaggguuugaccguguuagccaggauggucucgaucuccugaccuugugauccaccugcuucggacucccuaagugcugagauuacaggcgugagccaccgcgcccggccauggugugcauuuucacaaccaccaacagaaauacauuuaaaggaauagcugguuccugcagaagccuagcacacagccaguuugaaguguaguguccuugugugaagccaggaggccugucaccauaaggacagacauaguaaauccaucacaaagugucaguucacugucagagacagcauggaaucaagccagcuagacaaggccuucacccucucugugccucacuuuccuccucugugaaaaagggaugauaauagauccccaccccuuagaugaguuggugagggcuaagugagcuaaacacaggagugcuuagaaugcuuuccuggcacauagugagugcuaggaaagugaguugguguucggccacaguccauugacccuucugucaauggugcucaguaaagcugacaguggagaacuuggcauugaaccaaguugugaaccacugaccugugguguauuugagacugggggcugcaugugggcuggggaccugcagcuccuuugaggccguacuguacuccagguccccuucacauucugcuuauggcugucccucucucugccccagcacaucaaccccguggccgccucccucauccagaagaugcuucagacagaucccacugcccgcccaaccauuaacgagcugcuuaaugacgaguucuuuacuucuggcuauaucccugcccgucuccccaucaccugccugaccauuccaccaagguuuucgauugcucccagcagccuggaccccagcaaccggaagccccucacaguccucaauaaagguacaacaagggucuggguaagagagcagaccccccagagaaagcccagguuguaggggugugugcagcuuagucccuggcccugagagcucagguguggaguaggacaggccucuguccuucaauccgugguuccaaugcccaucugcuucucggcccugccaggaaagacugaccuuaccauggcuggauaaacguaccaugcccaagaagaagaaaauggauugaaugccaagccugaaaaauucuuucaaaucacuuuaauuaauuuaauuuuuuggagacagggucucuccucuauuuuccagguuggagugcagaggcacaaucacagcucacugcagcuuucaacucuagggcucaauugauccucccaucucagccucccaaguagcugggacugucaggcaugcaccaccaugccuggcugacuuuucuaauuuuuguagagacaguguuuugccauguugcccaggcuggucuuggaacuccugggcucaagcgauccuuucaccuccaccaaaguguugggaugacaggcaugagcugcuacaucuggccuuuaaaaaaauuucuaacacuuuuucaugauucauugaaaaacauaaaaauuuccuuuuuuuuguggcgugaucccggcucacugcaagcucugccucccggguucacgccguucuccugccucagccuccugaguagcugggacuacaggcgcccaccaccaugcccggcuguuuuuuuguaucuuuuaguagagacgggguuucacuguguuagccaggauggucucaaucuccugaccucgugauccgccugccucggccucccaaagggcugagauuacaggcgugaaccaccaggcccggccuuuuuuuuuuuuuuuuuuuuuuuuuuuuuuuuuuuuuuuuuugagacagggucuggcucugucuccuaggcuggaggggagugguaugaucucgauuucacuaaggauacauaguuuuaaaaagucacuugaaauacuuuuuuucucuguggauauaucaccaauuugauguacaacuucaguucauuuuucaguuuucaauuuuuagguauugguuuuucuuaaacuucauuuuggaauaauuuuaggcuuauacagaaaaguugcaacaacaacaaaaaacuccccagaguuccuacauaccuugcagcaauuauuacaguggaauuuuuuuugagacaggucucaggacuugcugucacccaggcuggaaugcaguggcucacucauagcuuacugcagccccaacauccugggcucaaacagucccccugccuuacccuccagaguagcuaggacuacaggcaugugccaccauacccagcuaauuaaaaaauuuuuuucuuugggaggccgagguggguggauugcccgagcucaggaguucgagaucagccugggcaacauggcgaaacgcugucucuacuaaaaauacaaaagacuagccgggcgugguggugugcaccuguaaucucagcuacucgggacacugaggcacaagaaucacuugaaccuggaaggcggagguugcagugagccgaggucucaccacugcacuccagccugggcaacagagcgagacucugucucaaaaaaaaaaaaaaauuuuuuuuuuguaaagacaagaucucacuaugucgaccaggcuuaucucaaacuccugcccucaagugauccuccucggccucccaaaguguuaggauuuacaggugugagccacugugcccugccuagaaugauguucuaaugguaauuuuucuuuuccucacuuuuuuugcauuuaauaauuggaauucuucuguaaggaagagcuguuccuucucuccgauugauuuauuuauuugguuaugucugaaauagacucauggauauuuuuauucuuugggcuauauuuuaaaggauuacuuauuucucugcuuuuauuuauuuuuuuaaauuugagacagggucuugcucugucucccgggcuggagugcaguggcacagucguaccucacaguagcuuugaucuccugggcucaagugauccuccagccucagccucccaaguaguugagacuuuaggcaugugccaccgcgucugaccaauuuuuaaauuuuugguagagaugaggucuugcccacacuggucucaaacuccugagcucaagugauccuccugccucagacuccuacuuuuuuucuuucaguuuuaauuuuuuauauagcauuuuaaaaacuuaaggaaauuuucaguuacccgaagguggagagaacuguaugaugagucccauguuucaucuauuuuuacuaguuaucaacauuuggacagacuguuuuauuuauuccagccuccugccuuuuuuguuaccgguguuuuaaaaaauuauuauuuacuauuuauuauuauuuauuugagacauucuugcuuuguugcccaggcuggagugcuguggcaagaucauggcucacugcagccuccaccuccugcguucaagugacucucccaccucagccucccaaguagcuaggacuacaggugugccaccauguccagcuaguuucuguauuuuuaguaaagacaggguuuugccauguugcucaggcuggucucaaacuccugagcucaaacaaucuaccugccucggucucucauaguguugggauuacaagugugagccacugggccuggccuugcuggaguguuuaaagcaaaucccuaauaucuuauuauuucauacccaagucccuaucaugacaucguuuuuuaauugaaaacuuaaacauuuuauauuauacaaggagaauuagcacaugguggugggggaauaaauaaauaaggaaaaagacaauaagaauaaucuguguuucuacugcccagauauaaucagcguuaaaauuucauguuaucuuuucaagcuuuuuugguuauaaauaagcauauaaagcaaauuuugggguggaaaaaaauuucuuguguuuuuauuuaaaugccuacugaauccauucuguggaugaacugaacuacucagcccuuccaucugccuggaugcugaagaugcuuuccauucuuugcucaaagcugggcagcucugagcugcuggugccuucaagcuguuugccugaguggcaggucauccugcagggccacaccguugggucagaggccacggcuucugaagaucuguugccucacagugagcacuaugugccugucaccugagcauggcagcugcugcucuaguaaccaggcacugauucaguuuccccaaagcagugguagcuaagagaauuuuucuuucggaagaguuucagcuguggcaggggagucccgugcccuucccaacgccccuguuuuugucaccuuccuaggcuuggagaacccccugccugagcguccccgggaaaaagaagaaccagugguucgagagacaggugagguggucgacugccaccucagugacaugcugcagcagcugcacagugucaaugccuccaagcccucggagcgugggcuggucaggcaagguggguacugcggggcccugggcggggcaggauugcuuggggcaucuggaaaaggcaggaggaggcuuggccaacaaagcacuggugacuuguucaggcccugucugcauaggaccauugguuuccccauuuccugauauccaaggcccugcuuccguggcuccugccgccuuuucugauccgucuuuuuuacucuagcaccucgaugugccaccuucauacgcuguuucuuuugcucaguaaguuccuauuguaucuucaagacccuugaaauaacagacccagauguacugcagccucagggcuuucucccugguccuggcacgaaagcacuucuuccagacaccacauggcucacacuguggccuccuucaagugucugcuccagugucagcucugugagcaucucccuggccccucugcuggugcuucucauccucuugcccacugcauaguucuccauaacacuucucacccaacauaguccaacauguccuucuuuguuuauuggauuuaaauuaagggguuuguugcaugcacugaacguaacauuuugauguguuugcaacuggcuucugucuucacaguuucuuaauuacuccaaacuggaaaacuagaugccucugacucuuaccaugauagaagucacugauauuuugcccauacuuaaauugauuagucuuugccccuacaaccacaguguaagcuccguggaggcugggguuuugucuguugcucacugaaccugcaacagugccuggcacgguaggccuucaguaaaugggucaguggaaugaaggagugaguggaacuuggugcgcugugcugagacuuucucugcagagauaucugugcugcugcuugucugagccugcuggcagcagaggcccugcuuugcucuucucuggggcccuaggccucucaacugagcccagguggggugcccagcaggcuucccuguucccuggugugggccacauguguggagcagaggggaagaggcugguccugaccaacuaacugucugucuguuucugucucagaggaggcugaggauccugccugcauccccaucuucugggucagcaaguggguggacuauucggacaaguacggccuugguagguuucuuccagaacaggugggugacucaggcacagccaggugaccuuuucaguuguuacagacucuggccuuuuugagcucccagguacuguucucagugcccuccucucuccaucccaggccucccaguuccagcucccagugcucccugacuccccagcuuuuuuuuuuuccagagacaggguccugcucuguagcccaggcuggagugcaguggcacaaucauggcucacugcagccucaaacucccaggccccuaaguagcugugacuacaggcgugcaccauuaugcucagcuaauuuuuaaaauauuuuguagagauggggucucauuacguugcccaggcuggucucaaacuccugggcucaaacaauccuccucccucagccucccaaagugcuggaaucacaggcaugugccaccacgcccggucccacuccccacuuucuauucccccuuucugagaccucucuccaccgaucccuaggguaucagcucugugauaacagcgugggggugcucuucaaugacucaacacgccucauccucuacaaugauggugacagccugcaguacauagagcgugacggcacugaguccuaccucaccgugaguucccaucccaacuccuugaugaagaaggugagugccguccggcccauggggggugguguugcagaagugggaccugugcuggaggaucagacucuaauucuggaaccccuuaccuacuuuucauccagaucacccuccuuaaauauuuccgcaauuacaugagcgagcacuugcugaaggcaggugccaacaucacgccgcgcgaaggugaugagcucgcccggcugcccuaccuacggaccugguuccgcacccgcagcgccaucauccugcaccucagcaacggcagcgugcagaucaacuucuuccaggugagcuggaggucaccaggcgcaggagagagcugggguaggcuccgcaugccuggcaguggcccauguggguugaauguggagugagcggcucagguaccuauaaccuguugugucuucccucuacucccuaacauacacuggccucugggaucgccaaccccugcugcucuucucuugcaggaucacaccaagcucaucuugugcccacugauggcagccgugaccuacaucgacgagaagcgggacuuccgcacauaccgccugagucuccuggaggaguacggcugcugcaaggagcuggccagccggcuccgcuacgcccgcacuaugguggacaagcugcugagcucacgcucggccagcaaccgucucaaggccuccuaauagcugcccuccccuccggacuggugcccuccucacucccaccugcaucuggggcccauacugguuggcucccgcggugccaugucugcagugugccccccagccccgguggcugggcagagcugcaucauccuugcagguggggguugcuguauaaguuauuuuuguacauguucggguguggguucuacagccuugucccccucccccucaaccccaccauaugaauuguacagaauauuucuauugaauucggaacuguccuuuccuuggcuuuaugcacauuaaacagaugugaauauuc

SEQ ID NO: 15388 - RNA, 1186 nt, Homo sapiens
uuuuuguguuggcccccugccgcucgggggcucucaccgagcggcggcgacaccuccaagccagguacuauggcggacgcggccuggcuucggacgagcgccccacugcggggucucuuaagcagggauugcacgggcggcgcgcgcgaggcggggcuggcgugcgcggauaggcgggccgagaggcggggcggcugacgucacaaagcgcacggcccgcccacgugaccccgcgcuuugugacuccaaagcgcggaaacugaaagagcagggacaacgggaagaaccaucugcuucaaaagggagggggguugcgcgucaggaggaccggcucacagggaggcucgguggggagagcucgccuugcaggggcugcgugcaguuuccacugcaaaguggcuugccuagggguggccggcuaacucccccuuccccacaggccccgucagcuccucuaagccucccaauuuaagugagcauuaugguugcuacgcagaaaacuaugguugcuaugcaagcgcucccuagcugcugcuuccaauaaacuggcuacccuauacucuugacaaguggaaaucguggagcagccgcugccaagaacugauaacagccaccagcaccauacagauuuauugagcucuuacuaugugcuaggcacagggcugaucgcauaacaacauugccaggcucagcagccacguugucuggguuggaucccuggcugugggggcucuagauuuaaccccucugugccugggucuccuuggcuguaaaaugccauuaaaaauaguacuugguuuacuuggauuaaauaaaugcacauaaauccauagucuaagaccaugccggugcauugacguggcucaaugcaccgaaauauuaauagcuguagcucaauaaaugucaauuuaacaacaaaaacccuacguggucaacaugacauuauuuccgauuuauagaugauggaacugaagcuagcaaucauguacuuucugaauuugcagaaggggaugccugcucaguggcagggucccgauuccauuccuaagcgcaaaugccaggaacagugacaagaacccccucaguagauuggaauuuuuuuuuuccuuugggcauggggacguuauuacauucagaaaaaaucauaauauaauaaaauuacauucauaaacgauaguuauuaucg

SEQ ID NO: 15389 - RNA, 96139 nt, Homo sapiens
gcccggggagccaccgccgcgccgccguuugggccgggaagcgauguaguagcugccaggcugucccccgcccugcccggcccgagccccgcgggccgccgccgccaccgccgccaugaagaagcaguucaaccgcaugaagcagcuggcuaaccagaccgugggcaggcgagugcgccgggcagcacgggggucgcaccggggcugggggcggagggcggagggcgcgggggcgggacggcuccuccgcgguccggcggcucugagcugggccgcagccccugcccgagaccagcggggcacgggcccgggggcugcgccgcgcugaggcccgagcgccgcgcuccaggcggcccgccugucucucagcgccgccgggcucccgagaccugcaggggagggccgccgccuccuccgccacaccgcgggguccccugcccauugucccugccccgggagcaucgcccucggggaguagacccgguccuucuccucccuucccgggggccgagccagcugggaucgcugcccugggcucaacaacggugacuucugucccuaacgcugugccgagcgcugugcuguggggggcggcagucccaggcuuucccggugcucccgcuguuugcgaguccuucuccuguaagugcauggcggcaagaaauggcuagagggacaugaaagccagccggauuugcucagugaguucagaacgcccuuugagggaauucggagguggugcugucucaaaaccagggcuccuaggaacuggacugcugcugccaguucuugacauuuagaaauuaggaauuggcggaaaaggauuauggagacgccuugcgccaauuuaaaaagucucaccuuagguuuggaaacaaaugcuucuuuaucuuccuuugcuacgguugaagugcuuaacaagaaacguuauugauuauuaaauggcaggcuagaccagaguugguagaucagguugucagaacaagaaaugauuugugguuuuugagaguuucuggaggugacugucaugugcuguauuaucuggggcuaauauuucaaggucuuucagggcagcuggcuguacuguaccgauuuaguguuuauucagcaaagagauacgaaaguaugaauuucucacagcucuucuuuugauuuucuguuuuuaacaguuaaggggaguuugguuuggcugaagcacgugggacacuucuuuuuuuugaguguaugaaaauacuuuuacuuccucucgaguuuucuaaauuugcuuuuuacuguuucauuuccuccaucuuuuugcuuaguuuccuuguuuaauuuuuucgauucccuaccguauuauuguggugagaauuaacucuuauuuucaggguuaaucgcugccccuaaagcccagacaaaccuacuuuucuguuauuugcaggaaaauuaaagaaauaaugcugagaggaagguagacgugugguaauggcggcugauguuucaaggaacaguuuacaagcacaugauaauuucuugugaguuucguacccuuguuaguguucugagcaacgugcauuguggaacuaguauuuaguaagugccaagauacauuugucaaauagucguuuggcuuguuuuuacauuguucgugacagguaagggacuuucacucuuuuuauacaaaguucugagacuuaaaucuaccaagcuauuuagggucucuuugacuccugggucaucuuagaggcuucucccuucacacuuuuuuuuuuuuuugagacagggucucccuuugucacccaagcuggggugcaguggugcgaucuugucucauugcagccuugacuucccugggcucaagcgacccucucgccucagccaccuaugugguuggaacuacaggugggcaccaccacauccgcuaauuuuuguauuuuuuguagaguggggauuugccauguugccuaggguggucucgaacuccuggccucaacugaucugccugccuuggccucccaaaguucugggacuacaagcgugagccaccuugccuggcaccuucacauuuuaaaauuccggccaugcuugccuaccuucaguuuccacaggaggucuugcuuucuuaccugcuagcaucuacuuggaacuccuggaagccucucccaccacaccuuuucuccaggcaccucuugcucauucuucagccuucugggaaaggucccucugccucugaaaggccuucuaugaugcuacagcauagauuggaugccucuccugggcguucuuguaauccuguguagcacuugcuuuucugugcugugacugccucuuguguguguucuccaucagauaaauaccuugagaguccuugcugugucuccuuugauucccagggucugcugugguuccuaccccauggccagggugcaguagacauuguuaauucugguauuugaguucuuacuagaucgccuugguggugugggcccgaguaugggaaaacaugaaguggauagaguagauggugauucaugcuggagcuguaauucugggccugaccuuugacugucuuuaaaaaucuuuauugcuagaugccaguggaagcugaagcuauuacagaacuauuaaggguguggcaauuaugcacccaaagucagaacaucuguuuuuaacugggaaaccuguugcuuccuugcuguugauuuccuagauguguguguguauguguuuucugcuuaaguaaucagaaaggacuaaggaagauaaacggaggcuggagagugccuagaauuguuacugcuuggaaguaggugguugguuggccccagaaucaggauucuggguguuuuuaggucaagaugaaggcuacaaagcaaaggguuuuuuuguuuucgccccugcgaucuagguggagaaggaaguuauauaugugaaugucaugcccaucguguuuugguuuaucaauuuguggaauucuagguggugucuugcagugagauauucuccucagaagggagaccuuugaguacuuucacuguaagguuccaggggagggacuuguagagaauuaguaaugccuggaaggaaugaguucgcaugaugcaguuuguuuacgauggguggguaagucuauuugagaagacggccugaaacucacaggggcaaggcuuaugagguggucucauggugugagugucccaaagaagagaaguaggaugguucuuuuaguccaccugccuuuuguugauucaugcauucaacagacacuuguugagccuacacuguguccuguuauccaggguauuaaagaaucaaaggugaauacgggcaugguuucugcccugagggagcucaggagauacguggaagagguaggcaggcaaaaaauaauuauauacaugagauaagugcuuaagagggauggcuaaugcacagagcaaaacccagcugucauuggauugagggagguaacaaaagcuucccagaggagaaaaucugagcaccuuucucugccuucauuuucaagcccuuauuucaaauaucucuuguauugauuaggucucuuuugguuguaagaaaacccaguucauagcaaagacgggaauugauuggcucauaagugaccaaaagagccucuaauaaguaguguggcugcagauuuggcuucuucuggggguuccacucuuuuuuuuuuuuuuugagacggagucuggcucugucacccagguuggaguguaguggcgcggcucacugcagccuccaccuccuagguucaagcaauucucccgucucagccucccaaguagcugggacuacaggccuguaccaccaugcccgacugauuuuuguauuuucaguagagaugugguuuugccauguuggccaggcuggucucaaacuccugcccucagaugaucugcccaccuuggccucccaaagugcugggauuacaggcaugagccacugcgccuggccucgguuccacucuuuagguaggcacuguguccacugggagacuuccacaucuuccaagucucagagggaaagaauacucaucucgcagucacuguggcccgagucccaggauuggcucugaaugcuucugggucacaugccuuuccccagaaauggacuggagucagcgcacccaaaccauauggacugagaguggaugguaaugggugguaaucaggcaagaaauaaaggucauggugugucuuuuguagcccugcuaaaaagagagauguuuuguuucuugaaaacccuuagaugcagaucaucaccaaugguguuuuuggggagaugaugucuugaguagaggaaggaguacacugggaugaagaccuugaaguuacagaaguaucaaggagaaaaaaaauuugagagacaacuaggagagcauaguacugaggcucugauagggagugucuccuuggguguugauuucuucccugacugaaguuucccuuggaggucugaaugcuuucacagauaguuguuuuuugagaacccaagguuguaaacccaaaugccuagagggcgaggccaguaaaaugaaucagugcuuugggccaugugaaggccucaggggaccuggaggacugugucccaccaaaggggcugcugugguaauguaggcccaguguggaccaccuguggaguuuuccugaaaucugcauuuuaacuagcuggcguuuaauccaaauuaaacuacggggacacuauaugcagcugaacaaaauauuucuguggaucacccaacugcuugucuagaaggacucagaaauugacagucccucuuuuucauuuauuccccuguaccuuacccugauguuuucaguucuuuggauuuguugaaaaacagcucauccuuucuuuacuaaaaucuugaaaaggucugauaguaacagucuauaacauuucuauggugguuuaguuuacaaagugcuguacuaaaccaccuggcuuggauuucgucuccugacaaugauaacuucucucugacaaagauggaaaccuggcuggguggggugggguggcucacgccuguaauccugacacuuugagagcccgagguaggaggaucacuugaacccaggaauuucagaccagccugagcaacauggugaaacccggucuuuacaaaaaauacagaaaacuagccaggaguggugguguuugccugucucagcugcuugggaggcugaggugggaggaucaacugagccuggaaagucgaggcugcagugagcugagaucaugccacugcacuccagucugggugacagagcaagacccugucucaaaaaaaaaaagaaaaaaaagaggaagaaaccugacuuucuaaguuugcacaguuacugaguaguggcugaggcauggcuuggguccagggccucuuccugugguucccaagugcuuuugaguacaggaacugggcugccucuucaccagggaaggauuaguguuuauuaauguuuauuaaacaucuucugugcuuaugaagcugcugggcuuggugcuuugcauacuuuuauuucauugcauucucauagccacccucugaggugauguuacuuauuucugauuuaaugaugaggaagccagagaucaaagaggucaucaagcucgcaagagacagagccguggacccaaacccagguuucugauucugcagcagcuauaaauucugaucacagagaucuaaugaccucuaggagucuuccacuccuaggagguauguagaauggaccacucacuagguaguuggauccacuaccagcaaugugaauucucacacugagucaaaaugugucucuaccuacugaucccagaacaguccccugcugccgaauugaaugaaucucaucucucuucccugagucagcccugccuguauuugaugaucacaaaccuuauccuuacguugccagcaguaacauucugcaucccucacccacuccacuguguccuuuuccucccacugaucuucacucuaccuuuccuuccccccacccuuuuuuuuuuuuuuuugacggagucucgcucugccgcccagacuggagugcagugguacaaucucgacucacugcaaccuccaccuccuggguucaagcgauucuccuuccucagccucccgaguagcugggcuuacaggcaugagccaccaagccuggcuaauuuuuguauuuuuuaguagagauggaguuuugccauguuggccaggcuggucuugaaccccugaccucaggugauccacccaccuuggccucccaaagugcugggguuacaggcgugagccaccacgccugcccacucugccuuuucuaggggaacucugaacaguauuucugagaagggauagguaaugugugcuuugcuucaaucugaguggauuccaucaaccucuccauagagcaggguggaaagagguccucuugucguugcagcagcuucucaaucucaucuuuuauggccuuauuauguaguuuacauguuaagaaauccagaaguauuuauaguugagugaaaauccauucuuuacuggggggaagaaaugaacucuaaaaccauaaaaaugaugaaccaguagaaaauuuucaucuguaaauuugaaccauaaaaggauauguucauuuagcaucauuuuuauauguguaagcggcauguuacgcuauuauggaauugccuuuguagcagaguggacgaggcaaaaccuuccaaguuugauuauggccuagggcgcugcagucaguacgugcaccgugcauuuuugucagaccacaggauguuucaccuuuaucauucuauuucaguuucucaaguguagguagaugcuguaguaacuagugaaguacaaauccauguaaaaauguuaaacucucaucuguucgcuguguuuguauuuucuuaaagguagggauuaaaaguguaauaggcccacagucccuuaucuggaaucauugggccagauaaguuuuagaauucagaauuuuucagauuuuucuaaaaguaauaauaugcauauauuguuguuauguaauacuuccaguggggucugggacaaaaucccauaaucaaacauuaguauagcaaaauauauauacauauauucccacugaauggauaugcaugaagauuaugcauaguuuaauaucaguucaggucaacuuuuauugccaaauaaguuacaaaaaaagauuuguuuuuuagaacuuuuuggauuacaaaauggugauagggauuguggacuugucuuacuuuuaguuauauaccuauugagagucuguuaaauuuuuuuacuguaaauaauauuucccauauucccaaagguuggaaaccacaaucacauaagcaggggucacaaaccgaagugccagguuggguaaaauaaauaagugaaaugggaggcggguauaggacaguagggaauguggggacugcagugaacuggugaauacauguucauucaaaggggagagcugcucuucaguucuagccacuuguugccauggugaacgugggaguagugaagcuacaucuuccauuuuugaugauacuccagaaugcugauuuucaugugaaguuucuugauauuuaaauguuggcaacuaaaaagaaaaaaacccacuguuggccaaagaaaacaucugaaagcauuaucuggcugugggcugccugcuuucauuuguaguuuagagacuaaugcuugugguaugaaaaguugucagugagccgggugcaguggcccaugcuuguaaucucagcauuuugggaggcugaggugggaggaucacuugagaccaggaguuugagaccagccugagcaacauagcaagauccugucucuacacacgcaaaaaguuuagccaggcaugguagcaugugcauguaguccccagcuacuugggaggcucaggugggaggaucgcuugagccugggaggucgaggcugcagugaacugugauccugccaccgugcuccagccugggugauggagugagacccugucucuaaauaaguaauuugucaguggcauucguaaugaacuacuuucuugagauauggaugggugcauuugcuuuauuguuauucauuaugcuuuacauacacacuauauguucuuugcacauaaaauauuucauaauaaaaaucuaaagaaguugauaagcacuuuauuuuagcauugccuuauuuucuagccauuaggaaauuuucaucuguaaauuugaaacuuuaaacuuauuuaucuuggaaaagggacugaaagccccacuucaaaaauaggagcccucuuuuuaaaaaguaggaguuaaaagagguuagauuguaauguucauuccuuuccagggccauagugaucugaaguaacauuggguauucacuguuauauugcgacagagaaauguccucgaucuccuuucuucucagaccguuccccugggugaucucagccccauaacuaucaccucauggugacaguuuuaugccuccagcccuggggucucuuuaucccuagaaugaugcuaucaucucucucuugaaaaaucucugcugacauggccugauaaaauugaacccaugaacuucuuccucaaauuggcuucauuucccucuaucuucuagucugugagucacgagacuuuggccugcaggguaaauccagcccaccgcuugcuuugugaaaaaguuuacuggaacacagccacucacuacaguggcaggguugaauaguugcaacagugacccauauggccugcaacgccuaugguauuuauccucuggcacuucauaagaagcaugugaccccugcccuagggcauuaaaugcccucacacccucccuagucaccugucagucccauucuuuuuccuccaucaucucagucaggugaggagacuggaaauucugccucuuugauuaucuuuuucuuuuuuuuuuuuuuuuugagacggagucccucucugucacucagucuggagugcaguggcaugaucucggcucacugcaaccucugucucccggguucaagcgauucuccugucucagccuccugaguagcugggacuacaggcgcacaccaccauguccggcuaauuuuuuuuuuuuuuuaauuuuuaguagagacagaguuucaccauguuggccaggcuggucuggaacugaccuugauuaucuguugacuucaucuuugcuucccagaggccauccuuccuguuaccuuaauuaggugcucauuauuuuucacuuggagucaaauuugucuuccaguuggcuuugcugccuugagcuggcuugagcuggauuguaucuacaauuccccaaccuucuguuugacauggucggucaccauuuuaaugauuauagcugcucaccucuaaauuacuuuuucaugaugaauucucuagagguuagaaucacuagauuuauaggaaauuaauguuuauaucaugacaguauugccagguugucuccuaagaugauaaugccgucauuuaguuuguagugcagaaagugauguugcgcaauaaugugugucauuaugcaugacaugaugaauaucacauuucaccaucaccuuaguugcauuagauauuguccuuaaaaaauuuguuaucuauuuaaauuuuuuccacuaaguucaaaaugaauguguucuuacauuuguauuucuuuauaugaguuuucucuguaugugucauuuguuugucauggaauuaacguuuaguuaucaguuucauugcucaguuaccaauuuaguucaacaaaugucucuugagaaccugucaaaugauaggggcugggguuaaaaauauaauugaucccuggggacuugaauguggagacagagcuacaaacagauaaucugaauguaaccaguuuuaucuauucuagcagaucuuaggugcuguuaaugaaaucuuaaugccauucuuugauguauuuauguacuuuaauauaaacaaguuagcauucuuguucauagauauguuccucaacagauacagugaugaaaccuugcacauucaugacuagguacagauuuaauacaaguuucagaagauaaagcugauucuauaaaaaaucuaagauuucuauaagaaacugucuuuuaaauagguagagccuauuauuuauagcaaauaaaauaauaggcauguuugauauaaaaacaauauucaggcuggguaugguggcucacgccuguaaucccagcacuuugggaggccaaggcggguggaucuccugaggucacgaguuugagaccagccugaccaauaugguaaaaccccaucucuacuaaaaauacgaaaauuagcugggcauggcaggcaggcgccuguaaucccagguacucaggaggcugaggcaggagaauggcuuggacccaggaggccgagguugcagugagccaagaucgcaccacugcacuccagccugggcaacagagugagacuccaucucaaaaacaaacaauauucaguucauuucagccaugcaucuugugagacuguguuuccucuguguuaauuacagcuuauugauuauuugcauuggcuacuuccuuuugauuaucccaagauguuucucucuuccucuccuuucccacagcucuucuuuuuggacgucuuccuuaucagagauaccuuuugguuuaguagucaauuugaucucuccuuuaauguuucauuagcauuucuucuguaguuacucaguguucuuccacaugguuuggccaaauuuauacuucuuaaagaguuuaaauuagaaaucacagaccaaguaaacaggugcucaaaugaauauaaaucuuaaauaaauguacagaaauuauuaaaagcacccaucagcuguuaccugucagugugaauauguauaaaucaagcagcuuggauaucacguggucauuggauacuuucacaugccugggcuggagugaccauuugaaaccauggccagcgguacuuuggggaaauacaccgaaguguuucuacuucaccagauacagugagugcuuggauggagggagugugggcacaggcacaaagcaggggagucucugagaugugccuggggguucagugaggacuccgcugggcauguaacgugagcaaucauuuuuaaacaaauuuuuucauggaggcagagucuugcuauguugcccaggcuggucuccaacuccuggccucaaacaacucucccaucuuggccucccaaaguugugggauuacagacgugagccacugugccuggccuugagugaucuuaauaacuggcaggugauagagaauuccaaggguagagauaguccuaggggaaaccuaacacuugaagaguuuauccuuuaacuuaauauuuuuuuuuuguuuguaaauugggaaaaaggcaaccauuaugugauucuuagcaggggagcaacucucuccagcucuucuauuuucaaaucacuuggguagugauugcuauuuucugauccauuuguuaaguauuuguaguauuuaaauucacagccccugguugcauuuccauccaauagaagguguaaguugguucuucaaagcuuuuuuuuuuuuugagauggauucuugcucugucacccaggguggagugcaauagcacagucucagcucacugcaaccucugcuccaagguucaagcgauucuccugccucagccuccugaguagcugggauuacaggugugcacuaccacucccggcuaauuuuuguauuuuuaguagagacaggguuucaccauguuggccaggcugaucuggaacuccuggccucaagcaaucagcccuccucggccucccaaagugcugggauuacaggugugagccaccgcacccagcugguucuuccaaguuuuaaaaagcuuuaaggccaggcaugguggcucauggcuauacucccagcacuuugggaggcugaggcaggcagauuugaugccaggccaacacggcgaaauccuguuucuacuaaaaaugccaaaauuagccaggcauuguggugcacaccuguaaucccagcuacuugggaggcugaggcacgagaaucgcuugaaccugggaagcagagguugcaaugagcugagauccugccacugcaauccagccugggcaacagagugagacccugucucaaaaaaaaaaaaaaaaaaaaaagcuuuaaagcuagcauacucuuguuuuauuugcccuguauaagcugauggagaccuuugccccaaauagacaauuuuguuauacauugaauaucaaguaucauuucucacaauguaacuuauuauuuucucuaauuuccauuuuacuuguauaucuccuguuagagccucuuuuuuuuuuuuuuuuuuuuuugagacggagucucgcucuguuccccaggcuggagugcaguggcauaaucucggcucacugcaaccuccgucuccuggguucaagcgauucuccugcuucagccucccgaguagcugggauuacaguugcccaccaccacaccuggcuaauuuuuguauuuuuaguagagagggaguuuuaccauauuggucaggcuggucucaaacuccugaccucaggugauccaccugccuuggccucccagagugcugggauuacaggcgugagccaucgcgcccagccagaaccaguuuaauacucccauugcuuuugcauuuuuguacuugcugggguucauaauaauccucaaacaaccccaacauagcaggacuaaaauacaggccauccauggccuggagcaccaacuuuugagagccaggcgauguugauuggcuucugucgucaucuguggaaguccaucguuagaaaagcuucuguuccaguuuuaggggggaaugaugguuugagggcuacugugguagaacuuggggaacucuuuucggcaaaagguugagaaaguuggugcugugggaagucagcuggcagccgauggagucaggaccagggaggaagggaaagggaacccagauaggaagcuacugcaguaggcucagagaggugaugacggcagggcuaagacagcagccuugggcggugacugggaagaacauugaacaccauguuugggcugaagaaaagagcaagggaagaggugaggagcuucagguuaggguugauguagauguuauuuacauagggaacaguaauucuucacuuuuucauuguuuuacaaugauuccuuuuuagaaacauauaauugugauauuuucuuugaccuuuuauugggcuuucuauucuauuccauugauuuauggcuuuggguguguguauauguuugcaucaacauuuuuuuuuuuuuuagauggagucucgcucugucacccaggcuggagugcaguggugcgaucuugguucacugcaaccucugucucccagguuuaagcaauucuccugccucagccuccccaguagcugggauuauaggugcccaccaccaugcccggcuaauuuuuguauuuuuaguagagacaggguuucgcuuuggucagauuggucuugaacuccugaccucaggugauccuccuaccuuggucucccaaagugcugggauugcaggcaugagccacugcaccuagccugcaucaguaugguuuaauaacuguugaucuguaauauguuuuaaauuggguagagcuggucucuuacaaauacucuuuuucaggcuggguuuguggcucacgccuguaaucccagcacuuuggaaagcugaggccggaggaucgcuugaggccaggaguucaaggcugcagugagcugugguccugccacugcacuccagcaagagacccugucucauuaaaaaauaauaauaaauauucuuuuuucaguaucucucuuacuuuuguauaaaggcgaguuuuggcaucucaucuucucuaguuucuagaaaaaauuauuuaggauuuugauugaguugggacucauuuauucaaaugauguuuauugggucccuguugugggcuaggcucuaaagguucaaaaauaaauaaaacccagguuuuuauggccuaauaaaucugugaacuaaacuuugagaauugauaucuacaagaugagcauugcacaugacuuuguguguacaaucuuuuauaugcuucccagguauuuuuuuuuguuuuuuaaauugagaauagugccuauuuacuaaacuaugcaacugaucauuuuuguuauuuuagguacauaauauuaucaguguugugcuucuauuucugcuuuugcuauuuaguucaaugauuucuuuuucaucccuuauuuaauugguuagacuccaaaauaguguguagcuguauaaauguuuauaggaauauuguguaaagggcauaugauucuaccuuuauuggacauuucaggaacaugauaaggacuauuuaaauccugcuaaaauacaaguguuguaauaugaauuguucccaauggaaguuugcaagcaacguucuccucauuuucgaaccacacaacuuuuagugugucugcuauuugagcuuuauucugugucuguuuugugucaugagguuggcaggugaucuuaaaugcagaaugcugaauuuguaguaguccaacuauauggagaaaacaauugcaaugcacuuuagauuuaggaacaaauuggaggagaaaguugagaaaugguaagaggaguuuuaauggagcguauguggcaguaugcuaaugucacuucuaaagaagaggugguuagcaggucacaaggcaguagacugaauuguagccucugaaucucagggcagucuuuaggaauggaaaccuugcugccuguagauuuagguagagguuuuaauaacccccccguugccagaaaaaaucauccacacacagauuugccuauaaucuuauggacuucacagacauccucaagcgcauggacaaaaaccccaagauucaagaaaagccguccacauggucggcagcucaagaaagccugccaguuguccaagcaaugcuuaguuacaguucccaugcugggagcugcucucuagagaaauguuauuugcagaugugcaccucgugcgucuguguguguuguucugccuguguccaaaauacaugcuuuuucuagaugggagccuuucccccacaaagcagaaauguguucugucaugggauuugaugaucaucaaauuacuuucccucaagaauuggcuuucuuggcgauuaguuaauucaguuuucaaaacuuuuagauaagggcuuaaucaacguaaaacugcuuuggggcaguugcauuguaguaaaaaguguauuggacuugagucugagggcuugagauccugucuguacuguuuacucgcugugucugugaccuugguccaaucagccacucugcuguguuccuauacgugagaaacggcuccugauaccaccaggagcaagcucugcuguguuuaagaagguggugugugcuagggaggcgucaugagacagugaggacauacagugugacacagcaggucagcacuggggaaaauagccagguuagccuucacuucacugcucuaugccaaaauacauuccaaauggguuaaagcuuucauguaaaaaauaaaaccacaaaauaaauacaagaaaauauagcuuauuguggaaaguacugcaugcuuuggcauaaaaauguggagaaagaacaauaaaagauagccuguaggugggacaugcgacucccaccuguaucccaguuguuagggaggcgaggcaggagggucauuugaggccaggaguuugagcccagccugauuaacauagugaggcccgugucuguaaaaggaauuuuggaaaaauuagcugggugagguggcacaccccuguagucccagcuauuucaggaggcugagauagaagaauccuuagagcccaggagccggagcugcagugagucaugauugugccccugcaguccagccugggugacagagugaaaccccaucucuaaaaaauaaauaaauaaauaaauaaauaaauaaaacaccuguagauuuaaccacauaauaacuacacuucugucuguuuuauuauaucaaaguuaaauuuaaaacgaugacuaauuggaaaaaacugagagcaaccacuacagaggugaauauacugaauguauaaagcucucuaguaauuuuaagaacuccgcucuaaugagcagauaucacagacagaaacuucucagaugaaauaccgaugaccaggaaaucugugagaccacuuuaaaaaauucgaagucauugaagaaaugcaaagcuuccaggcuccacuuuucacugaugaaauuggcagaguuugggacaaugagauguugcugucccgggaguguggauggggcuguguccugugauggcggugggcacuggcacucuuguccagaaagacauucgccacugugguucaagaagcaccucaaaggucuucaccuuggucccuuguccaccucugcccgcggucucuccuccuuucagccuccucuuucccacacagucccucccgcccuggcuugguccccuuucuucucugauggggucaggcaugugggugacugacuuccaaggcucugucuaccuggccuuuuucuuucaccuguucugcggaauaauagccugauucauuccucuuuuuggguccuucacuuccauaccugggauucggggcguggcccagaaagacccugcagucgugcaguguggggcugccagcauuucauggccuccaagcucagcugggcugaaugaaugcugccguccagcgcuuggcuuaguuuucugucccguuuuccugagugcuuuugccagacuuucacuuuucugaaaccuacuucacccuaccccagacacccacccucucuccuuggaugaccugccuccuaauuuccuaagaaaacuggacauggccaccuuuccccagugucugaggcccagguugacccguggucaugguugccgucaccacccaccugccuggaccccacccucuguccaaggccccgccaccugugccgcuguccugggcgcugccuugccagccuccccucugugccaugcaccuuucaccucccuccaucugcugccuguuucuucuuggcugcuccucauggucaggcuuuucucagcccuccccuuccuucuggggcuuugcgucuuccucugucauccacgcucugcgucuuggcuucccaggacccucuccucccacuuuccugucccugacgucccugugcccggggcccaguuugcaucaucagccagucccucauccaugcuucacccgcaccucgcuccuggcuucuucccugcccucccuggggacuccuauccuguccccugcccugguucuccuuccgcugugucccagggccuccauccucagccuccgucuucucugcagggucugcuucugcaugaacucccccagauccguguuugcugcugguccucacagcaggcucuucguuucuggaccagaugucuuuucugugcuucagaaccaucuagaaaaaagggaacuggauaucuccaccugaauguucaacaggucccuucacccagcauuuccagagcugaccucauuguaccuucauauccucccaguguuucucuuuuggugaggaaaaacacacauuguccagccagucccucaaggcagaaaccugguggucauccucagcuccucccccucacuuccuguccacccccaagucaccgaguccuguuccuuucuccuuugcaguggcucucugugcccugcucuaccuacccacuauuuagugugggcuguccuccaucucacuuggaucucguguuuuggggacucuucagauucuccuccauggcuucccuacccggcagcauaucuuucccucacauauuccacacugcagccagagggaucugccaaagaaauaauugugauaaugauagagaaugcgcaucuggguguauacugggugccuugcacuaguccaagugcuaaugacagagaauauauaucuggguguguacugggugccuugcaccaguccaagugcuaaugacagaauauguguccggguguguacugggcgccuugcaccaguccaagugcuaaugauagagaauaugagucuggguguguacugggcgccuugcaccaguccaggugauaaugauagagaaugugcaucuggguguguacugggcaccuugcaccaguccaugugcuaaugacagagaauaugugucuggguguguacugggcgccuugcaccaguccaagugcuaaugacagagaauaugcaucuggauguguacugggcaccuugcgcuaguccaaguuguguauugacuuguuuaauacccaccagacccugugaagucaguauaguguuaucccuuuuauaggugggaaccagaagcacagggagauugaguaacuugugugacaugauuucuccauauucuagacagaacaaaaaccauuuuuuuuuuuuugguugucccuauguugcccaggcuugucuccaacuccuggccucaagcaauccuccugccucggccuuccaaaguacugggauuacaggugugagccaccaugccaggaauuuuuugagcuuucuaggaaucagcacuuugcuuauauuaucucuuucaaucuuuccaaucuguaaauuagauauucuuaauaucuccauuuuuacgggaaaggaaauggagacacagagauuaccccgcucuuagguggugaacggggcuuugacucccugcauauuugcucuuagccacuucacccaccuacaaggagcuagcaccuugcuugggguagagggagggcaccuucugaacaugcuuuaguggguguuuuucuguucugcuuuccgaguuguggguggcaaaggagaugugcaugcauaagauguucucauuacuaagagugcuucugaugauaacaaaagaccaauauccuguuggagcaauguccagauaugaugaaaugcuagauuugccugguaacgcugaagaaauuuuuuuaugaaugcuccauccccagaagacucucgcuccugccauuugaucaguugauuuuauaauaugagcauugguaaauucuuaggaauacaacuaucauaauaacauguuauggcacaacaaauuuaacuguuacuccacugguagguuccugaaauuauugaugauaggaagauucuucagugcagagagggauuuaagacguuaugggagacauuuuaguuaagaugguugacugaagacauauuuauuucccuccccccccaaaaaaauaaaauucacugaaauguugggaauuuuuuuuaagucuuagaaguuaaaaaccauugugcugaaaucccugguguacuuaugaagaaguagguggcuugcaccuguagucccagauacuggagagguugaggcgggaggauugcuugagcccaagaguuugaagugaaccuggaccacauagcaaagcccuuggucucuuaaaaaaaagagaagaaaaaguuggucuauagagaaguaaagugagugcaguuuuauuuguugguucauuguccaagccugguuuuccuuuguuuaaaugcauguaacagccuuucugaagauuuuuuuuuuuacauuugcugccugguacucauuugaaggcccagaguccggcagaguuccuuuccguguuuuccgcaguccuucaguuugguucgcacaccugauggccuagaauugggcuggcccuuggcucuccugcccacccuggugguggauugccgcuggcuccuacucaguacaaggcccagauacugaaaacuuucauuuagucacuuauguauucagcaaauaaguuugcucacaaucuucagcagaucccguguaccugagcuuaaauggggugggguucucccccagccaugucaccugccucugcuccucccugcucucucuucccucucuucucccugaccugggugcucuuguacuauccagccucuggguuuccaacucauccaguaggucucagaagccaucaccaguuucaggauaucuuucugauaucccaggucugcauucaggccccuccugucaugucuguaacccgcaacaauuuaaugugcuucucugugccuagguuucuaaaucucuaaaauggguaugacaugguuuggcuguguccccacucaaaucucaucuugaauuguaguucccauaauccccacgugucguggaagggaucccaugggagguaauuuaauuaucgggccauuacccuuaugcuguucuaguaauacugagugaguucucaugagaucucaugguuuuauaagugacuuuucccccuuuugcucggcauuucuccuugcugaugccauuugaagaaggacguguuugcuuccccuuccaccaugauuguaaguuuccugaggccuccccagcccugcggaacugagucaauuaaaucucuuuccuuuguaaauuacagagacguggguaugucuuuauuagcaaugugagaacagacuaauacagguuauaauagugguaucagucucaugguugucuugaggauuagguggguuaauacaaguaaaguguguauuaggugguuaagaacagggucccugaaguaauauugccgagauucagagccuaggugggaaacccugggcaaucgcuuaaguucccugggugcaucaguuucuuccucuguaacacggggguaauaauacuuaucccguagaguucaguucuugcaaagcaccuggaacagugcugagcaugugauaugagcucaauaaaugugggcuguggugauagugacaacucccagggacccugcacuucccuguuggaaccguccuugcacuggaguauaauggcuuauuuuccuugauaguccuugagcucuggcagagcaggggcccuaucuuacucaugauggcucauggaagggaacccgaaaauauuuguucagugacuaaccaaaugaaaaguuagugcaaaguaugcaugacaccagccugugguugaauuuguugaugggcuguguagcuccacucaguuaaggcuuacuuauccugaauagcuuuuuugacaaaacaccucauuaaaaagcaaucagauuucuguuuuaagguauuuacaguguccuuucauccaucaggcacuccuuucuuugaccuuagaaaagggcaaguggagauuuaggguguuccccacccagaaucuaccaucaucccucaaaaacugccucgcccugacuuuccaggugacuauuuuuucuucauuuugugcaccacgcuaagcauggaacuuccugggccacaucugugacguguguuuauuguagaauuccagaggagccaccauuauucagauuuucagcacuagaugccuguuuaaaccgugcaacauuugucauuuuuggaguuacaguccuacguuugcaaagcccaguuuggaagguuucaaaauguucccuccuuugcuauuuuguucuagucucuuaaaaguccugugagaauguugaugcaaauauaaauaaaguaaggggcagaaagguuaagggauguauuuuuagaugcuaugguuaguuuguggcggaguuagggucagaacauagcuugcaaauuuaagagaaauuuaacuuugguccauggccucgaagguacucuuucugaagguucaaagacugguucacauuguguaauucacuuaaugggugucugccugcacacccacgaaacagggauaauaaaaauugcccuguauggguacauguuuuugcccguuacuuuuuuuuuuuuuuuuugagacagagucucacucuauugcccaugcuggagugcaguggugcaaucucagcucacugcaaccuucgccuccuggguucaagugauucuccucccucagccuccugaguagcugagauuacaggugccuaccaccaugcccagcuaauuuuuuuuuguauuuuaguagaaaugggguuucaccauguuggucaggcugguuuugaacaccugaccuuaggugauccgcccaccucggccucccaaagugcugggauuacaggcgugagccaccaugcccggcugcccauuacuuuuaaugggaaaagccacaauuacuuuugcaccaaccuauuauaaugaaauaauauagguaaaagugcuuucauaacagaaaauaauguauaaaugcaaaauauuacuauuaauuuuuuuuuaaauuuuaguauuggaaauuugguguuaagaaacucuuuuggcugggcacaguggcucaugccuacaaugccagcacguuaagauuuuagaccuugucuccaaaaaaaggauuuuaacugaggcaggaggaucacuugcggcgaggaguuugaaaccaguguggacaacauagcgagaaccugucuguacaaaaaaauacaaaaauuagaugaguguggugguguaugccuguagucucagcuacuugggaggcugagacaggaggauugcugagcccaggaguuggaggcuaaaauaaguuacgaucgcaccauugcuuuccacagucugggugacagaccccaucucuaaaaaauaaauaaacgguaacagaaacuuuuuugauuacauguuaugauccaccaauuccaguuucuauguuugauuacuuucuugaacaggaguacuguauuuaugaauuuuucuuguacuuuuuucaaguugguaguuuauagucagauucuacuguacucuuucuguuaaaauagcuauguguugggccaggcacgguggcucacgccuguaaucccaacacuuugggaggccgaggugggcggaucaugaggucaggagaucgagaccauccuggccaacauggugaaaccccaucucuacuaaaaauacaaaaauuagccggucaugguggcgugcgccuguagucccagcuacucgggaggcugaggcacaagaaucucuugaaccugggagguggagguugcagugagucaagauugugccacugcacuccagccuggugacagagcaagacucugucuccaaaaaaaagaaaaagaaaaagaaaaaauagcuaugugucauuggccaggaugacuauuugggcucugggucuguguucuugucucucgucuagauauccacagagggcuccaggaguuccuacuuccauccugcuauucuacuuuucauucugaaacucaaaccuguugccauuccauuacugaaaaaccaucaguggcucccuguugcccccgaguuccauggcaggcaaagccuuucucugcagccacaucuccaccuccuguucuguacccuacuauguacacacuccuccccaaaccuuuucuccccaugccugacuuaucugagguccacuuggacuguuucccugcuuuccuggccacacaguuaaucacucuucuaucugugcccccaaaguguuuucauuaaggaugagaccuuuuuuucucaugagcuccucaaggguggggacuguaucauuucugucuccuuuuuucuuucucaguuccugacauuuagugggaacuccguaaauaccgucugaaugaacaaauaucuaaaaucugaggcucuugaaguaaguccauccucggauggaugguuuauacuuggagacuugcuuuugcuucucugugaaugcaugcucagcugagaucugcuggugcagguguuucuauagcuuccuuagcaguggugggaagcccagcagcuuaagauguuagcuucugaugcaggguuuacuaacucuccacguacucugucccugaguuucuguuuauuguuugccugugauucucuuuggugccaucccacacgguguugucacaaccaacccuuuguuuuaauugaacguccugcgcuacuccugcucuaacucugacuagcuuuuuguuuuugugugguccaggcucgacugugacuucuuccagagagaagcuagaacagcuugauaaauuuggaaaggucauucuuagauaagacuugggauuuaucugaagguuguuauuauuuguuguaauucucagaacagcuaacacuccaugaacccucacuaggugccacgaaacacguuaaaugaaguacaugagaugguguuccuaaacaaccacuaugguggugguaucauuauuauaauuuuaugguuauaauuauuccuauuucacaguggaggaaauguuucuuaguaaggugcacaugugaacgucuagccuuggguuucaaagucugguauguuugacuccagagcccuaacucuuaguucugacuguauccuacauucuuauccuuugcugagagugaaacuuagaauuggguaucacucuguuuuuuacaacugaguuuacucugucugugaaggccgcagcguaaagccaguugugaaucaugcacaucagcuccuucugaaauguguuuauggccuaggacacagggacccuggagacuauggugcugcagugcauuauggcugcuacccuucuagucuguccugcugcucguucugccaccugccagcuguugcuaccugaaccuucuccuugcagcaguucucaguguucucuuugcuugggaauugccuggggagcuaaaaaaaaaaaaaaaaagccaagccccaccuccagagguucuaauucauuuguuuuagguugggguccaggcaucaguauuauuauuuuugacaaccuuaugagggguguguguguauuuguguuuuugugggggacauggucucacucuguugcccaggcuggagugcaguggugugaucuuggcucacugcagucuccacuucccaggcucaaaugacccuccuaccuaagcuuccuaaguagcuggacuacaagugcucaccaccaugcccagcuaauuguuuuaauuuuuuuuuuuuuugagacaagaucuugcuuugaugcccagacuggagugcaguggcacgaucguggcucacugaagucuugaccuccugggcucaaacaauccucccacuucaaccuucugaguagcugggacuacaggugugcaccaccaugccuggcuaaguuuuuuauuuuuuguauagauggaggugucccugucuugcccaggcuggucuugaacuccuggacucaggugauucucccacuuuggccucccagagugccgggauuacaggcaugagccacugugcccaaccuaugagauauauuuuauagaucauaaaauuuacccauuuuccccuuuuaucuuuaguuggcugcaauguuuguacauauuuaugggauauagagugauauucugauauguuuacaauguguaaugaucaaaucagcauaauuaucguauccaucaccuugaacguuugugccuguauugugaacauucaaaauccucuucuagauuuuugaaaauacacacuaaguuauuguuagucauauucacccuacagugcuauagaauacuagaacuuauuccucccaucuagcuauaauuauuuaucccuauccauuaaccucucccuaucucuccuccacccuaugcuucccagccucuaauaaccacaauucuacucucuacuuuuaugacguuauuuuuuuuggcucccacauaugaaugagaacaugugguauauaucuuucugugucugacauauuucaaaaaaugucucauuuuaaguguagaacucaaugauuuguaguaaauuuacagaguuguguaaccaucaccacaacccaauuguagaacauuuuugucaccccaaaugagagccuucauacuucuuuacaguuaauccccauuccccccacccccaaagccaaccacucaucuacuuucugccucuauagauucccguuuucuggccauuucauauaaguggcaucaccuguauuauuuucagagccuccaggacugucauguguagcucugguuaagaaccacuguuaccuccuagaucuuuuuccacuaguuuuuauuuuuacuauuuuucugaguggcucagaaaacucaauaggccccugccagggcugucucuuagauaaucugugagcuaaaugaguccuuguaaguuggacugagaacuuaacauuuacaaccuguuuuuauggggaugagcuugucaaaguccaaaugugcugaccuaguuuggaagggagccugcacaaccugucuucagacgcugugcaccuccccagcagccaucagucacagcacugagucagagcccagguguggagggagccccugacauuguguggccuggccuugggcacuuuugcuuuagacuuuuuguguggcuuuucagcuccuccuagccucuggcugccucaccagagcaguaaacuggacuccuccugagcuccuuucccuuaggcaguagcucuauguggauguacugucugcauugcaauauuuugcaaaauauuucucacauauuuuugccugcuuaaaugaguuuuaaaaucucaaacucagcugccuccagguccaagcagguaccaugagugacuggagcaggcuggggaauaaggcacuuggaaugccugagaggccguugaggugguugguggcagaagggagauuucuuucagauuuugcuauaagcaagaaucggugguggagcuuugagacaggccacgugguuagagcagggauagcaaauagauuccauuucaugugccagaggggaaaaagccaacugaccgaacaaaacgcugcguggguaagcuuacaugugcaggaaaacgauaaaccucaauucaauuuaggguaaaauguaacuguucaucuuagucacuggaauucaaauaauauuaucaagauuaaguuaagauugagaaggcuuuuauugucauuuaaaguaaaaauuaaauguuauaacccuguccuagagaagcuguaaauacaugggcaaaauaccaucauuuggggaaauaaugcagaguauagaacuauuagaucuauuuuucccacgucauugccaaaauauuuucuguugaaucauuuccccccguuaaguauccuuuuucuuuucaguguuaggcaugggaacaauuuuuucccaauaacaucccuuuagaguucuguaaacucucuuacggcuuuuaaacugcuuuguggcagguauaacaaauugcuucauuuuuaaaguuucagagagucguuuauuuuaaaaauccaauuaaguagauuuuagauuccuucccagaaaucuaagacgacagcuaaucuaaugagauaaaacaguaaaaacucauucaguaguccuccagcucacuaugaaaucaaacuauugcauccaaacugggcucagaggcucagguggauuuuguaaacacuuguaacgggaggugacaguguugcacaaaaucagauucccagcagaaugaaauccacugccuagcccugggugggcucuguaauuucacugugaauacaaaucauguugcaugcaguaauguuuauguuguuacccuacauacaauauucagauccuugguagauuagucacagucugucuuauuucucaaaaaugcgucagauauuuccugguaacuagcauugaaaaugagcucauuaaaaauucucuccaugcuucauuuuuucauuuuaauugacguaucagucagugugcaaguguaaaagccagcagaacagugaucucucaugugaaauuguaaaccaaaaaccaacagcccugugagcccagaggcagugggagccauugauguuugaugcuaguguuggcgccucggccacauauuugccauccuuggguugggggugcucuuggugguagaaagaugagccccugcucucaaggccccagaauggcugaaaggauugaaaaggagcaauuuggcaaaagucuugaaaagccagcgucucucaaccucugaaaugcaaguugggaaaacguagaaaucccccuucugaguaagaagaauuuggauuugggaagugauuaaaaaggauugaaguuucaugggaaaauggacuucacuuguacauagaucaggggucagcaaacucuggucugugggcuaaaugcggcugcugcaggcucagaaugguuuuggcauuuuuaaauacuugaaaacauuaaaagaggaacaguaguucaugacguacgauaauuaggcaaaauucacauuucaguguccauaaauaaagguuuauuggggcacagccagguccguucauuuauacaaugucuguggcagcuuuugugcugcaguggcaagcugagucauuacauagagacaguauggucugcaagccugaaauguuuauuguugcugaacucuuggguagagaacuguguuuauuuaggucuugucccgaaauauguuuaucaguagagaccagaaagcaaacagugauuaaaauacuucaguguuuuugaggaggugaguggauggaggugcguaggugcaggagggacauaacuucugauuucuuccugucaccagugucaccagcacugggcugugccuccgcauuuggacugaauuaucagaggcagccaccccuguucauuuuggcagcugcugcuugccuaugaggcagaaugucgaggaagagaaaauacaccuccagcccagccucacccauccucaaagugauucuaaaaaguuagcuaucaagguuugcaccacauccugcaagaguuacuaauagagaccugggguuggccagcauuuucuguaaauggcuggauaacaaauauuuugagcucugcaggucauacggugaugucuuucgcaacaacucaguucugcuguugaagcucaaaagcagccauagauagcacacaaaugcaugagccuggcuguguuccagugaaacuucuguaauacacugaaaugugaauuucauaaaauuuucauguguuaccaaauauuauuauuuuguuuuuuuccaaucauuuuaaaauaaccauucuucugagcuuucugaacauaaaaaaugggcggugagcuagauugagccugcggguauaguuugcugaccccugguuuagauaaacuaaguguaggccuugcuagucaggcccucuggguuugaaucccacaaucccacuuauuagugcugggguccuaggcaaguuaccuuucaagaccucacuuuccuuauagguaaaaugggggaaauagugguuccuacccaauaggguugaugugagaauuagaguagauguaagugccagcccagugucuggggcauagaaagcacccagcaaauauggcugcuacuguuggcuauuaugaaggcucaaguagaucccuacagccuuggaggaaccguuugugauguggagguuugacggucuucaacugucuucaguccacaguucaauuagauugaauaugaggcuggaggguuugguggugcugccuugcuuucgugcaguuaaguagaacaugguauauccacagaauagguuaauguacaggcauaaaaagggaggugguggaguuguacaucuguauucugacguguaaaaaugccccucgugucucuaucuaccugugugcaucuguguguguguguaugggugugcauguauguguguguacguauguguguguauguguguccuuugaaaucagcacuucucagccuuggcacuguugacauuuggaccugaaguaggcagaauaaugcucugcccucccgaaacauguccagauccccaucuccagaaucucugaaugucuuagauuacauggcagagggggacuaaguuuggagaugggauuaaaauuucuaaucaguggaaagggagauuagccuggacuagccaggugggcccaguguaaucacagagguccuuagcaguggaagagggaggucgcagagucagaggaagaggugacuguggcagagaggcccagagugaaccauacuggcuuugacagugcaggaggaggccaaggaaugcgguagacucaagaagcuggaaagggcgaggaagcagaugcuccccuugcauguccaggaaggcauucagcccugcugccaccuugaucguaguccagggagaccugguuggaagugcugaacucaagaagugugauauaauauacuuguguuguucaagccacugaguuuguggugauuuguuacagcagcaauaggaaacaaauccagggcuggaucauuccuuguucauaauucuuuauauuauuuagugugugugugugugugugggguugcauuuaggauagucaguagcauccuggccucuagccuacagagaccaguagcaucucccaucaugacaaccacaaauguccccagacauugccaaauguccucuggggacacaguugccuccaguugagaagcacuaguuuaaauuuagaaaacaaauugggaaggauauauaacaaauucguaacaguacccuuugggauaugggauuggaggaauggcuuucacuccucuuuuaacauaaaauuuuuaaaacuggauuuugccucccccuacagacauuuuuuuuuuauuuucaacugugguuuuuuuucccauuuuauaaaaagauuaaccuugaaagguaauaucacauuucaauuuuagucauuauggauuuuacuguggaaggcaguucuauacaccuauggcugcuuuucaaccuaguuuuauuggauuuuguuugacauugugaauguccuuuuucccaaagaugugauagacauccauucauucauucaguguguauuucuuuuuuuuuuuugagacggagucuugcucugucgcccaggcuggagugcaguggcgcaauuucaaucucagcucacugcaaacuccgccucccgggaucacaccauucuccugccucagccucccgaguagcugggacuacaggugccugccacugccuggcuaauuuuuuuuuuguauuuuuaguagagacgggguuucaccguggucucgaucuccugaccucgugauccgccugccuuggcuucccaaacugcugggauuacaggcgugagccacugcgcccggccucaguauguauuuaaguggcaggaaggugcugagcuugccgcuggggaggagugaugacuuuagagcucucucucugcccucauggaaccugcugucuagcagggaggaggacgguagugcucauuguuuggaagaccacagccugcauugaucgcggggacuugagcauucguguccaugguuugggagucccuggcucccauaguacauguuuuaugaaggaaacuaccagaaauccaugauuagagauggaaaauaucagaccaauuggaaauuuuccuuugacucucaccuggucugagcaucuucugucuuuuugguacagugaacuacuccagauugaaaacauuucuguuuucuccuugccuggcaagugagcucagugaaacauccuauuagccacacugcaggguuggacauugccacaccaggucaagggaaaguggcacuaugaaggccugggcagcacugcugcuuugagaauuacgaggagaaaaucugugcuuuaccaaaaaguaaauuaaagauccugccugguaucagccuugcuugagugacuaguaaaauugcagaauagcuucauaggaaaaaacaaaccccagaguaaaauggcgagugggaaguuccuuccugauucguauuguuuuuccaguugcagacaggaaacauucaaguguguuuucaagcccagaacguuggacacaaagaaggcucugacaaagcagaaaaaacccauauacaaaaaguuuaggaacauggagcaaaaugucugauucaaaacaaucuaggcugggcgcaguggcucacgccuagcacuuugggaguuggaggcgggaggauggcuugagcucaggaguuugagaccagccugggcaauguagugagaauccaucucuauaaaaaaaauuuuaaaaauuaccugggcaugauggugcgcaucucucgucccagcuacuuggaaggcugaggugggaggauagcuugaaccuaggaguucaaggcugcugugagcugugaucaggccacugcacucagcaugggagguagagcaaaaccuugucuuaaaaaaaaaaaaaucuggccgcguacgguggcucaugccuauaaucccagcacucugggagaccaaggcagccagaucgcuugagcucaggaauuugagaccagccuggccaacauggugaaacccugucucuacuaaaaauagaaaaauuagcugagcguggugguguaugccuguagucucagcuaccugguaggcugaggugggaguaucacuagagcccaagaagcagagauugcagugaucugagauuguggcacugcacuccagccugggugacagaacgagacccugucucaaaaaaaaaaaaaaaaaaaaaaaaaauauauauauauauauauauauauauauauaugauuuaucaaguauuauuuuuuaugauuggaucacuuugucuacuguuuuuuuuuugucuauagaugucuugacgaauucagucucuugcccccugccuugcuuuaauaaauuacaaaaacucaaccaaagauaacacuucucagaaaaaaccagcacauuucuguggccuacguacauggccuauugaauggccuauugaaugggcaccuuggccgauaguggaauaauugcuggacuuuccauaucucugguaaaggugaacacugcaaaacaguucacgauaggaagcaccaaggcuuggaccagucacagugaugagggagaucaggucauuuggaccacauuauuggaauagauggagacaguaccaaggccugaaaauuaagauggagaguccacaggccagcaaagaaucuuugugugagggagccauuccaguuuguguauuauacuccauagucaugauuugucacuuaaaaguaauucuucccaauuauagaucacuuuuaaucucuaguuggguuuggauuuuuuucuacacauuuuuuuuuuguuuuuuugagacagagucuugcucuguugccuagucuggagugcaguggcacgaucuuggcucacugcaaccuccgccucccagguucaagcaauucucgugccucaaccucccagguagcugggacuacagguguguggcaccacaucuggcuaauuuuuguauuuuuaguagagaugagguuuugccauguugaccaggcuggucuugaacuucugaccucaagugauccacccaccuuggcuucccaaagugcugggauuauaggcgugagccaccacccccaaccucuaaaauugauuuaaaaaaaaaaaaucuaagccugcaaaucuaaaauugauuuuauuaauguaauauauauauagccuccacaaacacaggaaacaaaggggaaauuucuuuuuaaacaguacauuaacauuuucauauaauauauucaauauaguuuucagccuccagaccuuuucauguaaaguaccucuaaagcagaggguccaguuaauuugaaaaaaauggcuggaaauacacugauuuucuuuacauuuuagauacucugagguauguuuucuguugugcauuuguagagcuugacauuggaccaauucuuuaaguuaggcacacuucaccccuggccauaucaaucaagcaugcuacuuaaaaguguaaguaacaugcuauuuuuaaaaaaccucaaaacugugauucauguaguuuaaaaagucaaauaauauaguaaaagacuuaccacaaaauacgguggguucacucccuacucucugagauuucccaacuccagaagcaacuacuuugaaauauuaacaguuuauugugacauuuauucauauucauaauuauaaguaauauguguaaacuaucguuuggguuaucaaauuaguuacugucuguugacuuucuguucugauaaaugaggguuuagggcccuuucccucugcuucugcuccccccauccuuucaauacaguuauaauuuuucauuguauuacuauuugauauuuauauuauguccaaucaauuauuugcagcugagcauacuaguuacuaugacuaucuuuauguuuccaguggacuuuuuguuuuuccugaaguuaauacuugccucguuuuuauguuugcuuuauuuucuuuguggcuguugcagcacugugcucauaacuguuuaacaacugccaagcuccuauuugaauuguuugcaguuguuuauguuuuugauuucaaguaccagugugagguuacugagcaaggaguugggagaagaugcacaugguugguuggucugaguuggcucuagcauaccucugagcuauuacuaacuuucccacaucugcuuauagcccacauugggauuguagagcaaguucuucucuucuucuguuauuuuuuaaaaaauaauuugcucugaaaaaggacauauuuguucugauucucagguugaaucucuuuuuuugaacuugugaaaauuuuaauaggccuugagacuucucuguguauacucguacuuacagaaggaagucauuuuagaguugagguggauucugugagagguauacagggcccuguccagauuuggggguuuuggcuagggaagaaaggcaaaaguuacccauucccugguggcauuuugcuaaaggagggaugaggcauuggcgagaggaaugggggcgucuaauggugaaacuaugacgaucucaugccagguguguucuugcuaggcugacugucagguuucuuuuugagucugguucuuugaccucauggucagcuggggcccugcuucccuucccuaacugguaugacuaccuguguuuggcucuucagcaaugccuggcaccuugcuugccaagcaaggucuaggguagcauauguuggccuguugcugguggaaccuuuucauagaguugaaaauuggcugccucuggaagcuggggccuuggcuuugucucuaggcccugauccucuggcccugggaaguauuugagucaggucagcauuccaguuuccugcagaaacuggugagugagccacccuguaggcaucuccagguugacugggacagugccaugaugacaaguguuagaaucccccauggcaaugcccuguucuggcuaacgugccauugccuuaaguguagacuggaggagcugugcgcuucuuucccuugcccacaguuggcacuacucugagcuuagcagcauuucgaggucauucuaggggucucauuuacuuucuggcccaagagcuuuuccugcucuugcauugguucccggccaagaucauacaaucccuguucugaauuuccgguucauugacagccuuccccugacucccuucacuguucagagcugaaacauacuuuuucuuucucuuuuaaaaauuuccuucacgccaggcgcgguggcucacgcauguaaucccagcacuuugggaggccaaggugggcggauuacuugaggucaggaguucgggaccagccuggccaacauggcaaaacccugucucuucuaaaaauacaaaaauuagcugggcgaaguggcacgugccuauaauuccagcuacucgggaggcuaaggcacgagaaucgcuugaauccgggagguggagguugcagugagcugagaucacaccacugcaguccagucugggcaacagaaugagacucugucucaaauaauaauaauaauaauaauaaaauaaaaauuauuauggucugacaguugagacuccgccagcucggaaugcccccuucugauugcuggccaccguguugguuuaauggaaggguugaugaaauuaguaguaguucaaagcauagcagagaaaguuguggaaacacuuaguuucuuuucaaaguaaggauggagaggaaauuugaaggaggaacuaauuguuauugugugugguggucuaggcuugcaucuuugcauaacguuucugguugugaacugaaguuuaagcuucuguagaacaguguuuucucaaagccaugucucuagaccuccugcaauggaauucugagcaaggaguggcuguuaaaaaugcagggucuauugaauuagaauagaauauccagagggaccugggaaauggcauuuuauaucagcaccugcugcccuuggugauucugugccugcucaaauuugagaaccacuacucaggaucauuuguucuuguuuugggcugcuauuccccacaaaguuuugcuuaguuauuuuucuuugguuuugcuuaaauugcucucugauguaaaaauugguaaacugccccugccaacccuucuaaauuuauuucugccuguuuugcuuuaaacuccaggcuaauaauuauuaaauuuuaggaguugccuuucauuuuuggauuucuaacucugaauuuuuaauuuuucccacagagcugagaaaacagaaguccuuagugaagaucuauuacagguaacaaaauauagucuccuuuaaaugaucuguuuaaaggauggaaaaaaauuccuaugugagaauugaggccugugggcuuuuuuuuuuuuuuuuuuuaaccagaaacagaauaaaauuaauuagugugauuuugagcaggaaagaaaacaguuuuguugcaugaugaugaaaaggggaucugaaacccagcuaccuggguucgaaucucacgucugcgcugguuagcuuuguggccucagggauuuacugaacuucccugcgccucaguuuccacuucucuaaacugagggaaaggccuuauccaccucacagguuguuaggaggguuuaaugaguuaagcaggaacagcacugggaacggagccuggcacgugguaagugcuagauauuagugaucuauuauuauuacugccacugcaagccacagagacugucuguuucugacgugaaacaucccuugauuugcccuguguucuucugccuuuuuuucagucucuguuagagcaguuguguggcauuuccccagggggcugugcaucccagcggggcagaaccagcauuuauuugcuguugauucuugaauaccuugcacaggaacucaguagacaugggcccucucaacgaauauuaaaugagcaccuucuguuucugugaaagauaacgucccaggcacugggagaaaucagugaacaaaacagauccaggcuucuguccuuguggaguuuacauucuaguggaaauuggaaucaaaauuaaaucauggaauuuguucauuuuuugcuuuucucugguggcaaaugaauguggauuaguuuucuaauguuugaaaaucuggucauugcaagauuuggggaagguaauguggaaucugcuccuaaaucucccauugccugccagcccugaguccuggggcuaugggcuuggaucugaagaaacgcugcccuuuugagaaagaggcacagaccaucucgaugcguaaaaugguuuggggucaaauguauucuguuuugaauuuguugauuuaucuuuaaaauagaaagcaucccaaagggccugcucucauucuucaugagucaucagaauacacauuuuuggcauuccuuccuguaaaaagcggcucucuuugccauaaacagccauauucuagcaauaguauuuugggaagcugcuuaugaugcguggguccccuaagucaguguuucuuauugcugacuguccauucugcuuuagagguuuauuuaaaacacacacacacacaccccaaacccaauaaggaauaauuuugaaaacacagaucuugcaguuaaauuguggaacguuuauuuugcugcuucugucugauguacauuguguggaaggcucaguugccaugaacuggagagagcucuuuggcaucucugguuuuuuccaguuggcagugggucugggcccggaucauucauuuucauuucugccugguccaaccuggugcuuuucuggugcuguaguguguaaacugacuggcgccacucagugugauagcaagguguagccaagaucaucccuuuucccugcauguagauucagccaugcuuuuccuaccagcaugcagacaccacaaaagaaagaggaugaauuuguucucuuuugucucugccuugucagauugagagacgccuggacacggugcggucaauaugccaccauucccauaagcgcuugguggcauguuuccagggccagcauggcaccgaugccgagaggagacacgugaguaucagaugugacucagacccacaguuccugcgucucucugaggcuuuucaaccccuggauugguugguuguccuaaguggcaucaguggaucagccuuuggugacuucuaucaccaagcacgcucaugacaccugcgugaccauagcauucuuuuguguuuaagacaucgcugggcuggaagcccuccuuacacggaaucuucuccaggugcuuuuaaaagcuccacgaucaugugucauugauaagagaauggcugugucgguuaugcaucuuuugcuggcagaaagcggaaagccugucuuaaauugacauugaaguagaaguaauguauugguuugcuaacugaaaaguccagagguugggauggacuugaggucaggguuuaucuaacauuuuaguaauguaaugaaaaacccaguuucuuuccuucucucuccugugcccucagugucugcuuugucccuagacaggcauccucaugauggcaaguuggcuauuggcagcuucuaugggcugcuuguuccuugaguguggccagugggaguagagagccucucucccaguaguuccccuccccuccccucucgccucuuuuucuuuuuucuuuucuuuuugcuucccuucccuuuccccuuuccccuuuccuuucccuucucuucucuuucuuuucuuuucuuuccugacagggucucacuccaugacccaggcuguagugugguaguacagucacagcucacugcagccucaaacuccugggcucaagagauccuccugcuucagucucccaagcagcugagaccacaguacacaccaccaugccuggcuaauuuuuuaaauuuuuuuguagagauggggaucuugcuuuguuaccuaggcugauguagaacuccuggccucaagcaguccucccaccugggccuuccaaagugcuggaauuacaggcaugagccaccauacuuggccccaguaguuuuucuugauggagugagaaagcugcuuuuuccaagcucuuggcagauugaaagcgcguuccauugcauugauuuguguggaguuacauuccccguuuuugacuguuucuguuccacccuaguuaccauggauagggggugagguggggugaggagaugggaugugccgauugguuuaaguuaguuuggcccagaccuagagcaugggcugugguccuacuccuagcucauagacuuuaucaaggccaggguagaucccugagaaaaaucaggauacuaguauagagaggaagagggauggacucuaggagagccauccggugucuuuuccaagguccacuuguucagagcguucaguuccuagguagagccaguggagcacagcagccuuuguucaugagggaguuccauccuugcuuuuacaaguccccagcuuaugagcaugcgguaaaccuuagaccccaugcaacauugaagugacaguuucggugacacacagggaagcuaugauuugguguauugucaccaggugucucaaaagugagaacuauuaauaguaugcagaugaucuguguuacccuuuuauguuuccuacagacuuuuauggggcacccuggcagcaggguuuuuccacucuugcacaacagugaggauucugcaaucaugucugucauaggaauggaaguuugcauacaccuaugcuuccacacuugccucaaagcucugucccucggaaccagacccagccuacugguucugcuuccuggagcuccuuguccuucuguugccuucuucugcucugcuuacccuuuucacauuguuucauuaaguucucugcuucucuuauucuccaagucauauucucugggccaccuccucuguucuuauggcuucuaacugauguguuuaugccagugacuucuaagccauuuucaaccaagcaaaaaacuuccucucuuagaugucuauucuagcaugcaugaucaguucuuccuucuguguugacucucugaauuccauccacccuuuuaugcaggcuggaaacuggggggcuuucuuauauuccuuguuauuuuuuauuuucaagacagggucucacucuguuguccgugcuggaguguaguggcacgaucccggcccauugcaacauuaaccuccugggcucaagccauccuucgaccucaaccuuuaaguagcugggacuacaggcuugcgccaccaagccuggcuaauuguuuguuuguuuuuuucguaguagagaugaggucucaucuguugcccaggcuggucuugaacuccugggcucaagcaguucucccgccuuggccucucaaaguguugggauuacaggcaugagcuacugugcugggccucgcuuuuauuuuauccuccaaaccccauaacugccuaauuagaaaguccuuugauuucucucugugaauauuuuaaauugcucaucuccauugcaucucuaccaccuuggccuuaaugcaagaccugacucccucucaccuggacuguuguagucaccuccugagcuacauuuccugucuguaauuuccuuuccagucugucuucaaccugaucaccagagucaauuuccugaaacacaaaucaacccuauuauccuccugccuaaaaaaaaaaaucuuggcucagugguucuuaacagggaccagaauuacaccccugggggcauauggaaauguguagagacaguucggucaucacagggacuggcaggcaccacuggcauuuggagggugaaccgagaugcuaagcauuuuuuguuuguuuguuuguuuuuugagauggaaucuugcugugucgcccaggcuggagcgcagugguugaucccggcucacugcauccuccaccacccgguucaaacgauucucccaccucagccucccgaguagcugggacuacaggugcacgccaccaagccuggcuaauuuuuguauuuuuaguagagacaggauuucaccauguugaccaggcugguuuccaacuccugaccucaagugauccucccuccucggccucccgaagugcugggguuauaggcgugagccuccgugccuggccaagaugcuaaauguuuuguagugccuggugaaauaguuccacacaggaaguaucuuaauguuagaagugcuucuucugagggacacuggcugguucccauugccugggauaaaguccacacucuuuagaugacuuaagcccuuucucagcugauuccauuucuccuuaucagcuucauugucuccugcugcuucccguucacacccugugccagccacauaacacucaccaguccccaaauaugucacugucccucacaguucuaucuaguuccuguugucuuccuugagacgcaguccaagacauauauucaauagaaacaaauauuuaucaaacaccuacuguguacaagugcuggagauauaaaaugaaugaaauguaaguuuucauggucucaugggggagauacauacaaauggaucauuauaaaacaagaugcucaauaaaacaugcacaggguuuuauggggggcccagaauggguaccagaggaagagggagguaguuaggugaggcuuccuggaggagguggugucugcccuauaaaggagggaaauuaguggcagguggugggaauauuccaggcagcuggggcaaagugcuuggcccucauuucugaaaccuaaugcuuuagcuuuccuuuuccaacgucaaacgaaagugccaaagacagggcuuugaggaugccuacacuuugcacuugggaagaggaguuaccacaacaauggugagagaagacuaauauggagaaaauugcagcagucuccagggcucuagaaaacacaggaggaaccucccaaaggccucauaacaugcuuccugcaugggaagaggcaagaauagaagggaagagagagacaugaggcaggugaccuuugcagcccagccaccauugacauggcagaacugucgugggucagauaagauagauuauuagauuagagaauuauuucuuuuugugcgauuggcaugcauuuuacaaauuaagucuuuagagcauuuaaaauucaucccuggccaggcauggugcugcacuccuguaaucucagcacuuugggaggccaagguggguggauugcuugagcucaggagucgauaccagccugugcaacauggcaaaaccccggaaguggguugcagugagcugagaucgcgucacugaccuccagccugggcaacagagccagacccugucuuaaaaaaaaaaaaaaauuaucccugaugauagaaagcuguucaccucuaggaagcacgaagcccucccuguggaggaguucaguguugauacuugauuaaugagcccauauguuaagcagaguuuccuuauuuauguacauaggaaacaagauuguuguggcuuuggggucagguuagggaaaccacaaaacuauuuacagcugccaucuugagugaugcuugucaaaauagaguuuucuauuauuuuuuuuccauagacuccuagaguuccagaguugcacaauauauuugucuugauuauugcauugaucuuuaauagguauuuaaccuccuuuagaaaggcagcauaaccaaaagguaggaauuauccccuauuauucucaugucuuccuuguccagaaauggggcagcugggaauagucuccuuguagugcagauggagcccauuauuuauuuauuugaaaauaauuuuguaggaagccgaggugggaggauugcuugagacuaggaguuugagaccagccugggcaacauagugagaccuugucucuacaaaaaauuuaaaaaucaauaauuuggggagaggggaaaugaguaaaugccucuguuuauuuuuaaauuucagcuuacuguuuugaauagguucuacauuuacacggucaaaauucagaauauacaaaagaacuuacagugaagugccuccuagcccauuuccccaggcacccaguucccuccuccagagccccugcucuuaguaguuuguuguauagccuugcagagauauucuguccaguacaagccagugcauaugugauuguaucagauggagcccuuuggaggcagaagaggcaagugacaugucagggguggacccuguguuuuuaacaugaaugcccuuucugcugggcaggugaaauuacaugggaugcugcagaauugaaagcauuuuuuuguuagcagauuaugacguuauaaccagcccacuuguaauugccaggccucuccugagauaagccauuggcccguagggaagacacugaacagaggcccgggccaucagcacucaggucugacuuuccugcgucucccugggaugccuggccaggccacuugaccuccuucggcuuuggguuccuugacuguaugauuauaacauuagaucaggugauucuguggucauugccagcuggaaaacaaaucucugauaggaaaaugaguggcuuuguauuuaaaaauauuacaaaaacuggcucuuuagcuagaaguuuuuagguauuuaaauaaagcuacauuuuagaaugauagccaaauuaagagccaguuuagacugggugcgguggcucaugccugcaaucccagaacuuugggaggcugaggagggcagaucacuugaggucaagaguuugagacaagccuggccaacauggcaaaacccuguuucugcuaaaaguacagaaauuagcuggguguaaguggugcaugcccauaaucacagcaggggaggcugaggcacgagaaucacuugaaccuggcaggcggcgguugcagugagccgagauugccccacuacacucuagccuaggugauagagcaagacucugccucaaaaaaaaaaaaaaaaagccaauuuaagaaugaguguucuagcaaaagcuuuugaaauugagcacuucauugcauuuaccugucaggauaaccauuuagagagcaaggucuaugucucugucauguccccagugccuugaacauagugugcuuugauucauuaauaauaauaugaacaggcugggcgugaugguucaugccuguaaucccaacacuuugggaggcugaggcaugcagaucacuugaacucaggaguuugagauuagccuggucaacauaccccaucucuaccaaaaauacaaaaauuagcuggacguggugaugcaggccuguaaucccaccuacuucaguggcuaaggcaggagaguugcuugaaccuggaagguggagacugcagugagucaagaucaugccacugcauugcagccugggugacagacucagacccugucccaaaaaaacaaacaaaaauaauaauaagcagaacaacaacaacagcaauaauaauaauagcagcuaacauuuacugaauacuuacaauguguuagguacuugauauguuuucuuuagucaacagauagccccaaacugaaacagagaucaucauacaacuaauaucugugagaccagaaccugaacccagacaggcugucuccuaccuguguaauuugccuggagggagaaauuaaugaaugaugaucugaaaaagaucauugagaauggguaucaaauaaugagaaaaacacacacugucuucuaucuuccagaaaaaacugccucugacagcucuugcucaaaauaugcaagaagcaucgacucagcuggaagacucucuccugggguaagaguugcugccuucagagugccaagugccauguagauugguggaaguggcugggccaggugguguauguaggaccugugagaggaacugugagcguugauggcauggcucauccgcuaggagaccggcugagacuccuugggagaaaguggggucaaggccgccagguugcuggagaaucuuccuuuuaguaggugucaggcuggaguuggauggcagaaagggccauuaacaaaaaagcaacugauagggucaaugccuauuccccuaaucuuggacagaaagaauguggucccuucuguguuccagguguuggcucagauuuagaaacucugaccagacccuuucaguucuuagucacaucguuuacaggcggucaccaaaacguccaugguaguuaucuaaaaagaguguauuuucugaauuacuuggauuuuuuuuuuuuuuuuacaauugucauguauucuuuaaauaauuuauauaaguaagaacaaagcaguuuuuauuguaggagggaagguauacccuucugucugcuccugcagcaaggcugguguucucuagcccugucugcucucucuggcugugacaugggcccugcuucccagcaggacgaggccuucagacuuuucaguccauuucucagcgucuacaguuaucucgcuguccuagaacaguuuccucccauucgucaccauuccuuucuccugucugcuuccauguuugggggcccugggaggaggguggccugugcccaccugccagcauccuccuucccuccagccuggaaguuuuuccuguuugugcuuccacaugcuauggccauccucaucacaccagagugauacugcgugcuagcaugguuauaaguguuuuccaaguaauagcucauuuaauccuuaaaacaaccuaggagguaggucauaucagcacuuagaaccauguuaacacacaacaucacucccauuuuacagacgaggauacugacagagagggcagggaaauugccugagaccccacagugggagaagagcaaagccuguauucagacuugggcagcuuggcaccagagagcauguuccugacuaugacaccauggccaccucacaccaggcaacgugcauuucuggugucaaaaaaaccccauagagagcuugcagggguggaggggaaggaaaggagagagggaggagggagggauagagacuguggaguuauaucacugcacguguacuuuguaugauaucagcugcauguucgcaagcaaacuaaaaggaaacaugauauuuauguaacagggcccuuaaguguuagccagcuagcucaucugcauagcagaaagggagccuggccaaggcuggacucgcagacauaagauaacauggaaugaacuuaaugucuaauuuaaaagaucuucagaguauuuugugaacacuuggcuuucaccugacuugagaauuuaauucuugaguaauuuguuauuucacuguucacacaucugucugccacccacacacacaaagugcaucccugagacagucauuuuuauuuuaaagcacaaaucuguggacucauguuuuaggcaguacccuacauuuauaauauuuucaaggcucguuagguagcacccuaaugcguuccuguuguauggcaagcagcacugauccacacgauaauccagugccugauuuaaugagcacgugcucguuguugggggucuuguuuuuaaaggaagaugcuggagacguguggagaugcugagaaucagcuggcucucgagcucucccagcacgaagucuuuguugagaaggagaucguggacccucuguacggcauagcugaggugggugcuucaccgugcagcacggaagagccgagaguggugugggcuggacagugaguguuaaaauuuuaacaguaguugcuggcuuuaacauacacuucuuuuuggaaauaaggggagucaauugaagguacaaaauccuuugccuuagagaaaaaacguuuguaaauacuuuaaaaugguuaaccuaaaagcccugaagugcaucccauuugguauguucuuauuuuuagguggagauucccaacauccagaagcagaggaagcagcuugcaagauugguguuagacugggauucagucagagccagguaacagcuugagccagcaaugcagcauugugucccauucccaccacgggggagaagaccacugacaguggacacaauggaagugcucaccaauucgugcauuugacccccagacugggugccagccugccagcaccuccuauaggccuuguucucccaagcguggcaguggggauguuguuagaacauccuguucuuagugagccagcagugaaaggaaauaaucuaaggaaaaugaagugaguauauuuaacggaagaggggaugguggcaguuuugagagcacaacucagaguguaggaauaaacacaucuguggcccuaacagcucaugaggguccugccaugucacaaacccuguguacuuguaauaccuucaguaccaaggaaggaggcacucacauggcaggaacucauguaaaccuauguagccaaaucagcgcugcugauguggggacugaugccagcgaaggagucugucaggauucagagcaggacugcugccucugcuuuguccuugauggaguuuuuuggcuuuuuuuucuuuccuuuucuuuuuuuuuuuuuuuuuuugagucaaggucuugcucugcuguaccaggcuggugcgaucauagcuuacugcagccucagacucccaggcucaagugauccuucugccucggcaucccagguagcugggacuacaggcacaugccacagcuuggagauggugucuagcuguguugcccaggcuggucuugaacuucuggccucaagugauccucccaccuuggccucccaaagcgcugggauuacagccaugagccgugguaccuggcccucaguggaguuucuaucagugacuuacauggcuuucuucucaggcaugugacaguugggaauagggaaacaggcaccaccagccucaguccuguuuccugcuuuaucacaaggguugacaaaccucuucuguaaagggcuggauaguaaaucuuucuggugcugcaacccaguugcucccuguuguaacugcuuaacucugcuguuguagcauaaaggcagcuguaggcaaugcauacaugaaugagcauggcuguguuccaauaaaacuuuauuuacaauguguacaaaucaguugugaagaugaguccugauuuaagaaauguugagaugagaaaagguauauuuaggaauucacacauggugaagacucugcuagugcaauuaucaaguaacuuaccucuugccacaugccagagaucgagcuacuuucauuuuaugucagcccauuugauucucccagcaaucccuguucauuuguucaucuguguuuucaacugauaucaauuaggugcucagugugcaccagacuuugugcuagacucuaaaugcauaggccuuuccaugugacuuggagggaacaggguagagguuaguguaacauucccuacuuuugagaggagacuuguuuuacagauaagggagggaccugcauuuguuaucuauaugacuugcuuugugccuucaggagcauacauugcaguguuaggauucugacagcaaaguccacagucuccuggucauguguacaugugauguucccugucaccugggcuggagugcagcggugugaucauagcucacugcaaccucaaacuccugggcucaagggauccuccugccucagccucucgaguagcugcacaccaccacacccagcuacuauuuuuuuuuuuuuuaagauggagucucucucugucaaccaggcuggaguacaguggcacaaucuuggcucacugcaaccaaggugcuggguucaagcgauacuccugucucagccuccuuaauaguugggauuacaagcaugugccaccacaccuggcuaauuuuuguauuuuuaguagagaugggguuucaccacauuggccaggcuggucucaaacuccugaucucaggugauuucccugccuuagccucccaaagugcuaggauuacaggcgugagccacugcaaccagccccagcuuuuuauuuuuaguagagaccuggucucgguauguugcccaggcuggucucaaacuccuggccgcaaguaaaugucucuucuugaccucccacaguguugggauuacaggugugagucaucacaccuggccuguacgugugauuggaauccuguguagcugagagugcaggccacccugcgauacaucuuugcucaagagaaggaaaaauauucuaaugauuaauuaaacaaggcagcaaaugcucccucacuagaguugguugagcauuauuauagauguuuaucugacaggaguuuugcaucuugagugcauguaucucauaggugauuuuaauacugauucuugaucuugcauucauggucuuguucacuuaaucacaauagguguuggagaagcugaaacaauugaauauuuccacuuuuucucauucuucuugcuuuucccuggagaaaaaaaugguaauaaguaggaauccauuauaugccagacaucauaugcugugcacaugcacacauauuuuucucgcuuuuccuccuuaugacaguuccacaaggcagacaguguuugugauaguuuuguagaugaggcaacugagaugcauagaggcuaagucacuaacuaggucacauaacuaguuaagauaaagcugagcuccaaacuugaacaugucagacucugaaaucuaugcuccuuucacaauauagcaucuccaguuuagcuuuggcugacuugcugaagccuuuugguggaggagugugucacgucaggaacacaaagugggcagaacauagcauuuuggggcacugcagcagucuagaaaguuuaguaaguagcuaacauguuuuuuggguuuuuuuguuuguuuguuugagacagggucucacucuguccccaggcuggagugcggcguugcgaucuuggucugggcucacugcaagcucugccucccagguucacgccauucuccugccucagccucccaaguugcugggacuacaggcgccugccaccacgcccagcuaauguuuuguauuuuuaguagagaugggguuucaccguguuagccaagauggucucgauauccugaccucaugauccgcccaccucggcuucccaaagugcugggauuacaggcgugagccaacgcacccggccaacguggguuuucuugcugcauuuuauaacaucuauguuuacauuuaaagugauagaguuuuccacaacaccagacauacccauuuucaaacagaaggucaaagcacauuugaaaaucaaaacaaauuguuuucuaugauuauuucccacuuuuccccuauuauuacuauaguuucuuuuuuuuucuuuuuagugcuuucauagcuauugauugauaccuacauuauuauuguuauuguuguuuguagacauggagucuuguuguguuguccaggcuggucucaaacugcuagcucaagugauccucccaccuuagccucccaaaguguugggauuacaggcgugagccaccgcacccagccucauagcuacacuauugaaguucuggcuuuuacuuucugaaaguaaucccaggucacagaugguaguaugguaguggaaagagccacaaggaguucucaaaagcaggagcugauucccaguggcacagggaacauuucagcucaaagcaagagagcaaggagagcaccuugcucuccuccgguggcagggauuccaugguuggccaccacaagaaagggguuccauggauuucucuccaguaguagaguuugugugagacaagaugugguugguuaugcucaaagcagaccacuacuccuagcacuaugagaguccugucauggugagaagcuaaagucuccuuuugccugcuuccauucuuagagaauaagcucaagagaauuuggcauccugggcaaugauaccccuuccagguagaaucaauuguggggaaggaucuaucuccaccagguccugccuccagcuguugaguauacacagcugguucucagaugcuggugaccccuuuguuuugcagguggaaccaagcucacaaauccucaggaaccaacuuucaggggcuuccaucaaaaauagauacucuaaaggaagagauggaugaagcuggaaauaaaguagaacagugcaagguaugagaauuccuugauaaauguaucuuuucgguuuuugcaaaugagggaugaaaguucaaauguaaguuacuuaauguuuuaaauaauuucuaucagaauauuuugaaugauuuuaaagguagguuuuauuuucuucuucucuaagacuauauuauuuuaugaucagaauaaaacauuuuaaauuucaaauaggauauuuuuaaaaacuugacaagaugucuaagcuuauuuaaagaugaagucagaaaaaaggaaagaaaaccauagcaaaacauauaauaaaauuacagcgauuaaaaaugcauaagaaauacaaaaguaagaaaaaagaaguaaaacuguauaagaagcauuaaaauagaucagugaaauaguauagguuuucuggaaugaaugcuauaauguaaaauuuaauauacaguaaauggcucauauguccuuggagaagauaaggauuacuuuuaaaauguugcuugaacaauugguuuguaauuugggagaaauagagcuuuuuaucucauaaauuacagauuaauuagauggucaagugaucucauucucucugcauccaccuguguagauagauguucauucugaauguuauuugaggugaaauuauuugaaaugguaaaggaauaggucuucggggagucuugacaaucuagagucuuaagucuggauugacuuagacuuuuccugcucuuauuuuucauuguuuuaaaaaaauuguuuuuuuauuuccugcuaauauuaagacuguuauauuuuaguucauuuaggucaugacauacuuugcuuuucaaaauagcaaaccuugaucaguuaacugcaauuaaaugacuuguuuaaaauaauauaguggguagaaauauaagaaaaauauaaaaauaauauaguggguagaaauuaaaacuaaacucacaaaguuaugccuuuguuuuaaaaaguuuuuauguuuaaaagaugauauucagauaaaugcuucuacuaaaauaaugucacauuggcuuauuuguggucugaagaguuguagcuuugucagugucauuuacccagcagucuucuuaauaucuggucuaaccuagauccuggcuauugccuacuuauugcacacaaauuuggguagagguuuaggaagucaucaugggcugaugucuguucucucaacuuccacacuugucaguauuucaagugguaaaaacuuaagaaaauauuuucugccuccuucucucucuaugcauaccuuguggguaauuuccucagaucuauguucuguuucacugauucucucuuuagcuauguuugaucugcuacucaaauaacacugaguuuuuaauuucauugacuauauuuuccauuucugaaguucuaguuauucaaaucuuuuugauacuacauuauucuuuucuaguguuucuuucuuuuaagucauuuuaaacauacuuauuuaauaaucucuguuaauucuguuuucugaaauucucugugagagugguaggugucugcuugugguggauuauuuccucauguguuuuguaauuauuugaacucauuuuaagaggggcuuuaucugugggacuaucagggauugggaaugagacuucccagagaguauuaccaguccagguccauuuuuaauuaaacuuaaaucaguuugggguuucugggaccacaugucaguaaauuuaaacuuuaaacccuccugaaagcaggccuauguuuugugaaaucucuuggccaauguuucucagaccuaaagcccauuccaaaacagacauacuuccccaugauuuccaugugaugcuaagugcauuuguucuaaucuguuguuucguugagaguacaguucuucaggaaucuuaucuuuaugcaugauauauguguacuuguuucuccuuacuaguccccaaggcuucagacaccuuggucaccaagacuggcacaaaucugccccaggucaucuccagcuuccauugaugcuuagcauuccgacuuuuucuuucuuucugcuucuuuuucuucuuucucucuuuguguguguguguguauggugggguugaggggaaucaaggaauuuacuuuauugcuuucccaguuauuauaaaaggauguucauuacuucuaacuagcauuuccaaguuuuugucauaaaugggaggcccuucacauuaauuuguguaccuugaugccaaaaacagaagucauuacauuaaaaaaaaaacaaacucucucuacauauauauuuuccggcauauaaguuuucauauauauauauauauauaaaauuccuauguauauuuauauuugaagauuggaaauacguaccuaauugccuaaucugucacuuaaaauuucuuuuuggccaggugcaguggcucacaucuguaauccuagcacuuugugaggcugagaugggaggaucacuugaggucaggaguucaaaaccaggcugaccaacaugaugaaacuccaucucuacuaaaaaacagaaaaauauuagcugaguauggugguaugcaccuguagucccagcuacucaggaggcugaggcaggagaaucgcuugaaccccggagauggagguugcggugggccaagauugcgccaccagacuccagccugggcuacagagcaagcaagacuccaucucaaaaaaaaaaaaaaaaaaaaaaaaaauuuuuuuuuuuuuuuacuuagagacuagaucuugcucuguuguccaggcuguucucaaauuccuggcuccaagcaauccucccaccucagccucccaaagugcugggauuguaggugugagccaccacacucagccugucacuguucacaaaauuauuuaauuuuuauauauguaauucauuuacauuaggucagauaugaaaaaguguaaaacaguguaccgugaagucuuucuucuaccauuauccuccuccugccuaauuuccauugcucccaauagguaauaacuguacuaauuucuuguuuuuuugucaagacauauuuuuauacauaugugacaauaacaauaugacauugcugagugugguggcucacgccuguaauccuagcacuuugggaggcugggguggguggaucacuugaggccaggaguuugagaccagccuggccaacguggcaaaaccuugucucuaccaaaaauacaaaaagugugguggcacacgccuguaaucccagcuacuaggguggcugagacaggagaauuccuugaacccgggagguggagguuucagugagccaagauugugccacugcacuucagcuugggugacagagugagacucuaucucaaaaaaauaaauaaaaacaaaauaaaaauaugacauacccuuccacccacccccugccuuuuuuuuuuucuuuggagacggagucuugcacuguugccaggcuggagugcaguggcacaaucuuggcucacugcaagcucugccucccggguucacaccauucuccugccucagccucccaaguagcugggacuacaggugcccgccaccauaccuggcuaauuuuuuguauuuuuaguagcgacaggguuucacuguguuagucaggauggucucaaucuccugacguugugauccgcccaccuuggccugccaaagugagccaccacacccagccuuuuuuuagacagagucucacucuaucggccaggcuggagugcaguggcacacgaucucagcucacugcaaccaccaccucccaggcucaagcaauucuccugccucagccucccgaguagcuaggauuacagcugcccgcccccacgccuggcuaauuuuuguauuuuuaguagagacgggguuucaccauguuggccaggcuggucucaaacuccugaccucagguaaucugcccaucucagccucccaaagugcugggauuacaggcaugagccaucgugcccggccauuccaccccuuuuuuaacccagauguuaauacaccauaaguaaugcucuguacuuugcuucuuaaacagauguguuaaaauauaucuuggagaucuuucuuugucagucauguaagaagccuccuuauucuuucuguaugguuguaccaggcaguugauggacauuuaaucuguggugcuuuccaucacuuuuucaucuaagagcucacagagauuguucucagaugccauuuuguuucacuucuuuuuucuucaauaaccucuuaucuuccauuuacccaggaucaacuugcagcagacauguacaacuuuauggccaaagaaggggaguauggcaaauucuuuguuacgguaagcaccuucccuugagaaaauguuaaagcauuguuaaaauggagucauuuuagcuuuuuugcaaaagauuucauuuuuaguuuugcucagccauuguguguguguccauccgaugcuaacguuacuuuuguuuuugaaugugggucuguucucaguuauuagaagcccaagcagauuaccauagaaaagcauuagcagucuuagaaaagacccuccccgaaaugcgagcccaucaagguaauguaacccgcgugcggcugaugcuuccuucuugccucugccaccucugccuggguucuucuucacccugacuccucugcaugcacguccuugggauaaagcuucucugccuaggaggguacuguuucccagcauaauuucaucuuccuugcugcauucucuaauuucuuccaaacccaaauuaacacacuaauggaacauuuguaguucuucugaaaccuucaguugaagagaaagcuggccucuuuggggaguaccuguguguuuucccaucuucuguaggcuugaaaaaguccagcauugaaugauccuuuuccacaucaguuauuuguuccacaggacuuaauucuggccaugugacuccaagagcauccauucuagggaaaauauuuuggacuuuccaaaagagaagccaguacuugaugccacaucaugcacgucacacuuaauaauaagugugauugaauccuaagaccguggucgcuucguucagacuccuccuuugucuuuauacuaagcuuuuguucuuaucaccauuaauauuucuccuaucauauucaagcacacugcagauuguaucugcaaguuaggugcagacugaacuuuccccuuauguugaauuuuaaguugggcaucuaaagcugcuuuuuuuuuuuucucucccuaaagcuuucgaugcugugucucucugauuuaccauuagagcauuuaccagcagagaugagcacagcuguugagucagaaauugcucggccgucuuuggaucuauuucaccugugguguagaccugacauuuggagcuuaugcuccucugcagaaccacuggucuugagcugaaaggggaucaggccaggugcugagugggaugacuuugugauuuugagaccgagcaugugucuguguguguugugggggggaugcuuuguggaugugcauacauaccagcaccuucaagaaugcgacuucuucucccccuaaguuccaggagauccucacagguucuggcuuugugccugaaaauuuugggauuauggaauuauaaaauuuuaugucuugccugaccauauagucagaucuucagcauucucaggggcaguguuucugauuuucucagccauugcccuugccuucccaaauaaucaagauuauuaguucauggaggaugguguugagucacagugcaaaggaacgaggucucuggaaaauguucccaccuuucuagggacagacucuugcugggcaaguucagaggaccaagaaaauauauuuaugagauaucugcugugggcugggccccgcauaggacaaaauaguagacaaaucaucauuuuagccuuugaauggcugagagucugauuugaaagaguugauuaacaagaggaaaaacgagagauuggauuuuuuuucgcauuuuguuuguuuguuuguuuuaaagagacaaagucucacucuguugcccaggcuagacuagaacucucauucuguuuuuuucccaaggguauuuucccuagagaaauacaucaggaagccauggagagcggggaugggacaggaaagagguuaggauggaacagcccguggaggaagugcgauuuguccuucuugcugaggucacccuuuaccgaguugcaauucaaccccucccaccucugccuguccuuguaccugccuuucaucuuaguucugucuuuucuuuccuugcugucuucucuguuuucagaaagacuuaucuuguccuuacuauauaaaaaaagugugaccugcccccacagcccccucaccuccguggacucuggugucacauucauggucaguuggugguaaucugguaccuuccugaccugaacacagcguccuguuuaaucugguucuccuucauuuuuucugguggguacuucagaugaccccuuccugccugccaccugcauuuucuuaccaccuuccuacuccugaauccuuugcacucuugugucuacccccaaucccucugcuguuuaggaaaaaagagcaaaacauacugcaguuuucaaaggaccagcaaccacccgucagauccuggcauuugacccggcaugggccgucccuuccuuauucauuuuugucuccucacgccacucgacugucuucuuucauuguaaggacucugcauugcuccauuucuuuuuaaaaauuuuucuucaagaaggauuauauauugcucauuucugucuccaccccagaagucagccuuuucugagguccaguccuugcaccucuguucucucccacccucacuuccucgcccccuuuucccuagaaauccccuuacuuggacagcuuugccucuuaccugcauuuuaauccuugcagccuccuaagcaucgguucccuuugaugaacagcacucaccuuaaacucaaaaagcaaaccaguccucuucccacuccaacugucccuuuucucccuucuugucucccuuauaucaccuuucuccaagugauucaggucuuaaccuuggaacccuuuucuccuuccucucuuccauccagugccuggguucuguccauuucgcccuaggcucugucauccucucuuccccuggcccacucugcuccaugcucucacggccuuggcgugaacuugggauaagauguaaauucccagacucacaauuccugaucuuuucucagcugauugccccucacaaagauguguuuguccguuuuucagccuguuuaaucucuguccgucucaugagacccccuccaaccucauuuccuuugagaagccuucuccgacagcugaagccaauggcaaacacuuugccucuugaauugugccagcauuuauggucuacaccagaagucgcaaacagccauaucucauuaaaaauuguuaaaaguugguugucaucaugugaaaaccagaugguuugauguaacaauucugauuucuggcuucuccugaaaguugagaacaucuggcaacacuggcuuugcuuucccacguggcaguguugguuuggugcagaggagugguuaucgccugucggcagaucgugcacucccagcaggauuugugccccugugcuaccuauccgacuccucuggacaauugcauuugcaacccuugucuauaccaucgaucugccaugacuuagcaaauaugucuugucuuguuauugacuguucuguguuuacaugugugucuuauauucccuucacaauucaauugcccucuuccugaggguagggagucucuguuaacuuuacaugccuccugcaguaccugacacauaguaggucuguuguuugagaggccagugccugagguggaauuugccuuaugacuugcuucuaggucagugguucucacuugcacccucugucaacauuauaccaggcuugggggugggguacacucuguccaguguuuacuagaaaguuccagcagagguuugaagcaugcccgccccuuagcauuacaggguugggcuuguggugaaggcaauggcgggugucauuugcagaaccccccugggugauuccagggcauccccuaguggaaggcucacguggccauuuucagccuguguuguaacuuauugcuuuagauaaaagggacaaaguauuucagguaagauuugaccucugggaagguccagacccccagaugcguuuucuauuggaaauuccccagcuggggccgggccagagacgaggagggcuccccacaauucugagaguggcugguggccugcaccucauuuuugucccccaccuuccuuucccucaccccuuucuucagucuuuaccucuugcucuuuccauccauuuuuaccuuuccacaagcucucgguucuauggauuugugggauuuuauuuuucuuccuuccccaugugcaaaucuaccccugcugugacaugggagagaguguaagaggacacaccagaguacauacugccuucuuccaacccagcuuucuaacagcagagcugcuaagggaccaauggccaguaaaggugcagagaaggacaugaacccuuccuguuguuggaaagauuuaaguguuucucccuggagcaguuuucacaacugguuugcccuccuuugcuucugcgagcugcucagauagcacuagaucucugcagcuugcacaggcaggccaaauucaaccagauacuucuuauucuaauucauauguccguucucuaaauucuucuuucuauuuuacugcuucauuguauuugugcuaagcugccucauaaccugaagauaaucuaaaauauggcuuuccugccaucagcauagccuucagcugcuuuagggcugcagaugcugcauuucuuuccacucagaauuuuucggagcuguuuggggaugcgguguucugaagcacugcaugccgcggagaugucgcaucugauggagaguaacugcaacguggagaguucacguuggccaucuccagucuuguaugacagauacuuaacuuguguuugaaauuuucagagaucauuuccauuuuugcauagcaaagaaucuauuucuuguccucuagcuagaaggcuuugcauggcuagaauaaauuucuuuucaacgaaacgguaugcucuggcaaaucuuccuuuugguucaaggcagcccacuaaacccgcuggcguguguugaugaaguguggugcaggugcagcgugccacugcagcuucugggcagccugaguuggugccaucuagguacgcucaggcuucuguuccacaaguaaccgccccagccugguccauaguuugcugcuccaguagauggcaaauaacaaaagcaaauagaacagauguauccccucuugcacagccucaccuaccagucggcuagaaaagcccauuggguaguuggggagaaaauagcuugguaaugccgugaguuuguugggugucuaacugaacaauuugcugcucuagauaagugggcggaaaaaccagccuuugggacuccccuagaagaacaccugaagaggagcgggcgcgagauugcgcugcccauugaagccugugucaugcugcuucuggagacaggcaugaaggaggaggugaggggagcuucgugauccugugcaccaagucuccaugccccuuguuguacccagagcaccaugcuccccgccagcccccuguccaccccugcuuaguuauacagccauuguccguuuuguguagaacaguggcuuucaagcuuuugucaccaugauccauauuuuaaauugcaacccuguucccuaugauaccuaucugucuaugaaugaaacaaagguuuuacaaaacaauguuuaccuuuccugauugugguacacccugaccucuuuguguccuguuugauuguuucauuuaaaacucugguugugauuugugacaauagauuucgugacgcacuaaugggcuaaggagcuuuaguuuacauuugcauaguauuaugcaguuuuuuugguuggaggucauuuacauacuuaauuuuacaggauucuuaccccaaaccccccaugaaccaaauaagggaguuuuuauuacucuucuuguauaaauaaggaagucagcaugcagggaguuuacuccaggucagagcuagaaucaaaaugcaaggcuuuuuuuuuuuccuuuuuaaagcuuuguauugaaauagaacguacauacagaaaagcauacauaucauagguguacagcuugaugugcuugcaugacuaaacccacccauggagucggcgcucagaucaaagaacaucccggaagcccuccuuguguuugcuuccagccacuccccuucuaacagccuacauuggugcuucuugucuggggccagauuugcuccccaggagacauuugucaaggucuggagguauuuuggaucaucacaacugagaagaggagguguuacugucaucuaguaguagaggccauguguauucguccauucucacacugcuguaaagaacuaccugagccuggguaauuuaugacgaaaagagcuuuaccugacucacaguuccacaggcuguacaggaaucguggcuggagaggccucaggaaacuuacagucauggcggaaggggaagcaggcaguguucacgugguggaacaggagggaaagagcgagcaugcgcacaaagggggaguugcuacacacuuucaaacaaccagaucaugugagaucucacucacuaucacaagaacagcaaaagggaaauccacccccaugauccagucaccucccaccaggcccugccuucaacacuggagaucauacuuccacaugagauuuggguggggacacagaaccaaaccauaucaccauggauucugcuaaacauccuacagggcacaggacaaccuccaacaaaaaaucauccagccuaaaauguccauagugcugaggucaagaaacucugcccagauuaauuuucuuccugccugucccugugcuugggugcgugcucagcccucaucauuccuccugacagcccugcagggcaggcaguaacacugcuuucauagacaggaggugagcggaagucaggaaauacccaucagaacacacugccacuuagucugagugucccaaccugcacuugaugcugauggcuuuucauuaucuuuagggccuuuuccgaauuggggcuggggccuccaaguuaaagaagcugaaagcugcuuuggacuguucuacuucucaccuggaugaguucuauucagacccccaugcuguagcaggugagcgccaaagagugucugcaaaucaagucacccucaaggcggugggcagguucugucucagacagauggucaguuaaaauccaauuucaguuacagguuuaagugacaaaaccgaaguggcucuugcuacaauuccuuaguguauauacaauguaauguacacugugucuucuuuacuccuuuucuguuuuucuauuuugaugauuaaaagagagaguagcuuauaaugcaaauauuuggagacauauuuguauuuucuucccaucuuucacagucuccccccaccaaauuccuuucuaccuggagaaauuaugucuguuaaggggaugacuuuaaaacuaauuuuauuuguaauugaucucuuaaaacuuuuuuuuuucagagauugaauuuguuuuaugaacauuuuagucucuaacaacucuugccaacuuaugauuuguuauguacaccuuggaagaucguuauugagaucauuucaauuugcaaaauaauaugucccaagauuccuagccuuaccccuuuuucauacucaaagagaguguuaaugauuucaggugcuuuaaaauccuauuuacgggaauugccugaaccuuugaugacuuuuaaucuguaugaagaauggacacaaguugcaagguaaguuuaaagaacacagaguuguaaauguuaaagggaaugaagugauauugugcccuauuugcaaaucauuuuauucucagggaucauaagauuaaaauagcguauuuguuaaauaauacaugucucagcucuuauuuauguuuagaauaaaaauaucaaguauuauaauuauuaguguaggaaagucaccacguaggcauugguuuaaauuuguguuauuuagguggaugaagacauagagugguacccacauuaauggauuugcaaauuuccagcccccuuuauguugaagaaagcccuguaacuggggauaggggucauacugacccguggcagugugccuuuugagcugugugcagucucaccugugcgauaauacaguuggccuuuaaacagcauggggauuaggggcauugauacccuacauaauugcaaauucaaguauacuuuuaacucccucaaaacaacuaauagcauacuguugacuggaagccuuacugauaaccuagucaauuaacacauauuuuguauguuguauguauuauauacuguauucuuacaauagauaagcuagagaaaaaguacuauuaagaaaauuguaaggaggagacaaucuguuuacuauucauuaaggggaaguggaucaucuuaaaggucuucauccuugucuucaugucgaguagguugaagaagcagagaaagugaagggguuggucuuccuguuucagggguggcaguucaucugugaguuuuuucagauuguccgagaucuccaggaauuuuccuauauguuuauugaaaaauuugcauauaaguggaccuuguguugucagcuguauaaugaugacauuaauauuuacugagcauuuucuugugcuaaguacugugcucaucuuuguagcuauuaccuccuguaaucuuuaauuaacguuauaaaaggcagaugauguugugauccacauuuuacagagaggaaacugaggcuugggagggaacagggccaggagaguagcaaguaauuggcagagcuagaauucaaaccagacagacccaaaugcuauauuccucuacuucgucccuuucccuccacccucagcuucagucugucuaggaacagaugauuuuaagcaggacagcuuuguuuaaaaagccuagaggcuucugcuuggcuggccagcccaccuccucgucuuuuuucucauggcgcugacuccccuccucuccagagugccuacuccucaccacuaagggaagaggaacaaaucucaccucuguucuguccucuuccccgucuacggacacugccccuguucccugcaggcaggccaugaucaaauaagagccacuuauuucugaucaguuacacuucaguggaugugaguccaucgcuugugucuuuaaccagguuuugcauuugagcuuuuuucuuuuuuuuuuuuuuuuuuuuuugaguuggagucccacucugucgcccaggcuggagugcaguggcacagucuagggucacugcaaccuccaccucccugguucaagcaauuccccugccucagccuccugaguagcugggauuacaggcgcacaccaccaugccuggcuaauuuuuuuguauuuuuaguagagacaagguuucaccauguuggccagacuggucucaaacuccugaccucaggcaaucugccugccucggccucccaaacugcugggauuacuggcauaaaccaccgcgcucagccgcauuugagcuuuucucuguaauuguggaaugagacuuugucccugguagauggugagguuuuuaaguucagagacaaguucuuagucaucacguauccuuggaacccugccuggggcccagccugcugucaguauuaauguuuaugggacagaauucaguagaauccaacaucaguguuagguagaagagaguugugggauuucuuuuauuggcuagccuccuacccaauaaaagauuuccuuguuuauuacaaggaaauaaacuuguaaaagaaggcgucuaucuguugguauauugauucuauaguugagaauugucaauaugggugggcuuccaucccaguaacacaucgacuggccucuaaaguguaauuauguuuaaucccuauccauguucuccagaaugguucuguucuggaggauauuucacguucaaagugguguuauagaggccccuuuaacacucuuggucccuagugggcagaguuggccgugcucuacaggcuccucacugccccuuuuuuaugucucugcaaguuuguacguugcgccuguggagugcaagagcucuuacaguugcuucacaacagaaaugggcugcuugaugugcagccaguuugcaguauugcaagcgaggaaagacccagaggucugggugccugggagcucagcccccugaucuguggcugggcugcuugaggguaggagaauuuggguucuguaaagccauacgucaguacacacuuuuucuagacagaauuuucaguagugucuugucucuucugugccaagcauugguggaggugguuuugucacagacgccucaaaaucguucagcagaaucaacacuuacccuguuuugcacauccagagauugaagguuaaccaacugcgcagaguuaaacaguuaauugguauuugacucuaaaucuguuuauuuccauagcaugggcuguuuuccaacugugcuuucucugucaaaauggaggccucauuuuuaacauagcauauuaauaagauaauuggugucuuaauaaguuguuguacuuaaaaguuuuuguucucagugugcaggaucaagacaaaaaacuucaagacuuguggagaacaugucagaaguugccaccacaaaauuuuguuaacuuuagguauguaugauugagcuacaaugacucuggagugaagauaaguuuaaugcccagcagagaagucauuuaauucaggcauacuuggcacauuaaaaaacaacaacaacaacaaaaaaaaccacaucacuuuggagaguaacuuggggcuacugggaaugggauuucauguauauuaugaugaauuugaagcaucaguaucaugccugacauuaauacguaaguuggcuuaucauuuucccacuacagcuauuagcaauaaauuucuugugaaaaguuugagugacuguauguuggguuuggaguccaaaucauccaguauguuaaaaggcaaaauuaaucaauaauuguacauucuguaaugucuuuuauauaugcuacuuaauuuaaaguauaaaucaucuuacuaaauaaaauuucaaagaauggagauuauauauugcuuuguggaauaacugugguuuuaagaaaauuuaccaugggacaaaacuuccauaauguaacuucuguuuuccuuuugacuuaauauguaacuuugaacaaguauagagaaaaggaaaaaguggccucaggugguaaagucacucaaaaccaaacaaagaaaauuuucuagaaagugccccuagaaaauuuuccuuguuugguuuugagugacauuaagugaccagucagaauaguuuacaggugauaugccuggaauguuacuuguccuuaaauuccgccuugggcucuccuacuaagcuaagcuacauacugccuuuuaaauauucccuuugauuaauuuaacucacccaccuuggaauuacagauacucuuccucuauucaguguauauggugagagcucaguacuucuuaguauguugagaguuuggcucuuuauuuuguuuauuuuacucuguaauuguuacuaauugauuuuugaauagggagcacauucccaugguucaaaauucaaaugguauacgaugaaaaaucucucuccuguucccauaccccagccacccaguuccucuccugggaugcauccaguguuuacaguuucuuauauauccucucagcaagaguuaauguagacguaagcagauacauucguguguacauacuugccuguguguuuuuccucucacacccccuuuuuaaaaaaccaaaugguaguguauauuguauacgucauucucccccuuaccuuuuuugcuugacagcuuaagguauuugcguaauacaucuuggagauuuuuccuucucaguacauuuuguaaugaugguagcauaguccuccacuguauggauauacugugauuuauuuaagcagcucccuauugauagguuguucuuacguuuuugccuuuauaugacuguacuuauacauaagguagguauauaugauaaauuggauauuuuuauaauuccaccauaaaguguuuucaaauacaguuuccuguaagcaauauaacugugucuguuuuuguauuuaaaaauauugagcucacuauuaacacauuauaacuuauaauagggguagaauagauaggacauaaaggagaaauugauuagaaauauacagccaauagggguucaaaucacugagauuuagacuuaaccuauuuucuucuuccaagcccuaauuagucuauuaucugaagcaaagaacacaagaaauguauaaaaugcuucaccugagccagauucugauuuaggaacccucugcaguuagcaccugagcaaacugggauugugcacccaggcaggaagagaacauuccagcagcuauuucagaggagaaacccuccccuucucuuuugaccccuagauauuugaucaaguuccuugcaaagcuugcucagaccagcgaugugaauaaaaugacucccagcaacauugcgauuguguuaggcccuaacuuguuaugggccagaaaugaaggguaagucaucuuucucuguaucauuugaauuucuucuuucccaccugaugggaugcauagaaauguaacucagguuacacauucuaguuuaagaucaauucaagguauucugaaguugguuuucucauucagccuauauucuuggaacacagcugugagcugggugcugucccagcugguggugacacaaagaugugugagacauugucccaguucucaaaaugccccugcucuuaggcagucagauagcucaguggcuacaguacagugauaagaaaaauacacauauuuauguguguguauauaugauauuguaggagggguagcacuuccacccucuuagggugucuggcugggccugagaacuaaauggacauaagacagguuaacaggagaaagcauacagauuuuuacauuuuaaugcccagcagagaagccauuuaauucaugccuacuuagcacauuaauaaaaaaacacaucacuuuggagaguaacuugggacuacugggaaugggauuucacguauauuaugaugaauuugaagcaucagugucaugucugacauuggaguucccauaggaaaaggaagauccaaagaagcagguggaacugaaugcuuauauaugaaguuggacaaaaaguaaauugugaaaacgugaccagacaaaggagcaugggcuagggcaguuaguuguggagaagugacuaggaagauaaggauucguucagcaagguuuguuuauggagguuucccucagccuugccuccccgucccugguguuaggaauguuucuuuccuccugguauaaggagggcauccuucacaugggaguuuaucuccugcuuucaggaugaaaaaggaaggucggagcccucuucuugcaugugaugguuuucaagugucuuuaacucaaaauaauccuaugccuaaggagcauauuuugggauagcguauucugcccccuuuaucaaguaugacggcagcagagguaaagaaacauaauucaggcugagaagucagggaaagcucugguuagggaauggcacuggagcuguaccuugaugaguuaacaguuucguacagccaggaccuggaugggccaagacacuguugaaagggccugguuuccaucguuuaugggcaugucacguggcuucgugaaacuugaagacagagaacaugaggcugugacugggaaggccagagccuucaagggccucacacauuguacugaggugucugggacuuauuuucugggugguggggagucauucauuaagguuccuaagcagaauaaugucuuaaguugcacuuagauaacuuuauuggcauugcaaaauguagauugaauagaggaggggucgggggauccgcuggaaagcuucugggaaauugucacucuguggauggcauugugaugaucucauuuaguaaucagaaguaaccuuuugaauagaggacauaaaggagaaauugauuagaaauauauagcaaauagagguugaaucauugacauuuauacuguuguccuuguuuuugcagaugaggacgcugacucuuagaaagaaaaaguaauuugcuuaaggucacacagcagggaacuggugugcccagguucuggauacagagccuguguccuuauuaacccuuauuagcuuuccaguacucuccuaaaagaaaaaugggaaaggauggagaggacaguuccucccuaauccagcagaguuuuaaggcacacagacugaucagauuccacaugggaggaaggcugggaaggaucauuuacaggcagagcuucaauuuuaagcuggaauuugaaaggagcaagaaauuuuacuuggucggaaagugggugaaaauacucugaugggaagagaggucagagugauaggagaggagagguuugaggcagucagaccugggauugagcuugggaacccaguguccucauguaggccucauaacggguuguuguaaaaauuaagcgaggugaagaaccugaagccugguagguggccagaaagugucaggccuuuugcaggugguuugcuuuugugguguucugacucucagcugaaacaggagcuugauagcagugauaauaacucuuacuuuuuucuucuucuucuucuucuuucuuccuuucuuuuuuuuuuugagacaaguucucgcuuuguucuccaggcuggagugcaguggugugaucauggcucacugcagccgcaaccuccugggcucaggcuauccuccaaccccagccucuccgguagcugggaauacagaugcaugccaccacaccuggccaauuuuuguauuuuuguagagaugggauuucacuauguuguccaggcuggucuugaacuccuggucuaacugccucagccucccaaagugcugggauuacaggugugagccacugcgucuggccuacuuauuuucuucuuuuugagccuuggcgucagacacuauuaacaucugaacacucaucuugagacuaguccacauauaugaugaccuuacgugugaaugggaggcucagguuucaacauaauaaaaggcacauuugccaggcgcgguggcucacgccuguaaucccagcacuuugggaggccgagacgggcagaucacaaggucaggagaucgagaccauccuggcuaacaccgugaaacccugucucuacuaaaaauacaaaaaauuagcugggcgcgguggcaggugccuguagucccagcuacucgggaggcugaggcaggagaauggugugaacccaggaggcggagcuugcagugagcugagauagcgccacugcacuccagccugggcgauagagcgagauucugucucaaaaaauaaaaaauaaaaaaauaaaaaauaaaaggcacacuguaacaaugcauguucuuggugauaucguaggcaaaauugcuuuuuaguaaucuuuagucuuagaacauagcuaccacccaugugugaugcuauuccagugggaaagugcaacccucuuuacagaccaguuuaaaaccagcauuugacacagcauuguugacugacugguuuugcugcccccagggucuguguguagcagacacugugguuguuaucacagugcacacuaaggagcagccaagccagagucauuuuuuccugggugaucacggccacauucauagaccaggaccaugugaauuugauuuuuuuuuuuuuuuuuugagacagaguuucgcucugucacuaggcuggagugcaguggccugaucuuggcucacugcaaccuccaucuuccggguucaagcgauucuccugccucagccucccgaguagcugggacuaugcgaacgcaccaccacgccuggcuaauuuuuguauuuuuaguacagacgggguuucaccauguuggccaggauugucucgaucucuugaccuugugauccgcccgccucagccucccaaagugcugggguuacaggugugagccaccacacccggccagugauuuugauuuuugcaucuuuuaaauauuuuauccuuuaaaaauaauugaauugcccugacacaaccagaagaaauuagaugcugccuacaggaaguauuuuaauuuugugaacuugcuuugcagaacacuugcugaaauggcagcagccacauccguccaugugguugcagugauugaacccaucauucagcaugccgacugguucuucccugaagguaauucucacuucaguuucauugaccgccaaagcaaugugauaaucguacaaaaagucuucuuaagagaauacaucuguaauccuucuucaugauuacguaauugguuucacuuuuucauguuucuuuccagccuuuguucauugcauuuguauuuugacaugaugguaaucauauuguauuguauuucacuuaguuucacuaaaacauagccagucaguguauguugaauacccacugggugccauauguuugcuggugaaacaugccgucuuaccugggggaacuccggccacuggagaagauggccacaugaacagauaaauuauaacacaaggcacauuagaagauagguggauggagaaagauuugacaaacucaagugcugggaaaagggaaccagggauugguuuuuagaagaggcgauguugaauaugcuggaguuuuucacuuggaagagggcuuguuucucuagcuagauuauggauuugcccauagauaggagauaaagcaggaaagguugaucggggccagcuggugaaggccugaguuggcugugucagggaauuaguauuucauccugcuggcaauagauuuucaaacuagguuuguugcaguucugggauccacagagguucccauggcccccuuuggggaugcuggccaggcaaguguuggaauuccggaucccccacaccuacuucccccagagcaacccugcugccaugucccguggggugcaagccccaugauacccaucuuucccucaccacugagcccaucuuuucuuuaccacuguuuugucaccaucaggaaucacgccucauucauauagguugcccagugaggaugggauggaugagcgaaugcuagcauucugcucaagguuuccuuugaggaaaugauucuugcaaaaacugcuaaaggcaguaugaacuugauguugccuuuuauuucuauuuuauauuaaaguguaaauaucucucuuuuuuuuuuuuuuuuugagacagagucuugcucugucgcccaggcugaagugcaguggcgcgaucucggcccacugcaaccucugccucccagguucaagcgauucuccugccucagccuccugaguagcugggaauacaggcauacaucaccaugcccagcuaauuuuuuguauuuuuaguagagacgggguuucacguucuuggccaggcuggucuugaacuccugaccucaagugauccgccugccuuggccucccaaagugcugagauugcaggcaugagccaccacacccagcuaaaugucucuuuuugaaugauucaaauaagugaucugugcucaucguccucuucuacauucuagauuuguuuuuauuuauuuuuuuuccacaaaagagaaagcacaaaaguguguaacuuauauucugacccauacuucuuccccugucuuguccucuuaacauuacuucccacugguuugauggaccauucuugcgaugugagugccuggagcuuccacuuugaaauagugagggcuguggacugaagaacgagguucccguuccaaugaggggugucuuagagcucccucgccugcugugcucagugucucaugcacuuguuuauuuuuccucuugcagagguggaauuuaauguaucagaagcauuuguaccucucaccaccccgaguucuaaucacucauuccacacuggaaacgacucugacucggggacccuggagaggaagcggccugcuagcauggcggugauggaaggagacuuggugaagaaggaaagguaugauuugaccguucacuuccaaaccagcaguaaauauguuguuagacccgugguaucugguaucgcucaguggacuugggauuugagaguggucgccauccacccaugacugaugguguccagauaguuucuggaauucugcuguaggucauuccaagcacuaaucucaccauaaagucaguguguagcuucucaguuaacguuucuuccacguguauuccagcuuaacuugguggugugcuugguaagcccugcaguggaacggcaucauacacauguuaaaagugacccagauguacgugaguggggggaaacagaaaggaaaauaaauucaauaguguggacuuuuguccagaauugagugugagaacacccaccuggcacagugaguugagugauuuggcguuuaaggagacauauuucugguauaauguggccccacaauggaagccaaccacugaauuugauguucagugggaaaaaccucaguauuugccaauucuagaagaaaaaaaaauggcaguguugaacuuagugagaagcagugugucucuauauacucuuuucuaugggcaauucaugggauuuucaagggugauuaagacuguuuguaauuugugccuuuggaugccaaccugucccaugugugugaugaaaugccacuguacucacuaggaaugcuaacaguuaagaggccuguuggaaguaauaugcuuuucuugguauauuaaauaauacuacuagaaauaguuuuacauuaaaacgaagugacaagcucuuauuuuaauugcucagucuuauagugaggugugcuguuuguuucuuguucuuuguauugcauuuuuuaccccuagcaaaggagaaugcauuauucugucccuauucuguccuuccaaaauccacauuuauucuaugcagacguauuaccucucugaacccucauucauacauucaguaguauuuccugaugacagacucuaccuguaacaaaauuagcuuucauauauuuuaaguuacagaauacagugcaugagucuaguuagcacgugacagacaauucucaguuaccugccuuguguauucucccugccagcugacccaguaagcacgagcucaagaagccagguaucuuuuuacuuuuugaacugaaagaaaaaguuguuaaguucauagaucagucgccuuaagugaaaagucagccuuccuuccacccucuccagccacauccagccaccauucccuuccccaaagcaacggcuuuuuccagucuuuuugguuuuuguuuuuuugagacaggguuaugugcccaggcuagagugcagugguaugaucauggcucacagcagccuugaccuccugggcucaggcagcccucccaccucacacaccugacuagcugggacuauaggcacgcaccaccucacgcagcuaauuuucuaaaaaaauaguuuuuuguagagacagggccucacgauguuucccaagcuggucuugaauuuccaagcuaaagcgauccucccaccuuguccucccaaagugcuaagauuacaggugugagcuaccaugcccagcuuuuccagccuuauguaccuuucacauguagucugcauaugcacauaggauuguuucuacaucucaucucaguuaagaggcaguguggugugauaaccuuacacugccauugguaggccuucuggacuugacuucugugucauuccccaaaaacagauuugagaugggaacuaggaaguauggaaauaggccggauguggugacuuaugccuguaaucccagcacuuugagagaccaaggcaggaggaauacuugaggccaggaguuugacaucagccugggcaauguagugagaccgcaucucuacaaaaaaaaauuuuuuuuuaguaucccaguauggugaugugugccaguaguccaagcugcuccagaggcugaggcuggaggauuguuugagcccaggaguuuggcacuguagugagcuaugauugcuccacuggagugccaagcacuccagccugggugguggagugagaccacaugucuaaagggggaaaaaaacagcagaggaaguauggggauaaacacacuaacaugaugucauucaagaugaggccugccuauuugcuuuuagcugcucacacccaaauugaucaaagacauugaacaguaccagguucauuggcuuugcucaggcuugaagccgaguggaguugcucagggguggccauuagucugguccuugccgcuucacugcaugccgggcagcuuggguggcuauccccaugugugguuuuaacacauguggaccgaugggcuucugucucaguagucugcucgcaugguguguugacuguuucuucucucuguguagcuuuggugugaagcuuauggacuuccaggcccaccggcgggguggcacucuaaauagaaagcacauaucccccgcuuuccagccgccacuuccgcccacagauggcagcaccguggugcccgcuggcccagagcccccuccccagagcucuagggcugaaagcagcucugggggugggacuguccccucuuccgcgggcauacuggagcaggggccgagcccaggcgacggcagguaaggaggcugacuucugcuggcaguggaggcuggacgccccagccuucuugcaggugguggccuuugagcacggcauccaugcccaaagaacugcuccagcauggagugaacagauuuacuuucacuccucugguuggcaaaagauggaaaaaaagacuaugaauggcucgcuucuuuuuauguuuuccaaagaaagcaacauugguuugcauucuuugccacacugcuuuggugcuggaaaccggaagccaguggaugucucauagugugaugagccucugucaccuguuggauguauacugucagcauucauguaccuucuguucauugucauccagugugcuaaccaggaagcauuugaguguggcaaguuaguuaaauuuucguauuccuggcauuuauucacccauucguugauugauucagugaaacagauuuacugagucacugauaugugcuaggcacaugaggugacuaagacuccacuccacacccccagauuucagucuuguagggcaguugauccaugaguccaagguggaaaauaagaugguagcuuuucuuuuuucuuuuuuuuuuuuuuuuuucugagacugcgucuugcucuguugcccaggcuggagugcaguggcauaaucguagcucacugcacccuccgccuccuaggcccaagcaauccuccuaccuaagccucccaaguagcugggauuacaggugcuugucaccaugcccagcuaauuuuuuuauuuuuguaaagaugggguaaacauagaugcccuagguugcccaggcugaucucgaacuccuggccucaagugaucuuccugccucagccuuccaaaaugcugggauuacaggcaugagccaccaugccuagcugguagauuuucuuaaaaggcucuuuuaguugcuuaaccuuuggauaagccaccuggagugggcugcaaauggauagcaacuuuuaagaaaagucaccuugaacuugagguuuuuuuuuuugagacagucccacucugucgccuaggcuggagugcaguggugcaaucucgguucacugcaaccuccgucucccggguucaagugauucucuugccucagccuccggaguagcugggauuacaggcacacaccaccaugccaggcuaauuuuuuuguauuuuuaguaaagacaggguuucgccauguuggucaggcuggucucaaacuccugaccucaggugaucccccugccuuggccucccaaaggcuggcauuacaggugugagccaccgcgcccagccauaacuugagauuuuuauuuaauugacauuaauucaguucuccacacugauccaggcagaugaccaccagaggcuacuucagguggcaucucuugugguuuggaacugacagcugcuuagcuuugcauacaugugugccaaaauuuuuguugucauauguucugcauuggccauccacaacacaccgaaugaucauauaugaaguaaaauaaaugugcacaaaacaaggacaggcuguuuauccacacguuuauuucccacacagagagaugaauuugccuugaaagaacuccuuucucaucguccuugggaugagcaagggagagccuuguugugugugaagcugcucgugagauaggaaucuuguuucaccauuaaaacugaaugcugaaugcuuugugcauuccugaauuccauuuucuucaccuugggaaaguuuacuuugggguuaaaaaaaauuaagacuucagacuucuuagggcuucccgugcaccucauaggcugcacguuagcuugucaauaauugugcccuaugcauguacuuguuuugguuuaaauuuuuuuguuugaaggaaaaaagucuaagcaaauucacuuauuuucuuuuucuugguuuuguuuuuuauuuuuauuuauuuuuauuuauuaauuuauuuuuugagacgaagucucgcucuguugcccaggcuggagugcaguggugcaauguuggcucacugcaaccucugccuccuggguucaaaugauucuccugccucagccgccggaguagcugggauuacaggcauggaccaccaugccuggcuaauuuuuguauuuucaguagagaugggguuucaccauguuugccaggcuggucgcgauguccugaccucaagugauccaccugccuuggccucccaaagugcugggauuacaggcgugagcuacugccccggccuguuuuuuguuguuuuuuuuuuuucagacagggucuugcucugucacccacgcuggagggcaguggugugaucauggcucacuacagccuuuuaaucucccaggcucaagcgaucuucccaccucagccucccaacugggacuauaguagugcauccccaugcccagcuaauuuuuuuaaauuuuuguagagacgaggucucacuguguugcccaggcuggucuucaauccuggucucaagcaguccucccucccuaaccucccaaagugcugggauuacaggcaugagccaccaugcccagccaauuuacauauuuucauuuccuugugacauuccauuuguuuaaucaaggcuaaauguauuauuuaagacaauaauuagucuuaaugcagaaggacaaauggaaugucaguuacuuugcuuuuuuuuuuuuugagacagcaucucgcucugucagccaggcuggagugcaguggcaugaucuugacucacggcaaccuccaccuccuggguucaagcgauucucccaccucagccuccagaguagcugggacuacaggcaugcgccaccacgccuggcuaauauuuguauuuuuaguagagacgggguuucaccuuguuggccaggcuggucuugaacuccugaccucaagugauccaugugccucagccucccaaagugcuggcguuacaggcgugagucacugugccuggccugcuguuuguuuuuuauacuguauucuguagguauuuuuauguacauuacacuaauguuauucacucuuuggugaccuugacaaaauggagcuacagaguuugguauaaaaaguucugggccaggaaacaggaagccugaauucugaucucuauccugcugcuaccaacucuggacuucgaguagucauuuagccucugaguucuccuucuucaguccaaguuauugauaauaaucaagcccuuuaucauuuagggucuuauuuugccauggcuuuugcuuaguuuuguacaguguauaugucaacauguaaaagccauuucaugguauuaaguacugcccaauuuaaguccaaacgcaguagaacugaaaacuccgcauugguugcuuugaaauggucucucugaugauacuggaguggcagagucguuggaguccagucugaugcaacgaaucucauaaaauaaauaguccuauagucccggcuacucagggugcugaggcaggagaggauugcuugaguccagaaauuugagaccaaccugggcaacauagcaagaccucaucucuuaaaaaaaaaauggcaccaaguaaacauuagcucuuuauauggcaccaaguaaacauuagcuuuauaagcccagugugagcuaguuagaauuucagauccuuuuccugccugccgaagugaaaacucugcuuggaaucuuauguuuuaugugcaguauguucagauuuucuagcugggauugucugacgucuaacuugacuuuuacuccucuuaguccucccaaaccgaaggacccuguaucugcagcugugccagcaccagggagaaacaacagucagauagcaucuggccaaaaucagccccaggcagcugcuggcucccaccagcucuccaugggccaaccucacaaugcugcagggcccagcccgcauacacugcgccgagguaagcagccaccguccuccuugcccucagggaagccugugcagaccuccuuaaguuagugcaaggauucagauggugagguuuguggccagaucuuuucuaugucuguuguaaaaucccaagcagaaaauucagucauucaagagaaaagucauuaaagaaaaaggaaaaaauagagaacagaaaagcagacauuuaguuuuuccuuaggcgugacaaagcuuaacaaacagucaguucugcagaaaugcucccaguuuuccuggugucccaagcccucgcucuguuuggagacuaccacagccucuguacuucucagcuuugugggucugggaggcacuuuugcuucggaauuggggugaaggcuuucuagguccugauuaacagaaucugaacugcucccaccugucuucccugcaguccuccacccagcagccaggggaauugcuuuaaaacuccaagcagaucaugucgucucuugguuaaacucuucaguggcuuccaugcgaacuucucacccuggguucucugugcuuugguggggccuaccucugagcccagagcuuacacucccuccucucaacacacuccacucuugguuccuugaaugaacuaaguucauccccuccuuagggcuuccagaacauucugucccauaucuucacaugguuucuucuuaccauucaggucucaccucaaaaaucacuucuuccagcugggcgugguggcucacaccuauaaucccagcacuuugggaggcugaggcaggaagaucgcuugaggccaggaguuggagaccaaucuggucaacauagugagagcccaccucuacaaaaaaaauuuuaaaaauuaucuggguguggugacacacaccuauagucccagcuacucaggaggcugaggcaggaggaucacuugagcccaggaggucgagccugcagugagcuaugauugcaccaccgcacuccagccuggacaacagagugagaccccaucucuaaaauaaaaaagagaggccaggcgcaguggcucacaccaguaaucccagcacuuugggaggccgggguggguggaucacuugagccaggaguucaagccuggccaacauggugaaaccccaucucuacuaaaaauacaaaaauuagccgggcauggugcuugcacgccuguggucccagcuacucaagaggcugaggcaggagaauugcuugaaccugggaggcagagguugcagugagccaagauugugccacugcaccccagccuggccaacagagcaagacucugucccgaaaaaagaaaaaaaaauggauuaaauucacugugucugucuauagaagcauggucuuuacaaagcacuacacaaauguuaguggaauuucuacaaaucauaggcagggaggcaaauccgaguccacugcuugguugcagacccccacuuuauucuucuucaggcugccucucugggcccugucaucuuaucaggaucucagcugauccuugagggaaguuagucuucuggaccuagauuccaggugugacucugguuuuggauuaagaagacucuuuuccuuauagccgcauucagagucuuucaugcuucccgaaaucacagcucccaggcuucuucgcaggauggguuugauucuuuuuuccuuccccacccccugcgccucugagguggucucagacaaggccuccauuucucccagcccccucccccugacacuuugcucccacgcucccucuccccauccucuucacacccuuaaauuucaggaacgagcuuuuauucaguaugacuuuacaauuaguauugcuuagaacagaaaacuagacuuuuuuuuuaaaugccgauggcagucuggaguacagcuaauguaagcugguuggugguuucugaguuccaggguugaaaguuccagaccaguguagcagaguagacuuuacccuuuuuucuuuuuuuuuuuccuuucuuauguuuuuuagaggcagggucucguuuucucacccaugcuggaaugcaguggcgugauaauagcucacugcauccuccagccacuggacucaagugauccucccacuuuggccucucaaagugcugguacuacaggcacaugccaccaugccuggcugcuuuauuuuuuuguagagucggggucucacuguguugcccaggcuggucuugagugaucuuccugccucagccagucagagugcugggaauacaggcaugagccaccgagacuuuacccuuuucaauccugaauucugggcccuguaaacaggcagccggggaauaggggaaggaggaagaggaaaaagcauucagggaguccacaugucaugggcaggagucucaguucugccccuuacuagcugugugaccuauuaccaaacacuggcccucuucaagccucaguuuucuucucugugaaaauggggauaacagagcuugcccugcaaugagcuuaugaaacuugaaugagauaauuuauauaaauuauaaugugcauaauuuauauaaaaggccuuacuugguacuggugauaagagugauacauguucauuucuuuccuucauuuccuucuccuucuuucuuagagaaccaguaggaucuuagcagaguuugaaaaaggcuaaaaucucuccuuucccccuaccccucccagcccaaaaccagagccccagaucuguuguuuucccuccugcccucaucagucccagguuccuaucccugaucucagcugguguagggaggagagugaugugauucagcucucuuuagagaaauaauucuaaggcaacucuuccagauuuauucaugcuuuuguccaggacauaucuauuaacucaaaugguugcggaauugguagaaauucuguuauuaagaccaaucaaaccaaucaaacucucaaggagaagguggcuugggaucaggggucauguuauaucagggugaacuagucaugcuugguggucccuccuggcuguucugccucuuucugcgucuucccauggggcccuaaugaggaggcugcuaagugggcugagggcagcacuuccgugucauugggguggccucuguuaacaguuuucuucuuauugaacuuucaaaacgauaggccuuuaaagcccuuucaaaugugcauaauguacuuaauuuuuaaaauaaacuuguuuguuuggaguaauuuugaauuuauagaaaaguugcaaagauaaugcugagaguucccauaugccccuuacucaguuuccccuguuguuaauguguuacaugaccauggcacauuuaccccagcucagaagucaacauugggcuaguccccccaucccccccaacuuuuuuuuuuuuuuugaaauggucucacucuguugcccaggcuggaauucaguggugugaucacugcagccuuggacuucccaggcucaugggauccucccaccucagccucaugaguagcugggauuacaggcgcaugccaccacgcccggcuaauuuuuguaguuuuuuguagagaugggguuuugccacguugcucaggcuggccuugaacuccugcacucaagugauccgccugcuuuggccucccaaagugcugagaucacaggcgugagccacugcaccuugcgguucauuaccauuaacuagacuccacauuuuguucagauuucccuaguuuuuccacucauguccauuuucugucccaggaucucauccaggagcccacauuauauguagucaucguaucuucuucgucuccugcugucugugacauguucuccgucuuucugugcuuuucuauggccuugaugguuuuggagaguacuggucaggcauuuugaagaaaggccuucaauuuguguuugucagauguucuucugauggguuaugggcuuuggggaggaagacacaguguggugcccuccugaccaccucucaucagagguacaugaugcugguguaccuuauuacuggugauguuaaauuugggcuccuggccaggguugguugcugccucacuguuccuacugaaagguguuuuuucucuuuuugugcagcuguuaaaaaacccgcuccagcacccccgaaaccgggcaacccaccuccuggccaccccgggggccagaguucuucaggaacaucucagcauccacccagucugucaccaaagccacccacccgaagccccucuccucccacccagcacacgggccagccuccaggccagcccuccgcccccucccagcucucagcaccccggagguacuccagcagcuugucuccaauccaagcucccaaucacccaccgccgcagcccccuacgcaggccacgccacugaugcacaccaaacccaauagccagggcccucccaaccccauggcauugcccagugagcauggacuugagcagccaucucacaccccuccccagacuccaacgccccccaguacuccgccccuaggaaaacagaaccccagucugccagcuccucagacccuggcaggggguaacccugaaacugcacagccacaugcuggaaccuuaccgagaccgagaccaguaccaaagccaaggaaccggcccagcgugcccccacccccccaaccuccugguguccacucagcuggggacagcagccucaccaacacagcaccaacagcuuccaagauaguaacagguaaguaggacaucaaugcccguauuuccucgucugcucuacauugcuuuuguacuacuacauuuuauuuaagcuuugauuuaugccaggugucagcaaacuacacccgcaagccaaaccaaaccuguccugcagccaguuuuugucauuaaaguuuuauuggaacacagcuacacccauuuguuaacauauugucuguggcugcauuggugcugaaacagcagagcuggguagucgugaccaaagauccuguggcccacaaaguuggaaacauuuacugccugguccuuuaaguuugccgaccccugacuuauaguugcuuguguguuuaagaccuauguacguuuacauuuuucucaacauaauggcuuuuauuccagguggaagguauuuuacaacacgagcaugaacuuuauuucuuagugaauuccucauuaaaaugcuuaaacaguacuucuaagaguaaaaguguucauauuaaguacagaauuucagguauaacuuuaaaaaacaugauuuaugccaaauugaaugcuccagaagggagaucucagggcacugucauguucuaauggcuugggagggaagaaucaagauuuuccuguagacccagugggaaccuguuuggaagugguggugauuguacagguuuuagugggcuaccuaauggcauauuuuuaauagucuagaacaugaccauuuuauuuaacauuucaagaauauuuccaucccaaaugcucuaauuuauuauuuaauuuaaggaugaauauggggguuucuaguguguuuuuaaaaaugguaauuaggggccucaaauaauuucuuacagcagccuaguuuaaauuguucuaaguggaggcacuuucggaaaagaagcugaaauacaccucugggcuuuccaaccauauugagugacuuugcagcuaaaaaugugccaagguuuccauuaacccaaagggugacgguuaacugauucuaacagcuuuugauaacuuuuuucaggaauauaauacauaauuugcacauguuauaaaugguuaauaacuuuuuuucugaugccaucagagcuuuuauuuugaaaacaacaaagccauguugguuuguuuguuuuguuucccaauagaugcccuuccuagugcccucacagguggggaagguuuccaggacuaaggucuguaauggccccgagcagcuugccccauagcucgccccacagcuccaaaugcuccugcuuagccguguuuugcauaugugcuuuugaccaugugcucaggagcagccguuugaccgugugcccugacagccaauaggccauccauucuguagcauauugacauuucuuuauuuuuaucagaagcacuuugagcugcagugcuucaaauucgaggaguagaugucaguagaucaagagccugauuucaagcugcucuugaagaguaucuucuuucuuaggggccaagcacaguggcucgugccucuaaucccaguacuuugaguggcugaggcaagaggauugcuugagcucaggaguucgagacugcaguggguagugauugugucacugcacacugcaguccagccugcaugacagagugagacccugccucuuuuuaaaaaaaaaaaaaaaaaggaauaucuucuaucuuuuuggugagccucuuagcagcagucuacucuucccagugugauuuaccugucacugaugggcucaccagcauccaaccaaagaggacccaggugcagucagcacgggaggaaauuguguccuuugugucuugagcuuuaauuuuaaauuuuuguauuuuaagugcaaguuaacugcauggagcuucuuaauuugauauuuuaaauucucaagaccaaaaaauuaaaaaaaaucuuccgccaaauacccuacacugaauuauuuuaaauuccuuugcauccuagcaugcuuacguuuugcuuuauuaaaccauaugagcuuuuuaaaaggcacugugagcucaucuaagucugccgcugggucuacauguggacagcauaaggcccucaucauauguacagcugcuuuaaucagcuggccugagccuuaggccuacugugggccccuuagccagagugcucacagcuuaggucugaguaagacuuucuguaggaaccguaaguggaaaaccagaguguagccuucaaaacagggaggaggcccgggugcgauuccacaauuucaugcuugugacacaccaaaauguuauuaucagauauuuccuuuuauuuaaaugaaagauugcaaaccagaauuaugccuauuuuuuaauaccauuguuacccgggguguauuuauuccacaaguuuaguuuacugaucugcuacaacacuguaauauacugccuguaauuauuagauaagugaaauuuuacauuaaaaauguguuucccgaagauacuagcuauuuaaaaaccggucuaugcuaugaauucuccuaacucaagaaauuccagguuaccagaguuaucuuuguauuacagaauuaaccuguacuaucuuaaaauccccuggccucccacugaaaguacacagaaggccaacauuuagaauuuuuuaaucugcuaguauugaucauacugcuauuaaccauucuuggauguagccauuggguuuuucaaggaggaaaaaauauauaacuuccuuggacaggaugguccuuuauuaugacauaauguuuucacuuagaaaacuuuagauggacaaauuccugaaaacagguuauuccuuuagaauuggauuaaguuagaguuuuaaagaguuggguuaaggcuaaugggauuaagauaaacucuuggggggagauuauugcugccaagcagguuuggcagccaacuucucacagcucagcaccagcacuggaggaugccggcauucuggcaucauuuugagucuccuguuaauugugacucuagagagcaguaagaguuuuaauucccauguaaaagaguuuacaucuugcuauuuuugaaguaauagauuuuagcaaagaguauucuaauuuaaacauuuuauuaaauaauuuagauguaugaccugccauauucaguaagaacugagauuggaauauuuaaugguaaggaaaaggcaccugauuggccaaugcauuuuugcuacuugaugaucauauuugugcacucaugccuguuacuaacuggccacccuaacccugccugcuugcaucccuacuaauagugcaugcacugaaggaggacuggcuuuguugaugcuugcugcaaugauucggaauacuaaguguguacccagauguggaacagguggucacagggcuguccuuguuacuucuuuaauuuccauucuuuuccauaucaggcaagcuugagguauaguaggaagaacacacauuauggagucagaccugacugaguuagaauuucagcucuugguauaacauaggcuaggcacaaccuggcugaucuguaaaguggugacaucugucuaaauuguugaagaugaaauaagagaaaguccaagauuauucuguuagccaguuacaguucuuaauauacgcgcaaucucggcucacugcaagcuccgccucccagguucaagcaauucuccugccucagccuccugaguaccugggauuauaggcgccugccaccacaucuggcuauuuuuuuuauuuuuaguagagacggggcuucaccauguuggccaggcuggucucgaacuccugaccuuaggugauccggccuccucagccucccaaagugcugggauuauaggugugagccauugugccuggccugcuauuuaucauuuuuaucuagaagaaaauaguuuuaaucagauuucuauguuagauucacauaucaggguuuuaaaaacucauacgcccggacccggccuucuaggacccaaacacaggagacuggggguggaacccagguauccauauuuugauucugaugcaccacuugguuuuuugaaucucacuucuuucauggguuaaaaagacaaugcucugcagaaggagauaacauauacauucauauaauuuagugagccugagacugucugugaggcguuaguccacuguaccacagauagaccaaaucacucacaaaguagccauaagccuggacacuuugcuggcuaauuucauaguguuugcuuuuuaaacucucacccuucuuaugucauguaaguaaugccuuuuuaaaaauaagcaugagcuggggcacgguggcucacgccuguaaucccagcacuuugggaggcugaggcggguggaucacuugaggucaggaguucaagaccagccuggccaacauggggaaaccccaucucuacugaaaauacaaaaaguuagcugggugucguggugggugccuguaaucccagcuacuugggaggccaaggcaggagaacugcuugaacccaggagguggaggucgcagugagcugagaucgugccacuacacuccagccugggugacagagugagacucugucucaaauaaauaaaaauaagcauggauauuaaaacucuugagaaauggaaauaauaagaaaucaacuguagcuauacaauugaaaaagucugccauuuauauucuacuuuuuuucuuuucuccucuucucuucucuucucuucucuuuucuuuucuuuucuuuuuuuuuuuucagacggagucucacucuguuccccaggcuggagugcaguggcacgaucuuggcucacugcaagcuccgccuccuggguucacaccauucuucugccucagccucccgaguagcugggacuacaggcgcccaccaccacgcccagcuaauuuuuuguauuuuuaguagagacaggguuucaccauguuagccaagauggucucgaucugcugaccuugugaucugcccgucucggccucccaaagugcugggauuacaggcgugagccaccacacccgccccuuuuuuucuuuuaguuuuucuagaaggcaaggagguacaugagcauaauuauuugacauagacagauuuggauccuuuuauuucacuuuacaucauaugcucguucucaugugauaauguaauuuuuagaaccauguuuuucagugacuacauaauguuucaucaaccagauguauuauuacuccuaguuggauauuuaaguggcuucuguuucuacuugcaguuuauuuuuaauaaguagauaaucagaauugugucaagauaacauccagugagacuugaacagaaucacuccugaauaguugacucagagucucuaauagcccuagaaaacugacgagaaaucaucaguuccugauaaaauuacacaauucuacuucaaccaaagaggaucaaagccagauugguuggacugucauucuucuguuuauuuauuuuguguauuuuuugagacagagucuugcucugucacccaggcuggagugcaguggugcaaucuuggcacacggcaaccccugccuuccugguuuaagcaguucucuugccucagccucccaaguagcugggauuauaggcagguguggcaacaccuggcugauuuuuguauuuuuaguagagacaggguuuugccauauuggccaggcuggucuccaacucaugacuucaagugauccacucacuucugccucccaaagugcuaggauuacaggcaugagccaccgcaccuggccccaucauucuuaaucacccuaacauuuucccucuuucccaaaagaguuguguauauccuugggugaggauccugaaagugaagacauuaucugaggaaauaaugguuugggucuuaaacacucugguuagagcuaaguuuauaugacagguauuacauuguaaaaaggagaaaaagguuauuuuagaaagacaccuguuagaaccugcuuuuuuuuuuauuuuuuuuuauuuuugagacugagucuuaccccguugcucagaauggaaugcaguggugcgaucucagcucacugugaccuccaccucccagguucaagcgauucuccugccucagccuccugaguagcugggauuacaggcacucacuaccgugcucggcuaauuuuuguauuuuuaguauagacgggguuucaccauguuggccaggcuggucuugaacuccugaccucaggugaucugccugccucggccucccaaagugcugggauuacaggcaugagcuaccacacccagccagaaccugcuuucuaaaagcacccuaaaccucuuugguugugaauuuauauauucucugccuuccaagggcuggucuuugaggauauugcuuggaacuaaguucauacaguagauauuuuauuuaaaaaaaaaaaaaacagaaaagagaccuccaauaaaagguuucuuuuuugucugauuuuuugcuuuuuuuuaauuuugaaauauaauacuugucauauaaacuuagcuccaagcaguaugcucaaagaccagcccuucuuggaaugcaaauaauauauaaauucauagccagagacguuuagagguguuuaaagaaaaccagguucuuacaagugucuuucuaaaauaaccuuuaucucuuuuuuacaacaaucaaccagaguguuuaagacucaaaccguucacuggugaaggaaggcauucccugagacucuaggucugagaagagggaugggugguggagagggggagggaguuuauucgcccugcaguugugccugcaccacuuacuuucaagggcauauuuggaucuguuacuugucaaaguggcuaucagaaucaccuuggacuucuugaagggugaguucacaaccgagaaagcacauauucaaaauuguugaaguaauaaguaaaucuucuagaaccuuacccucagugauaacauuccacuucuagcucuuaaauacccacuucuguuuccuggaugagauacucagugcaggaaggaaccuggguuacauuugucagagccccaaaucugagaugaacuguaucaaguucugccuuugggcugaggcugguuacuggaggucauccucuguuucucucuuuuuuuuuuuuuuuuuuuuuaaaaaaaagagagacagggucuugcucuguugcccaggcuagagugcagcggugugauuccaguccacugcagccuugaccuccugggcucaagcgaaucucccaaguagcuggaagguggaacuagaggcaugcaccaccacacccggcuaauuuuuguguuuuucuuauagagacggagucucauguugccugggcuggucucgaacuucugggcucacaccaucaucccaccacgcccagccuauuuuguuuuuuuaaauacaauaucuuuuguaugaacuuagcuccaagcauaugcucagaaaccagcccuucuuggagugcaguuaauauacgaguucauagccagaaagauuuagagguguuucagacaaaccagguucuuacaggugucuuucugaaauaaccauuuucuccuuuuuacaacaaaccagaguguuuguaagacugaaacaaugaucuuggauaaugucuuugaaggcccucacccagggauuuacagacuccucuggggaggagggaaaauguaaugcgaagagccagagugcaaccaaucuggcuuugauccucuuugguccacacuggcugugucaccuugggcaaggaauagagccucugagucucccuuucuuauuucugcugccuuaggauuaguuaguggggguucagugagacgauguaauaaaguguggguguauaguacagucucugguguaaguaagugcucuauaguaaugucagcuacugaggcugggugugguggcucaugcugguaaucccagcacuuuggggagccgaggugggaggauugcuugaggccaggaguucaagaccagcccagucaacauggugaaaccuugucucuaccaaaaauaaaaaaaauuagccaggcaugguggcguaugcuuguaguccuagcuacucgggaggcugaggugggaggaucaguugagcccaggagguggaggcugcagugagcugagauugcacgacugcacuccagccugggcaaaagagcaagaccccaucucaaaaaaaaaauuuuuuuuuuuaauguuagcuacugugaugaagucucuuucugaaaacugguucuguacagguugccguaauucuuucuacuuuuuguguguaaacaaagucauuguuucuuucagggacugauucauguaggaauagagaggggcuggggaaaccagauggggcaggugggcggcagaguaagggauuuccuuuaugccccaaaacacauuuuuuccccuugaauuaauaauguguguggaucauaaauagaaaaauucagagaggcacaaaucuaaaaauuauguauaugugauguauaagaaaaagagagcagcuguggaggggcuugguggcugauaggcguuagcuugcaugugaauacagauauuaacaaguagaaaucucauccguauacacagugccuuugcaucaugcauuccccgccaagucaugucgguuccauaguuucugguaaacucugggcugagaagagacacgggcugguagccccuucuguuuuugggggccaagauaauggggaaaggauugcauuugcagugauuuucuuauacgucgucuucaagucacagcuacuucuuugccugaggauguaagaauggaggauuggaaagaugguugcucuagaugacucuucaugcauccauccaaccauccaagugugcagcuacaaaauuucuugaacaucugcuauuugccggucacuguuuuagguacugaggauacacugugaacaagacagacacagucccugccuucguugacuucuguucugcuuaggacaaauccaagacagccccuauucugugcauacagaccaccuuuggcugcaccauaggcuggugcaguucugcacagugucauugguuuuauaguuaucacaagaccugaauugucugaaaugacauucagcaccugaacucuuugacacuuuggcaccuccauaaaucuagaaauuucucugaguuguggugcauaggaaaccuugagggacaacccaggaguaacugugagaaaaagggugucccagggaguaaauagaucucacagcucagaacuguagggacaggaagguggaagggguaggagcuggaacaagucuccaagcagugagcuuccccaaagugcaccagcguuuucaagcugugccugcguagacgggagcaggucgaacagaaauauagucaaaacuagcucccgucaaggacagacaggaugucauuuugcaccacagcaaguaggggaaagcagcucucaagccuaacugugaaacgcccccacaaaccaccuccuccucccacucccucacugcugccugccauggcuaccucuaacgcagcaaagcaaaacuacaaaacaucucucuucucucuuacaccagcccuaaaauaccuaaugaggcucucauaauuugccagaacccacaucuacgagagaagccagcccuuuugucuuaauuaggauccccuuggucugcccacuugaccgugggcuucauugaggcugugccugucuuguucagugcugcguccucagcagguagaauggugccuggcaccugggaggugcucaguaaauauuuguucaugcauaaaugaaucugagacccacuggccucugggaagagcauaggagagggggacaacagcaugaggaccauauguuugccaucuugcugaaggaauuucagccaacauaauaagacaugaaaauggcauucgagguguauuagacagacaaggggauguuaguguuugcaggagacuuggucugccucagugaugucagucagcagugauugugauuccccaggggacacucggcagcaucuggagacauuuuaguuuaaacuuccccagugaucugugauguacaggagacacuuucgguugucacacugggggaggaggcugcaugucacuggcaucuguugggugacaccuacaaugcacaggacaaccacaacaaauaauucaggcccaaauguugcuggugcugagggugagguccuaguguuaguaacaggaggaaaacccagcagucuggaggagagaccucuucccagggcagcccaggggccaucaggaggguucaucucaugcauuagaggucuugggaagaaugaggcuuccuuuccuccaucaaagcaagcaaauccuuuaaaagcugcaucuccaagggcugcuccgggcucauagcaagcaacgucggagcccagaggcaaggcugugcuacucagcugcccucuggggucacaaaggcuucacuuggcuucuaagagcugaugaggccucucgcaagggacccugugugcaugggcugacccugaaacuucccagccucucuucuucucagagcacccucagguggccucucggggguuaccccucauugauaccaugucuccucguguuuuuguccagacuccaauuccaggguuucagaaccgcaucgcagcaucuuuccugaaaugcacucagacucagccagcaaagacgugccuggccgcauccugcuggauauagacaaugauaccgagagcacugcccugugaagaaagcccuuucccagcccuccaccacuuccacccuggcgaguggagcaggggcaggcgaaccucuuucuuugcagaccgaacagugaaaagcuuucaguggaggacaaaggagggccucacugugcgggaccuggccuucugcacggcccaaggagaaccuggaggccaccacuaaagcugaaugaccugugucuugaagaaguuggcuuucuuuacaugggaaggaaaucaugccaaaaaaauccaaaacaaagaaguaccuggaguggagagaguauuccugcugaaacgcgcauaggaagcuuuugucccugcuguuaaugcgggcagcaccuacagcaacuuggaaugaguaagaagcagugcguuaacuaucuauuuaauaaaaugcgcucauuaugcaagucgccuacucucugcuaccuggacguucauucuuauguauuaggagggaggcugcgcuccuucagacuugcugcagaaucauuuuguaucauguauggucugugucuccccaguccccucagaaccaugcccauggauggugacugcuggcucugucaccucaucaaacuggaugugacccaugccgccucguuggauugucggaauguagacagaaauguacuguucuuuuuuuuuuuuuuaaacaauguaauugcuacuugauaaggaccgaacauuauucuaguuucauguuuaauuugaauuaaauauauucugugguuuauaugaaaacuucauaauucuuggagguaaauuguggagugugugugugugugugugcaugaguguguguguguugccacucaaccagauagaauuguggcugggacaucuugggggagagggucuaauuguagcuguaggaguuugaagaaacagagag

SEQ ID NO: 15390 - RNA, 20151 nt, Homo sapiens
ccgccaggacgccucgcgcgggccccgcggcgcucgguggcaggcggcgcaugcgugacugcgguucccagcgccccccgcgcucuccgcgggccgaguggacgaggccgaacgcgagcagccugccgcugcccccugcgagcccuggcuucgccccgcagcucuucucccuuccgggcggaacaguuuuugcggccuuuccucggcggcagcgguuuccucaggacggucggggccgucgugggcccgaaagagcccggcgccgcucucggaauccggcggccccagcggcacccgcggcggccuggacgugcugcggugacccgagcccggaaccuggcgccgggcggggccugcacauccggccccacccacucggggacucgccucuccgcgcccgacccgggaguagcggacacacccccucccggcccggcuguccgccuccgcccagccuuuccucagccugcuucauuuuucucccagucguccagccucccgguuuccgacuuugcacuaagagggaugcacucuggaaaaccacauugcgcggucacaucuuguuuggagaagaggccaggcuuuugcaucuuagaguauacguucaccuuuucaagggccuggcauagauuugauuaaucagccuggaauacccuguuccugccgaccuggccguuuuuaccuccguaccuuaucacacucccaggaacauuaagcagggagcgcuuggagucuucuuuggguccccaccuugagcuagacgugaaguugaccccugggcugcagcauggcugucgcccucgacucucagaucgacgcgccccuggagguugagggaugccuaauaaugaagguggaaaaggacccugagugggcaucagagcccauucuggaaggaucggauagcucugagaccuuccgcaaaugcuucaggcaauucuguuaugaggaugugacuggaccccaugaagcuuucaguaaacucugggaacuuugcugccgguggcugaagccagaaaugcguuccaaggagcaaauacuugagcugcuggugauugagcaguuucucaccauuuuacccgagaagauucaggcuugggcacagaagcaguguccgcaaaguggagaggaagcgguggcccugguagugcauuuggagaaagagacuggaagacuaagacagcaggugagagaggauuuuccaaauuuuuguacuuagaaaaaagggaaugggaaaggcaugugggcagggauguauugcagaaagacgugcucuucagagaaagauaaaugguacuaauaaaagacccuauaagggggucuuuucacuuuaagugaauccacuuaaaaggggaucagaauuucacaugaaauagaaaaauaaaagcuuugauugaaauauuaucuuacaauggaaaccagacauuauucaccuaagcauuuaucgucaucuuuggcauaauguuugcaacaaaacaauauaagagaacaauaugguuuugcgucacagagguucacuuacgcauuuugaucaaaaaaggcuauucuguucccccuuuaaaaaaaaaaaaaaaagacuucauccguuaucccagagccgucuccaagcguuuuacuguugcacucagugucuucugaagugcucucaugccuucauuucugucacucuccuccagucuaacugccacaucuucauuucucaguggcuugcaugcucuucuaguuguucuucaaccucacuuucaugaaccucgugaaauccugcagcauuugcaagauuugcgguuucaccuugcaucagacuugcauuguguagagaucuaucagcagguugcuguauuggucagggauagacagauagauguggauauuaauuuuguaaguuuucauuucacuacuguauauauucauguccugguaacuucuuugcgaacguaacagauauagagucaaauaauaucuauucuagcaacaaggaggcucuuucacuccugacagauuuccuucucuguuuaguauuaaauauuauucuggccaggcgcgguggcucacaucuguaaucccagcacuuugggaggccgaggcauguugaucaccugaggucaggaauucgagaccagccugaccaacauaaugaaaccccaucucuacuaaaaaaauauaaaauuagccgguuguguuggugcaugccuguaaucccagcuacuugggaggcugagagaggagaaucgcuugaaccugggagguggagguugcagugagccaagaucgugccauugcacuccagccugggcaacaaaagugaaacucugucucagaaaaaagaacacuguucuguuaccuuacacccagacugcuggacaguacucucagcccagcgcucucagagacuccacugggaauggaguggaauuuucauuccuucucaugucucuguccuucuuugaugucuuuccugggagaauuucgcccugauaugggccuguuuuacucccucuuaugguauugacuucauuucucaggucagcagucccgugcaccgggagaagcacuccccacuuggagcagcgugggagguggcagacuuccagccagagcagguggagacccaacccagggcggugucucgggaggaaccuggaagccuccacucaggacaccaggaacagcugaaccgaaagcgagaacgucggcccuuacccaagaaugguaagagggaagacucggagcacgccuagugcagaggcuggggcagauuuccgcaguaccccaacgcugugaaugugcaguggagggccuccuugauacauauucagaauaggagaaagguuucauucacuucaagaauuaggaacaugugcaauauaagugaaaagguaucauaaagauggaaacugagucugggcaacaugggaaaacccagucucuacaaaaucgcaaaaaaaaaaaaaauauuagccagguguguuggcgugcaccuguggucucagcuacucaggaggcugagucaggaggauugcuugaacccaggagguugaggcugcaguaagccgugaucacaccacuguauuccagccugggugacagagcgagacccugucucaaaaaaaaaaaaaaaaagauccaaacuggggaaacuuagauugccugggccagcuaugagauccuguggugguaaacucuccauggcuggacacagugacucacgucguaaucccaacacuuugggaggccgaggcaggcggaucucuugaagccaggaguucaagaccagccugggcaagauagcgagacaaacacauuuucucuacaaaaaaauaaaauaagaucuacauucuacaaucaucauguguuuuucaguccugccauguguaugugcucuuggcugacuauaaauaagucaaaaagcuguuugaaagggaacaaggcauuuguguucaaaguuugacucacaggccaucacagaaguggcauacaagagagauaaacaguuaagauuucacagggaagggaccacugacauucauagcugcccugcacauuaaugacucaggucaaaugcuaggaaaugaauacccuguccuucccaguccacagugaucucuccaucuccugaaguguggcuucaucucagucuuaaagagaggaauggaaacaucacuaaaccugccgucagaagucuucuguuuauaucuugucucugccaccuucugucugugaucuugggcaaauaauaugaaaagacgcaugaaugcacagaggcuaagagcuuaggcuuuagagacagacagaccuagauucaaaaccuagcucugccauuuuuuuaucuauguggccuuggucaggauacuuaacuucucaagcuuuccauucucucaucuuuauuuuauuuuauuuuauuuuauuuuuucuuugagguggagucuuguuccagguuagcgugcaguggcacgaucucagcucacagcaaccuccgccucccagguuccagcaauucucgugccucagucucucgaguagcugggauuacaggcgugugccaucaugccuggcuaauuuuuguauuuuuaguagagaugggguuucaccauguugaccaggcuggucuugaacuccucacguuaggugaucugcccgccuuggccucccaaagugcugggauuacaggcgugagccaccacacccaguccucucaucuuuaagagggaaauagcaaggcuauuugugcagauuaaaugcggcagcaugaaggagccagugcauaauagugcucaauaaaugcuaguuuccuuucccccagaauggcacaauuauuuuuaaaccucaagucugucugauuuacccagcccuucacugagaggcaagauucaguacuacuauacuguuuuaugccuccccaaauuuauauuaugauggaaugcauugcaaauguccaugauugagagagacagagagagagagagagagagagagaggaagggagaaaagggaagggagggggaaaggaaggcuggggaagggaaaggggguagggaaggagggaagguaccacagccauagucucacacugagacaugagcgggaccugagcauuggcauuggcagugcccuuucaaucagaugugugcucuccaguucccacaguccuuaccugguccccuucauccuguauuuacuugcuuacccccggaaagcauuugaggcugugaucccagcuuuaggguacuguguuuuuggggauuguucugaacucacagauaaaauggugaauuuauauuuguugguguuucaauacauacucaucucuuaaaaagagagacagcaugaauuaaagggucaaagcccagauuacuaaucguuucuuucuauucuuacagcucggccuucucccuggguuccugcccuugcugaugaauggaauacccuagaucaggaagugacaaccacacggcuuccugcugggucccagguacauuguaauugucuuuuuuuucuuugagauggagucucacucugucacccacgguggaguacaguggcgcaaucucagcucacugcaaccaccucugccuccuggguucaagcgauucuccugccucagccuccugaguagcugggaccacaggugcaugccaccacaccuggcuaaguuuuaguauuuuuaguagagacaggguuucaccauguugccuaggcuggucucaaacuccugacuucaagugacccgcccgacccggccucccaaagugcugggauuacaggugugagcuaccaugcccugccguaauuaucuucucuggccuuccuuacuaggguguuuaggcgcaaugcuuucugugccuucacuguccucaaauuuuuauacucccgucaagaguauaaaaguguauuucccccuuaguccuuuacuuauacuuacuuuaaauauacuuauacuccccacaagaguauaaaaguauauuucccccuauuccuuuacuuauacuuacuuuaaauauaauuacuuuacuuaccuuaaauauacuccccacaagaguauauuucccccuuauuccuuuacuuauacuuacuuuaaauauacuuacuuuacuuacuguaaauacacuuauaguccucacaaguguauaaguauauuucccccuuauuccuuuuccugaaaagaugggacccagucuucugaguaaugagacuccuugcuggaucaucuuguuuaucuugucaucuuaugauucuuucucuucugcuucauuuggcgcaaacuauccacuuguuccuugauuucaguucuuuaggguucuucucugccucaucugugauugcucauccuuugaagaccugugcaguuaucuugguagucauugguguuagugucauuacaggaaccagugaaagauguccacguggccagaggcuuuuccuacagaaagagugugcaucagauuccugcccaaagggaccucuaccgggauuucaggaaggagaauguugggaacguggucucccuggguaaggauuccuucccuuuccaaauauaagacuuggagcuuucuaauguauucauuucuacugauuagaagauaggcagauagaaauguuaacacuuaaaggaucucuaaggauugucuaguguaaucacuuagccagguucucuucccucacccacuccuccuuccaguaaaaaaauaauaauaauaauuuagugauuaaaacauuggagaggaguuacauaugacuaucauauuuguauuacauaaaaugguguaguacaguaaaugguauuauuccuuaggaaacugaggcuuagagagcuuaagaaacuuccccuggucaaaguaaaguaagcaauguagcuaggauucaaauuacgacauguucaucucuuuuguaucauaagcuggcaaauucucaauuugcuuucuguucuuaacagcucuuuccuauuaaccucaccaaaaugucuucagaaguuuuuuuuaauuaaugaaauauuuuauuaaugaaauauuuuguuuucaauaaauacuuacgaaaauauaucuguaccaauaauuuucaaaugugaagucacagauuauuuuuccccuucauguaauagaaaaguagauuucagacucuuuugaggagaaagacaucuuugacgugucucaggaccacaaagcuauaauaagauauaaggcuuuuuuuugcccaccuacccucaaccuccuuaagcaaaacaacucaauuuuauuucuuugauauauguauuuguggguuccuguaaguuuuguuuggaaauuagguucuucuaccaaauuuuuuucgacuuuauugggguacaaauaaauuuaauauuuauuuauuaaauauauguaaauaaggccaggcacaguggcucaugccuguaaucccagcacuuugggaagucaaagcagacagaucaccugaggucaggaguucaacaccagcaugaccaacauggugaaaccccaucuguacuaaaaauacaaaauuagcuggacaugguggaacaugccuguaaucccagcuacuugggaggcugaggcaggagaauagcuugaacccaggaggcggagauugcaaugagccaagaucacaccauugcacuccagcaugggcaacaagagcaaaacuccaucucaaaaacuacauauauguauauauaugcaaauaaaauuguguauauuuaagaaugucauauugcaacuugaugauuuuauguacauauacauuguaaaauaauuaccacauuugaguuaacacauccaucaccuuacauaguuauguauguguguguugagaacacuuaagaucuacacucucagcaaauuucaaguauacacuauaauauuauuaacuguaaccaucaugcuguauacauuagaauuuuuuaaucuuauaacugaaagcuuauacgcuuugaccaucaucuccccuuacccaagccccuggcaaccacuguucucuucucacuuucucuaaguucagcauuuuagaugccacauguaagugagaucauauuuguguuccucugucugguuuauuucacuuagcacaaugcccuccaaguguugucacaaauggcaggauuuccuucuuuuuuuuuuugagacagaguuuugcucucacccaggcuggagugcaguggugcaaucucggcucgcugcaaccucugccuccuggguucaagcgauucuccugccucagccucccgaguagcuggaacuacaggugcaugccaccaugcccggcuaauuuuuguauuuuuaguagagacgggguuucaccauauuggccagguuggucucgaacuccugaccuugugauccaccuaccuuggccucccaaagugcugggauuacaggugugagccacugcgcccaggcuccuucuuuuuuaugacuggcuaguacuccauuauauuuuuuuuccuauauuuucacauuuucaauauucauucaucaggagguacuuggguuguuuccaugucuggacuauugugaauaaugcuucauugagcacgggaguacagcuaucucuucaagaugcugauuuugucuccuugggauauguaccauaagugggauugcuggaucauauuguaguucugauuuuuugaggagccucccuaauguuuuccauaauggcuguaccuguuuacauucccaccaauagugcaugaccauucccuuuucuccacaaccuuguuaucauuugucuuuuuuuaauugacagauaauaauuguguauauuuaugggguacaaugugauguuuugauacauguuuucguuggggagugauuaaaucagcuaauuaacaaauccaucaccuaggcagggcaugguggcucaugccuguaaucccagaacuuugggaggcugaggugggcggaucacaaggucaggaguucaagacaagccuggccaacauaguaaaaccccaucucuacuaaaaauacaaaaauuagccaggugugguggugggugccuguaaucccagcuacuugggagucugaggcaggagaaucuguugaacccaggaggcagaggcaagucgagaucgugccacugcauuccagccugggcucacucugucucaaaaauaaaagaaaaucuacucuucuaggaauuuugaaauagacaaagcauuacuacauauuauagucacuauauaauagauuacuaaauuuauauaauagauuacuaaaguuuauuccucccaucuaacugaaauuuuguacccuuugaucaaaucuccacuuuccccaucuucccuccuccucccccagcuucugguaaccaucuucuacucucuacuucuaugaguuggacauuuuuagauacugccaaaaaagugaggucaugugauauaugucuuuucugugccuggcuuaccuuaguuaacauaauguucuccauguucguccauguuguugcaaaaggcagaauuuucuucuuuuuuaaggcagaauaauauuccuuuguguauauagaccacauuuucuuuauccauucagccuccugguugcuuccguaucuuagcuguaugugaauaaugcugcagugaacaugguagugccucuuuggccuacugauuuuaauauuuuugcauauauacccaguagcaggauugcuggaucauaugguaauucuauuuuuaguucucuauggaaccucuguacuguuuuccauaaugacucuucccaauucacagcucugccaacaguauucagagguuucauuuucuucucaccaacacuucuuauuuuugucucauugaugauagccauucugaaagguaugaaaugauaccucauuguggcuuugauuugcauuucccugaugauuagcaauguugagcaccuuuucauguaccuaucugccauuuguaugucuucuuugggaagauguccauucauauccuuggcuuauuuuuuaaugagauuauuuguuugguuuguuguuauuuugcuauugaauuguaggaguuccuuguauauuuuaguuauugaccccuuagcagaugagugguuugcaaaucuuuuuuucuauuccauagauuuuuucaucacuuuguugacuguuuuuguuguuguuuuggauuagauuuuuuuuuuuuuuuuuuuuuuuuugcuguauagaagcuuuguaguuugauguagucccacucauuuauuuuuacuuucauugccugugcuuugaugucauauccaaaaaaauuauugcccagaccagugucaaggagcuuuguccccuguguuuucuucuaggagauuuaugguuucaggucuuauauuuaaggcuuaauccauuuugaguucauuuuugugagucguguaagacagggguccaguuucacucuuuuguaucuggauauccaguuuuccgagcaccauuuguugaaaagaugaucuuuucccagugauguguucuuggcacucugucaaagauuauuuagcuauacauguguggacuuccuucuaugcucucuauucuguucuacuggucuuugugucuguuuucauaccaguaccauacuguuuugauuacuguggcuuuguaauauaguuuaacaaaaaauucuuggcuucuuuucucuuauagucccagugccuauauauguauguauguuauguauguuggggugggcauggaggggaauguggggaaaagauacacuuuauuuuacaaguaacaaauacugaguaggagcauacccugaaccuaacacaacacuggcuacugagagagaaucaaagguuaaaaauauauauucuuacccuuaaagguuuuccuguaagaacuagcuaggaaaagaaaugguacauauaugagaaguaaaaugaucguguaaguuaguagauguuuguaccaaggaagucauguaaaaauaaaugugcagugucacagcugaggaagguuugggugugaacaaguggcccaggagagcaugugacagcagaagauugaggcaugcaguaaugacuucuaugucuaccaugaaauauguuuauuuuacuguaggaagugcagugucuacaucuaacaagauaacccgguuggaacagagaaaggagccauggacucuaggucugcauuccucuaacaagagaaguauccuacgaagcaacuacgucaaggaaaagucaguucaugcuauucaggucccugcaaggagugcaggaaaaacauggagagagcagcagcagugggguuuagaagaugaaaagauagcaggugugcauuggagcuaugaggaaacaaagacuuuccuggcaauucucaaagagucucgcuuuuaugaaacacuucaggccuguccccgaaauagccaaguguauggugcuguggcugaaugguugcgagaauguggcuuccuuagaaccccagaacagugucgaaccaaguucaaaagucuccagaaaagcuaucgaaaggugagaaauggccacaugcuagaacccugcgccuucuuugaggacauggaugcuuuguugaacccugcagcccgugcuccguccacugauaaaccaaaggagaugauaccuguccccagacugaagagaauugccaucagugcuaaggaacacaucagcuugguggaggaggaggaagcugcagaagauucugaugaugaugaaauaggcaucgaauuuauccgcaagucugaaauccauggugccccugucuuguuucagaaucucagugguaagaauugugcuuuguuucucugguaggaaaacagaugugugaucuuguggaaaaaggaguagaccagaaguggccaaacccggggggugcugucacacacaccucaccacuuucacugugguguggccacaucacugaaguacucucaggugcuugcugcugcccccauugcagucagaguaacagcuccaaguggccguggagaagucguuuucacuuuagagcacagcauggauuuugaguguuuggguccuuguggaaggaagacaaauggaguuacaggguucuaaggaucuuguauuaucugauaauuggcauaaagcaaucaauuguauugcauuauaagucaagcaugcauuauuacguuaucuaaaauaaccaguacaaaauuuuguaacaguuucaacagguuuucauuaaaaauaaaauaaacauuuuuuguguaaucuaaaagaagacaaaggagagaaaaaagaauacaaaauagaugagucagauggaaaaaaauaagauauaaauccaaauauauaauuaauuacaaacuuaaagaacuaagauuaucagacauuaauugcuuauaagagauccaccuuaaauauaauacagagacauuaaaauuaaaaaggcagacagauacaccaugcaaaagagagcugguguuaaauauuuugugacugagacaugcagaauuaaaucgccaauuaauaacugugugacaguagacacaucacguaacuacuuugagcuucaauuuucucauccguaaaauauggcuaagaauaccucauaggguuguuauuaguguuaaauaggauaauauaaaugaaggcacugugaaaaugcuaaaauauaauacagcauugccugguaucacuguuauuaguaauguuucuuuacuccagcuagagauaaauucuuuuuuuuuuuuuuuuccgagacggugucucacucugucacccaggcuggagugcaguggcgcaaucucggcucacugcaaccuccuccuccugggugaguucaagcaauucuccugccucagccuccuaaguagcugggauuacaggcacccaccaccacgccuggcuaauuuuuauauuuuuaguagagacaggguuucaccauguuggucaggcuggucucaaacucccaaccucaaaugauccacccaccucggccucccaaagugcugggauuacaggcaugagccaccgcacccagccuauaaauucuuacauagaauggaaaacuaaaucaggcuagggaauguauccaugacuaaacccauucaaaagaaauaucuggcuggauguggugguucauaccuguaauucuagcacuuuaggagacugagaugggaggaucccuugaggccaggaguuugagagcagcugggcaacacagcgagacuccgucuuuacaaaaaauaaaacaauuagccaggcaugguggcacacuccuguagucccagcuacucaggaggcugaagcgagagggucgcuugagcccuggaguucaaggcuucagugagccaugauugugccacugcaguccagccugggcaacagacugagauucugucucaaaaaauaaaaaauaaacaucugcuaagaugggaagaugcauuaugccuagacaggucucaccaaucugaaaauccaucaacaugaggcugggacucuugggguggucucaaauaugggaauccagucauaggccuggaagaaaccaccuaguaagauagaggauagagauuuuuccuacaauagauuacaaaacauacaaaaagcauguuuuacaaauuauauuuagauaugcccugaaaaguuuuauucugcuauaaaugcagaacauagucuugucuuacagaucauuucaucucaaaguagaggauucaaugacauccaaaaacuacucugaacauaguucugcuccucaaggaagacugcuuacagaagugguaggaaauuugagggggaaaguuccuauuggaaauucuagucauuauucuuaaccacuuuggaaagagacuucuagagaacuaaaucauuuaguuaaucaccauagcaauggcagauuugggggacugcauuuuuauucuuccaaauaagcuuugagauuaguuuaccgauuucaguuuuaaaaaucugaaugggauuuugacuauagauucauaugagaaaugauaucuguacaccuugagucuuccuauucauaaacagugucuugucauuuuuucuaguuuuaugauauuacacauuuugauauagaccuucucauuucuugcaaagcuuauuccuaggcauauguaguucuuguugccacugugaaugggauuuuuuuuuaccucuacauuucuuaauguauauaguauagaggcuagagacuccuuuucuuuguuacauugugaacuuuauccccaaauggcaggcgugcacuggggcuaugaagaaaccaagacuuuucuugauauccuccgugagacucgguuuuaugaagcgcuucaagccugucaucggaagagcaaauuguauggggcuguagcugaacagcuucgagagugcggcuuccuccggacaccagaacagugccgaaccaaguucaaaagccuucagaagaguuaccgcaaggugaaaaauggccacgugcuagaguccugcgcguucuacaaggagauggaugcccugauuaacucucgggcaucugcuccuucccccagcaccccagaggaagucccaucaccuucaaggcaagaaagaggggguauugagguugaaccccaggaaccuacaggcugggaaccugaagagaccucacaggaggcaguaauagaagacucuugcagugagagaaugagcgaggaggaaauugugcaagagccagaguuccagggaccuccaggucuacugcagagcccaaaugguaaggugcaaaaccaaggaguuuuaguccaaaagaggaauaagugugauuuacugaaaaaugaguagaucuugcacauagcucaugaauauuccuucauucaagaaauauuugagugccugugcuacuugaagaacaggggauauagcagugauguucuuggcaugguggcucacaccuguaacccuagcaguuugggagguugaggcggguggaucaccuggggucaggaguucaagaccagccuggccaacauggcgaaacccugucucuacugaaaauacaaaaauuagcugggugugguggcgggcaccuguaaucccagcuacucaggaggcugaggcaggagaaucacuugaaaccugggaggcgcagguugcagugagccgagaucgugccauugcacuccagccugggugauagagugagacuccaucugaaaaaaacaaaguuccuguucucauggugcuucuauucaaaggaggaacucacguuagagugacucaguccuuggguucucagccuugguuuuuguugguaugggucagacaguguuuuguaucuccuggaaguaccguggggaagaaaaacuuggaauuacacaugagaaaaaacuuggaugaagaaaguguuucaguaagcacaaaagaagaauaucuuaugguuauauggggugugcaagacaaaaaagauaggcagagacuaaauaaaagacuuuauucugguccugagcuccaccugcauguuucccacugacuuacgcccucgugggccugucacuaguaacucaggcuuaagauguucaaaacuaacuucaccaucuuccuuaccacaccacggcucuucccugugggcucccgcccucauccagacuaucacgucuaucuguccccucuucaguuaccauuagccacugucuaguucagucuucucucucucuugccuagacuguuguaaaagccuccaaaccaguuuucuccacccacacuuuuauuaagguuucacagccauuuuugaucugagcucaucuuacucuucuagucuacaugucagcauuuuccuuccucaacucugcuuauucagagcggaacuacuggcuauuuccuacaugcaccucaagcucuuucacauccaaacuuuagcuugcgauguucccuccaccuugaauguccuuggcucuacauaucuccauguccaaauucucucucaccucccauacuuugucugucucugucuuauggcacugaacacuuuguauguaagaucucccagacauggugagcuccugaaggacaggagcuccgucuucccauaacacuagauuaagcccucggcaaucaguugaauaugcaggguaauucaggacuaguuuauugaagcaagugacucuagcuuaguauauauaugggaaauuauaguaugaaggcuugaauuaaguccuguagaacccuggcuuugauaacuggaaacaaaguccuugugaaucuuguuuuuaaagugagcuccaaaccuaucaucaaauuaucaagcuuucucugagccaacuccuagguugugacuuccuccaaaucgcagaacaauguugaacucaaucagaaaacuucaaaagaaguacugacaggccaggugugguggcccacaccuguaauccuaacacuuugggaggccaaggugggaggaucgcuugagcacaggaguuugagacuagccugggcaacauacaccccaucucuacaaaaaauaaaaaauuagcugggagugguggugugcaccuguaaucccagcaacuucugggguugaggugggaggaucacuugauccugggaggucaaggcugcagugagcuaugaucaugccacugcacuccagccugggugaccaaaaaaguacuaauaagugaaagauggaauuguuagggcuuuuuacuuaagugucuagauugauugauggcugcccuccucuccccaucccaugccacagccuccacacuugggauugagaguuaucugugguuucuacugaauguguggaaggaaaguaauguugaaacuggcaguagaaacaaggcaggagagcagaugcuuaagaacaaggauuaaccugaauugggccuaaguugcacagcuugugaaauguuuauggaugaaauaacgugaugucuggaauuggcuucaaaguagucuggauggagggagcagggaguaugugggcguggaaaugaaaugagauuggccaugaauaggucauaguuaaauguagguaagugguuugugggaguucauuauacauacuguucuccagacuuuucuguguuugaauuuuccauaaguuaauacaaaaaucacacaguuaauaacucaccaagaugggaccagacucagagccguguaauuccaaaacuugucucuguucaccaugucaugcucucuguccagaaaacuuaacagaaaaucuggauccaagauguagugaacgugggauguaggugaaaagagugagaaaauaauccaauuuggguaacagugagaauuaagauuucauuuagugugguuuaugggacagccugaaaaacaaagugagaagaacauuugaaaagaaacagguacccuugggugggauaugauuagauauguagaggaauuuaguuccugaagucccucgaggaacuuggacuuagucagaaucuaaucuagagaucagugugguguagugugcuuuaguauagaggugaaauuaugaaaauaggaugaauuagaguggaaccucagggagauaagccagguugcacccuuguuaaucgggauauggauggggaaugauggcuuggauuauaaugcaggaaacauuucuuaaggccuacucuguacuggcuguuauuggccuguuuaugaauggaaagaaauauagcagaaugaaucagggaagagucacaggaucugagguuagagaaguguauggagagcaagcggaucaagccuugcaagccagguuguuuaugguuaauaucagacuuguauaaaauuuguauugucuuucauuuuuucagauuuugaaaucggaaguagcaucaaggaggauccaacacagauaguauauaaggacauggaacagcauagggcauuaauagaaaagucuaaaagaguuguuucccagaguaccgaccccagcaaauaucgcaaaagggaaugcaucucaggaagacaaugggaaaaucuucaaggaauuagacagggaaagccgaugucucagccuagagauuuagggaaagccguugugcaucagaggccuuuuguggggaagagacccuacagacuucucaaauauggagaaagcuuuggaaggagcacucgucugaugugccggaugacccaccacaaggagaauccuuacaaguguggugucugugggaagugcuuugguagaagcaggagccugaucagacaccaaagaauccacacaggcgaaaaaccuuuuaaaugucuugacuguggaaaaagcuuuaaugacuccucaaauuuuggugcccaccagagaauccacacaggagagaaacccuacagaugcggagaguguggaaaaugcuuuagucagagcucuagucuuauuauacaucagagaacgcacaccggugagaagcccuaucaguguggagagugugggaaaaguuucaccaacaguucucauuucagcgcccaccggagaguucacacuggggagaaucccuacaaauguguggacugugaaaaaaguuucaauaacuguacgagauuucgagaacaucggagaauacacacuggagagaagcccuauggaugugcccaguguggcaaacguuucaguaagaguucuguucuuaccaaacaucgggaaguucaugugagagaaaagccucugccacacccuccaucucuguauugcccugagaacccacauaagggaaagacugaugaauuuaggaaaacuuuuugaugaugaucuucucuuccuaaaugcccccuuagccauuuuacccuaaucucauucuuggaagcaaucuuuucuuagcuaugaaguguaauuuccaagauaaacuugagaauauaaauaaacuaaacacuuucauccuguucucaccucugccucuaacuucaucagucuguuccuccucuucugugugucucagcuucuccuuuaagaauguggcgaagauacauuguccgaguucagaaugaaauacccuucaguacauugaggccacugcaacuggauugcuaaguucggcaacauucaagaucuuccauaugggugagaguugucuucaaggauauaaaaaaugccaaaaguuuuuuuguuguuauuaccuacuccgugagauccuggaugaaacuugauaacagauuuucacauuuagauagaacuuugaggagucugaucggaacuacaucaaauccaucuugguuuugaagagauccacaaaagaagagugaagauuuuauagcuuuccucagaagucuguuacaguguaccuuuuuuuuuuuuuuugucaagaaguugauccaaauagcuagggcagaaucccuguauugucacugaaauccuguuacuaaugccuugcccuccauggaggugagaagcaauugaucaccccucauccuuuucuguacccgaagacuuaaauccccuggcugcugcuucuccagccuauaaguaaucccagguccuccuacuguuucucauagcccugcacuugccucucaguugcucugggugcuccugccggccucuuccgaacuaccaugcccuccucagauagaauaggaggccugcucguggugugucucacuaaagcaaaguaggauuucagaugcguucuaguucuauccucuaacuucucuggcucuuaucuagaacaugacuggcauguuggcauauuucguaccucccaccccugcacugcaguauaauauuauaauaguguuucuaaaacuuuaaggggauagggaagagguaauagacaccugaagcauuucuaagaccaguuggacuccuuuggccugcugucgaucagauagccaccucagcuuagaccagcgcucucaggucuggcuguuaaaucucccagucucuuuuccugaggcuucuagucccuguucaccgcaucagaaaccuaacuguagugugccaaguaacuuaacacaacucuagagcucacugggugaaaagugggaacauuuauaaaaacuucaauccagaaauccagaacaccguuuuuguuuuccucauuuacuuguuuugucugaaaaaucucuuugagaacccccggcaguaacccaguaaacacugaaggaaaaguucugaugggggaugguuaauugacuuuugaaguuacagaugaaacccagagauuugauuuuccauggccaguugcuucaggauggagucaguggcguuuauucccuuaguauguaggugacccaggguggcuuugcuuuggcaagggagaagucacaaguuuaaugggaagggaaccggaguuagggcuguuugugggugauuauuuugcucuucucucucccuuucuuugucaaaugcucuuauuugaagccaucuggaaaugauauuuuuccuuuugguauguuucaaucuuuugaaacuuguucagcaaaguaccuaggaggguaggcacuguagaaagaaaucuaauuuauggugccagaauaggguguggccuguuggaaggcaggugacucagguagacauugauaaauguuucugauuuacauuuguuggaaauauuaugacuguucacaucucaauagguugauuuuucuguguuguccaaguuauagauuucuaaugcuaaguacaguuccauguugguagugugcguagcacaguaagauguuuguggugccagugggcuuguguuuauauuguguagauguucuggaauuccagcucuagagaagauguaaauuaauagaaaucaccacuuaauaauauguacacaggauugauauuauguggaagcaugauucagga

SEQ ID NO: 15391 - RNA, 1526 nt, Homo sapiens
caugaaugaggaguaugaugugauugugcugggcauuggccugauggaauguauccuuucagguguaacaucagugaagggcaagaaaguucuucauauggauugaaacccuuacaauggaggagagagugccucuauaacacuacuggaagauguauacaaaauauuuaaaauaccaggaccaccauaaccaucaauggggagaggaagagacuggaauguugacuugauucccaaguuccuuguggcuaauggucagcugguuaaaugcugcuuuauacagagauaacucacuaucuggauuuuagcgacugaagggagcuuugucuauaaguguggacaaaucuacaagguuccuuccacugaaacagaagcccugacaucuagcuuaauaggacuguuuaagaaacgucacuucaggaaauuccuaguuuauguugccaacuuagaugaaaaagauccgagaacuuuagagggaauugauccuaagaagaccacaaugugagagguguauaagaaauuugauuugggccaagauguuauagauuuuacuggucaugcucuugcacuuuacagaacugaugacuacuuagaucaaccauguugugaaaccauuaauagaauuaaacaugacagugaaucuuuggcaagauacgucaaaaguccauaccuuuauccacucuauggccuuggagaacugccacaaggcuguuugcaaggcuaagugcuauuuauggagguaccuauaugcugaauaagccaauugaagaaaucauugugcaggauggaaaaguaauugguauaaaauccgaaggagaaauugcucacuguaagcagcucaucugugacccuagcuauguaaaagaucagcuagaaaaagugggccaggucaucagaguuauuugcauccucagccacuccaucaagaacaccagugaugucaacuccugccagaucauuauuccacagaaccaagucaguagaaagucagauaucuguguuugcacgaucuccucugcgcacaauguagcaacacaagagaaguauauugccauaguuaccacaacuguggaaaccaaggagccugagaaggaagucauaucaucuuuggagcucuuggagccaacuagaugggaauuuguuaguaucaguggccuccugguaccgaaagacuugggaacagaaagccagaucuuuauuucccgugcauacaacccuaccacucacuuugagacaauugugaugacauuaaaaacaucuauaagaagauuacaggauucgaguuugacuuugaggaaaugaagcgcaagaaaaaugacaucuaugggaaagacuaacaccaguacauguuauuaucuaauuaggacaaauuuaaaauuuggcaaauaaugcauauuaugugaaaucaauauuguaaggccugcuuuuguaaucaaaauggagagauugaagagugcugugucaguaaauacuccuccccuucaucuuucuaacauguauuaacucguuuucauggaguggcuauu

SEQ ID NO: 15392 - RNA, 135098 nt, Homo sapiens
cgauuccggauugguccgguuccagcgccgcagcccggcggccgcgcuguggggccgcccggcgcucgccacuuccggcgcguuggggcuguuggucgggggcggccgcgcgguacuagcgggcggcuccagggcgggcgcgcgcaaggaugcucuagggggcggcggcaguggccguguggguugaggcugcgaggacagcgcgggcccccgggccucuccccugagccggccgccugggccgcgcggucgaggccugucagccuccgcccguucagccucggggccggggccgccgccaccucugcccgcggaggccggggagccccugccugggcccgcagccucccccgcgggggucgggcccgggcgggggucccgagcagcugcccuccucgccggcauccgagccucauuuccugcuuuuucaguuuccuuggggaggggcgggugggucuggaugaauugucucggggucccccgaugaggcgacccgggcggcccugcccuuuuuagaggguccccucggggcccgguggggaagggguugucuuugcaugggugggggacuucccgagucugccgggaccaugaccugaacugugcgagcgggacguguccgaagcccaagaaccagcucaucugagccgcccccuccccggccagcaugguaaguggaauuggagcccccuucccuccuggggugcccuaccggaagggugggaaugggccccggggcugcugagccaucgcugcucuccccauggcggggagaggcgcgugcggagccuggccggugacacaugcgugcagagugugcagccccggcccugcgcucccauccccccagggaugauggcucaggccugggagggcccugggagcgcagcaggcacaacccuugcaucugguguuugccuccugcagcuccuccggauaauaacuaucguuuauugagggcuuacuacuugccaaggcccugcgcgaagugauugacagugcaguaguauuuaaugaucacaccagcccucuguucggaaguggggagacugaggcacggagcaauuaauuccccagcucaaggucaagcgacuuuuuaacaguguuaagauuugaaccuaggcaucugacuuugaaccuaggcaucucuaauacacuuagagagcugggugauuguaggagaaacaucucaucuagcuguagguuuauauaugaggaaacagagcgauuuacagaggucacuugcacaggugauggcaaagucaggaauggucgugaucuuuugacacugaggcugcuauucuacaugcucugaucucugcugaagcuaccuuccacguuuucuagaccgauacuuucaauacuccccuaaauguguguacucacaucucuuuguguauccacaucuccacguuuucuagaccgauacuuucaauacuccccuaaauguguguacccacaucucuuuguuaagcauuugccuuuuugcucuuguaauuauuucugagccuuaucugucuauugcgguauacacagcuccuucaaagaccaaauuguuugaacccuuaucugcuccagcuccuggcacauaguaagcccuugguaaguacuggaucaccuagccugugguugagcaccucgaggaguggagcuguucuccucaguuucacccauuuuaccccugccaaguuagugguauaauagagaaagggacauagcugcaucuuuugugauacagaccuuaaggccuguggaauuuucgaaacauucaaggggccuguggguaguguguagguccugagauauggagcuuacaaccagcuggguaaaguacaccauuaaugcugagcagcaccguacaguauaugcuauacguauaguguauguguuuuauuuuuauuuguuuugagacagggucuugcuuuguuuccuaggcuggagugcaguggcacguucauggcucacugcagccucgaccuccugggcucaagcaguccucccaccuuagccucccaaguagcuggggcugcaggcaagugccaccaugccuggcuaauuuuuuguggagaugaggucucaccacguuccccaggcuggucuugaaccugagcucaagugauccguccuccucagccucccaaagugcugggauuacaggcgugagccaccgugcacagcugagucuauguauuuuaacauauauauuacacaguaugaauuguggcaaaucaguuaagcucucaguuccaauuuccucaacuaugaaauuuggggauaggauuucucuaaagaguaaucuagagguaugagguauaacauuuaguggcuaaugaaaguagcacucauuccuuccuucauuuauucuuucaguaaugcuuuuuuuuuuuuuuuuuuugagauggaguucagcuguuguugcccaggcuggagugcaguggugcagucucagcucacggcaacuucugccucccggguucaagugauucuccugccucagccucccgaguagcugggauuauaggcaugcgccaccaugcccggcuaaauuuuguauuuuuaguagagaugggguuucaccauguuggucaggcuggucuugaauuccugaccucaggugauccacccgccucggccucccaaagugcugagauuacaugcaugagccaucgcgcccggccucaauauacuuaaguuuuguuuuuuaauuguaguaaaauauacauaauuaaaauuagccauuuuaaccauuuuuaaguguacaguuuagugaaauuaagaacauucacauuguugugcaacgaucaccaccauauaucuccaaagguuuuuucccaaaacaaccuguacccgucuuuuuucagucucuccccugcccuacuuuaguuucuauuucuaugaauuugacuacuuuagguagcucauguaaguggagucaugaaguauuuggccuguugugacugccuuauuucacauggcacaguguucucaagcuucauccgugugguggcgugugucagagcuuccuuccuuuugaaagcugaauuccauugugaguaugugcugcauuucauauauccuuucauccuucgguggauaccuggguugcuuccacccuuuggcuauugugaauaauacugcugugaauauggguguacaaaucuuacaagugaauuuucaguagccaccaccauauaccagggccuagggcauguacagaugaacaagacacacauuccuccccuugggaaacuuacagcauugcuuuaggacccuuggacagaauuuuguuauugacugagcuagcccagcacccuuguauugagguuucauuuuaauuggcagucaguagagcaucaugggaaugaccaccuuugaguaaugaauuguaaaguaguuggcuucaugaacuccaugugcauuuuuucugagguacguugcaagucaaaguuuuugucaccuagaccucaguuauuuaaguacacaggggguggccauaguugaugugaauaggauuguccuuuuugugucacugacacagugguucaucuguagguaucccagggucaggggcuuggguaggguaggcccugucccccaaagguaaggaaacuguugccuggcuggugucuuacaggcggagggucuuuucccugggaucccagcucuuuauuccaggaaauuauuuccucuccauuucuugcugacuuaacauuuuuacuuuuaaggguauuaguuggcauaaguuugagcccuuuuaacaucuucuuuuuaaaucuucaacucuaauaagacuugaaaguggcguaaugugauaaaaacuaccacuuauuaagcaucuuugaugugcuagcuauucuucacucauuacuuguuuuuucuuucuuuuuuuugagacggagucucgcucugucacccaggcuggaguguaguggcaugaucuuggaucacugcaaccucugccuccuggauucaaaugauucuccagccucagccuccugaguagcugggauuacaggcacgcccagcuaguuuuuuuuuuuguuuuguauuuuuaguagaaaugggguuucaccagguuggccaggcuggucucgaacuccugaccucaggugauccacucgccuuggccucccaaaguucugguauuauaggcgugagccacugcgccuggccaaguuuuucucuuagucauucaguaucaguaaaccccaccaacucugcuagguuccacuauggcuguuccugccagagcgggagauggacagaccugcucugugauuccuaguugacaagugguggaguuggcauuuagacccaaagugcuguacuccggagccugugcucuuugggugcugccucaugggaaggaagaucaggagagucuuccaccuguauguuguuuggcuuagagauagauagugguggagcauagggaguauggggaauuuuguuuacacuaucccuguugaccuucacauuuagaaccaguuuaaaaagauuuauaguugcaguauagaauuacaggaagagcuagcauacuauaacuguauuugauuaaaucauuuuuuguugcauucccauggauucuuaaguggugugacauguuagagguucccacuacuuugcugagaaauuauuacuuaguauugagcgagcuguugcuuaauaugaaaauugugugcaaaauugaguuuuugcuuauauuagcauuucuuuuuuaguugcuuagaaauugaauugccugcuaagguuuguuuucuuucuuucuuucuuuccuuuuuuuuuuuugagauggcaucuugcuuuugcacccaggcuggagugcagugguacgaucuuggcuuacugcaaccucugccucccagguucaagcaauucuccugccucagccuccugaguagcugagauuacaggcacccaccaccauacccggcuaauuuuuguguuuuuuaguagagaugggguuucaccacguuggucaggcuggucucgaacuccagaccucagaugaucugcccaccuuggccucccaaagugcuaggauuacaggugggagccaccacaccuagccuuauuuuuuuaauaucaguuaccgugaguggccccuguaauggaggcagaaucagaacugaaauuuagccacucacauggcaugucauccacuuguucauccacagcauugcauuguaccccaugcucucagagguacaaagaagacaugggggugcagggagauggcagggaaagguucagcaguacccagagguuuuguaugucagucacagcauuagagaaagucuggagaaaaaguuaccugucaagaaaugacuugaauagcuucugaaaaaauuaguauaugauaugguucaaaucaccugauaaaaccaaaauguggucagcaaaauuaauguaguauaaagaaauagguagauuaagccagaguuuuuguuauugguuuuuauauuuauuauauauuuauuuauuuuuugagacagggucuugcucuguuguccaggcuggggcgcagcagcacagucacagcucauagugaccucgaucuccuggucucaaggcaauccucccaccucagccuccucaguagcugagacuacaggcccaugccaccaugcccagcuaauuuuuuuauuuuuauuuuuuguagagaguggggauugcuauguuguccagccuggucuugaacuucugaucucaagcaguccucuugccucagccucccaaagugcuaggaucacaggcgcgagccaccacaccaggccaaauaaucaugaaauaauguauugacuuccugcuaugaaguuuacaacccuagguacugugguuacaaucuaacaauauaauaguuaauauguguguguguguguguguguguguguguauugcuuucuauaugccaggcaucuuacaucuaugaaccuaugaacccauuuacugucccaaacaacucuaggagguagaggcaguuuuuuuuuuuuuuuuuuugagacagucuugcucugucgccuaggcuggagugcaguggcgugaucucagcucacugcagucucuaccuccuggguucaagcgauucuccugccucagccucccgaguagcugggacuacaggugcgcaccaccaugccugaauaauuuuuguauuuuuaguagagaugggguuucacuauguuggccaggcuggucuugaacuccugaccucacaugauccacccgucugggccucccgaagugcugggauuacaggcgugaaccaccaugccuggcuuaaaggcagcuuucauuucauguuuuauagcugacauucagugcacugagagguuaggcaacuucccaaggucacacagcgagucacugcucauaaccguuacacuuccaggguaauauuuaauacugccccugcccucugggagucaguuuaguggggaagauaagucaacauacucugaaaauacaagagacugugauacaggugauaguagaagaauguguuggugcaaaggggcauugguacaaagauugcauagguacugaccugagagagauuggcugagaagagucagggaaggcuucccaggaagguauauuugagucuugaaggaugaggaagaguuugacacugggacaaagaaagggccuuccaagugaaaguuucuugcagacaguuacaaaggucacauauauagcaacaaagauaauagaaaaugauaggugugaagugagagugaaggaaauaaacauuuguugggugcguaggacuuucuagggcuuuauaugcauaccuauguacacauauacauguaguacacaaacaugguauuuuuuuuaucugaaaccuuuacuccuacuuuccuggccaguuauugcccuauuucuuuuuuccccuuugcaacaaaaccccaggaaggaguggccuguacuuggucucuaauuccucacuuucccuuugcucauuaauuuuagacauaggaucucgcucugucgcccaggcuggagugcaguggagugaccauaguucacagcagccuugaacuccugggcucaagggaucccccugccuaggccucccaaaaugcugggauuauagaugugaguccccacgccuggcauuauucucucuuaaucucacuuaucaaggugauaaguguugcuuauccaguguugcuaaauccagugguuagcucucagucccuaucuuacuggaucugucaguagugucagacaaguggaguaccccuucugcaguucagccuuucgucacuuggccgcugggacacuaagguguguucuugguuuuccuccugucgcacagguuguuucuuccucaucucauagccggaacacucuaggccucgaacuuagugccuucauccaggacaccuauaacccaacaucucucuccucagcuccaguucucgagucuccagcugucugcuugacauccaagcugguuugugagacgggucacaucuccccucuagcucaccuccuuuagcucucacuggcugugcugcagcucccucggucuucuuacugcucuucagaccuucugggcauguuccugcuccaggccuuuggccuggcucccugccucugcuuggaccgugcucucccugagaaucugcuugacuaaaccuuuaagccucgagucacuuuuccaguggggccuucccucaccacccuguuuaaaaugguaaugccacuucagcacuuccagucccugacauccugcuuuacuucucuuuuuguacaauuuuuuaacauuuuauauacucaauauuauuaaugagguuggucuuuuguugucuccugcuaaaauguuagcuccauaaagcuagggaaucucucuuuuguucauguaucccaagagucuagagcaauucuuggcauagugggcaauuaaauugugguagggauguuguugaggucuuggguguucaaagggagcuuuagggaaggaguaaacuaggcucccuagcaguuucagaaguuuggaaguuucagaagagaaggaugugaagaaguaguuggagagaaggcuaucaagguaguuuguggcuagaugauggagggucuccaguacuacccuagggaguuuggcuuucucuuguuggaugguuuuuccuuaaaggaaacuuaaucugcuguguauagguuagaugugggaaaccagauguuacaccaugccuguguggaugugacaagggccugccuguucuugcauguguaauuagugguugagaggaagaccugguaagggaguugucacuuaaaacugauuccagaguuaagagaugaggaagaaggaaaagcacaagcugauuuuggaagccuguaaccuggcgauugagaguaguagaaaguuuuaaucaguuggugauuuggauuugguaggaauggaagcgauaacauguaaacugauaggaagagaugacaggagaugggccaugugcugaugaaauaugggauguggcuaucucuguagguaggugagcaguuguggcgcuguugacaugaagguaguuggcccugggcacgagaaggauguugaagaucuuaaguaguugcauugucaaauguaucugucuaagccaaggaagaugugauagcacaggcuguguugaaaggguaggaauuccugaaagugugguugccacucuaccucuacuuuuucaaccucccaccucuccuuucccccugucauucauucuacaacccauugcugacugacuuuuuuuuuuuuuuuuugagauggggucuuacuccgucgcccaggcuggugugcaguggagcaaucaugucuuacugcagccucuaucuccuggggcucacgcgauccucccaccucagccuccugaguagcuggaacuauacguaugcaucaccaugccuggguaauuuuguauucuuuguagauacgagguuucaccauguugccccugcuggccuugagcugcugggcucaagugauccuccggccucagccucccaaagugcuaggauuacaggcguaagccaccacgcccagccagcagacuuuuugucuuuaccacuuuucaagauuauguguaacaucugugugcugaguucaguuuaaugcguauuuucaauccuuaggucauuugaccucucaguguggccuuuggcagccacugaucuccuuuucuuuucuugaaacacuuuucuucuuggcucccguggcauccaugguauuagucucuugguuuagccucccauggcuucagcuaugacccguguaccaaugaaaacuaaacccucaccagcuguagauauccaguguucugacaacaucaaauuaaauguguguuaaaccaaauccaucaucuuccucucagguuagugccuccucugucuugcccugguucuguuaaugaccucauuuucuagcuagucaaaugaugaaccugagucaucuuuaacuuccucuucuauagcgccccccugcuuccagaccuguugaugcugcugcuaacguaucuguguccugacccugaccuuucccuccauucccucugcuuugaucaagcugucauugucucuugcuuugguuguugcugucaugaccgguccucucuuccagguucugcgucccucuguccaucuuccguacugcugagcugccucauagagcucagaugugaucaugccacgugaaccccagucauucagagcagaggguucccacuguugucugagaccaaguuuucaucaugguagaguaacaugggcccugaauuuuaaguuucuuacuuacuuugaggucccucaguaaggaugaagaugguucauuaaauacuuaaagugauuuauuuggaguaucuaugaaagacuucccaaaguacaccuuguuuuccagccacagcaaaccauuugucauucccagaacacucagugcacuuuaauacuugucugccuuugcugaugcuguucccucugcucuagcgcccuuuucuuucuugcaaaugaaacuuaugugacaucucaagguuaccauaaacauuaccucucugaggcuuuccagcugcuaguuuaucauaggucaucuucgauuauaguuugguauuuuuuggcuuuuauuauuuugauauguuuguuuuuguuaauauaagaaugacaagacuacauuauuauuauuauuauuauuuuuugagacggagucucgcuuugucgcccaggcuggagugcaguggugugaucucgacucacuacaaguuccgccuccuggguucaagcauucuccugccucagccucccgaguagcugggacuacaggugcaugcugccacgccuggcuaauuuuuuguauuuuuaguagagaugggguuucaccguguuagccaggauggucucgaucuccugaccucgugauccacccgccucagccuccccaauugcugggauuacaggcaugagccaccacgcccggccaagacuacauucuuacagugagugucagacaguucagaaguuucaagagcaaaauguggaucucuugccuccuuccccacuccuccuccuucccacuccaagccugggggugaggaggauuaguucuuucucuuuaagagcccauagcagagugcgucuuacucugcuucgccucuuuagugccuaguaagcauucagcagauacaugaguaauuaagagucagguguaaaaauaaacccaagcaggucaaggugggcccuugagguuaguaaaugauaguaauaguauuuggagagggugguaagagugaaauagaguaugaaugcaguaacaccuuguauuuccaaaauccaugcaaccagcaagcucagauaacuguauuuuuucccccgguggguggagaugggcagcaggugagcaagggaaguugucagaacaagugcugugggggguggugugcuuacuggggagccccaaagcuaauugcuacugggagaaccgcugaggaacaaugaggagugggagugggugaggugaggucuuuguggaucuuaaccaaggaaagacacagggcagagaagugagggggugaaagaggcuaaugggaagggaaggaaaugggcauagagagagaaaaggucuguguuucauaauugcacucugugcuagucgucguuaaggggcccucaugcauaccgcguaggguauuugauuuaaucucucauagccacccugccagguagguauuauguucccauuuuauaguugaggaagauaaggacgcugaggcccaggguggguaaugcuaaguaacuucuccaaaguuaccuaguguucucuucaucugggcuaagaaaauaaaaaaccaaaaaaacagaaaucagaauuaccuagugaguugacagagccaggauucaguucuaagguuccaacuccaaggcccauguuuuuuucuagaucacuagguuucuuuuuuaugagacggaaucuuuaccuguugcucaggcuggagugcaauggugcaaucuuggcucacugcaccccagccugggugacagacgaaacuccgucucaaaaaaaaaaagaaagaaagaaaaaguaguaugacuugagggcacagugguagcugguccauauuacaggacaucaacaaaaaggaagauugcuugauuucuuugaguuuuaauucagguaagcccauuaggcuuagcauaugcaauagguucauuuccauuagaggagccugcugcuguuuuauaugaagguuauaaugaaaaagaucucuggucuagggcucccugaaaaguuaaggguauuuuauaagccaaauggagcuggaaggaaaaucguugguuucuaaacucauuaauaaucagaccugagaaguucuguccuuuccuuucccuuuucuuuuuuugagauagagucucccucuguuucgcccaggcugggguguaguggcgugaucuuggcucacugcaaccucugccucuggauucaagcgauucuccugccucagccucccgaguagaugggauuacaggugcccaccaccaugucugacuaguuuuuguauuuucaguagagacagguuuucaccauguugggcaggcuggucuugaacuccugaccucagguaauccaccgccuuggccucccaaagugcugggauuacaggagugagccaccgugcccggcccagggaaggccuuuuaaaaaauucaugaggaggccaggugcaguggcucaugccuguaauccuagcacuuugggaggccaaggugggcagaucacaaggucaggcguucgagaccagccuggccaacauaagugaaacccauuagccaggugugguggugggugccuguaaucccagcuacuugggaggcugaggcaggagaaucacuugaacccaggacguggagguuguagugggcugagauugcaccauugcacuuuauccugggugacagagcaagacugucucaaaauaaaaaggccgggcaugguggcucacuccuguaaucccagcacuuugggaggccgaggcaggcggaucaccugaggucaggaguuugagaccagccugaccaacauggcgaaaccugucucuacuuaaaaaaauacaaaaauuagcuggacaugguggugggcaccuguaaucccagcaacucaggaggcugaggugggagaauugcuugaacccgggagguggagguuguagugagccaagugcuuuguuauuguccaggaaauuauucaucugcauuuuguuuuuagagaaagauaaauugagugaucuaucaaggauuuuuuaauuuuaggggcacaugucaucaggaccuccugaggcugugucacggacucauguccuuuuaaauaaaaacauuuuuauaaaaaggguuuguuuauuuaauuuaauuucauuuuuuugagacggaguuucacucuuguugcccaggcuguagugcaauggcacgaucucagcucacugcaaccuccaccuucuggguucaagcgauucuccugccuuagccucccaaguagcugggauuacaugugacaccacgcccggcuaauuuuuauauuuuuaauagagaugggguuucaccagguuggccaggcuggucucaaacucucaaccucaggugauccacccaccucggccucccaaagugcugggauuacaugugugagccacugcgccuggccagauuuauuuauuuuaaauauguaauuuugagauaauguaagacuuacggaagaguugcagaaauaguauagggaguuuuuguaagcucuucucccauagguacuuacuaacaaacaacaaaacugcagcagccaagcccuccaacauuugugaccaacaauuuauuuuuuaaaaauuuucuuuuuuuuuuaaauuuuaaaauuauuauuuuuuuucuuguaucaggauaggaucucgcuguguugcccaggcugguuuuaaaauccugggcucgagcaguccuccugcuuuggccucccaaagugcugggauuauaggugugagccguuguuccuggccuugugaccaauaauuuagcucaguuucugugccuucuuuauucuaguacugcuagacaauuaaaguaggugcugaugcuacuguagaaacacaaaaucuucucugccacuucuugauuuugcuuaguuguuauuauccugauuguaaaaaguauuuugaacucuagaauauuugauaauuaaaaaaaaaaauuaccaccauuggauucaaucucuaauaacauuuugauuugcuuccuucuagucuuuuuuccuauuuacuuuuucaauaugguugagauuacacuguaaaugcacuuuuuucuucugccuuuuccgcuuuauagcauaaguggcuuuucaaaucauuaaauauuuuauaaauauuugcaguggcuuuauaauaccgaauugcauggauuuuuaagcaguucauuguucuguuuuuugccaugguaaauaauaaugugauuaaugucuuugcgaaaaccuuuguauguauuuuagaaaauugccuuaggauagauucccagaagggcccaaggguaugaggguuuuuuuuuuuuuuuuuuuuuuuuuaauaaacuuagauguagucugaacaauuuuuuuuuuuuuuuuuuuuuuuuaagagucucucuguguugcucaggcuggagugcgguggcgugaucuuggcucacuguaaccuccgccucccggguucaagcaguuuuccugccucagccucccaaguagcugguacugcaggcgcccgccaccacgccuggcuaauuuuuuuuuguauuuuuaguagagacgggguuucacuauguuggccaggcuggucuugaacuccugaccucgugaucugccugcccgggccucgcaaagugcugggauuacaggcgugagccaccgcgcccggccuagucugaauauuuuuaaggcacuucaucacauguuuuccagaaagguuacacgaguuuauucuucccaucagcuguagauaaauauccucaucagcguuggguaaucuuaagaaaauugucgcuaauuuaauagguuaaauaauggcuucucauuauuguuccucaguaucuuuuucugugugucuauguaggaaacuuaucaacaaguuagauuuuauuuuuugucuguuuauaggagacagaucccuuaagcuuuauuuagguaucccuuauauuuacauuaauguauuagaaauaguggcuuaacauauuuuaauuuuuuccagucguaaguuaguuacuuuucaaaaagcuguaguaaaauacacauuauuuuuuuuugagucagagucucucucugucacccaggcuaaagugcaguggcgugaucucagcucacugcaaccucugucucccggauuuaagugauucuccugccucagccucccgaguagcugggauuacagguguuagccaucacacccggcuaauuuuuguauuuuuaguagagacgggguuucaccauuuuggcuaggcuggucuugaacuccugaccugaagugaucugcccgccuuggccuuaaaauacuacauguuuuagucuguuuuguguugcugaaggaguauuugaagcuggguaauuuguaaagggaaaagguguauuuggcucccaauuuugguggcugaaaaguucaagauugggcaugugguaagggacucaggcuacuuccacuccugguggacggugaaggggaaucugugugcagagaucacagggcaagagaggaaggaugagagugagaggagaggcgccaggcccuuucaaacagccagcucucaggaacuaggagaaugagaauuuacuuacccucaccccccgaacuccuugccagggagggcauuaaucuuuuuaucagauaucuacccccaugacucaaacaccucucauuaggcccugcuuccaacauuggggaucaaauuuaggcaugagauuagguggagacaaaccacauccagacuauggcaacacauaacauaaaacgucaccauuuuaaaguaugcaguucggugacauuaagugcauucaccauguuguguaagaaucaccacucuaguuucacacuuuuucaucacuccagaggaaaccuguacccauuaagcagucauuccccuuucucccuugccccagccccuggugaccacaaaucuaauuccugucucaugaauuugcuuauucuggauauuuuauauaaauuaucauacacuauaugguccuuccuuaucuccgaaugcauaaaaagaugacauagauuaaguaaaaguugaauugaaucuguauuuugaaaauagaaauccaucuguggcagcagucuuaaauucagcauauuuaauuggccaggaugucccaugccccagccacuaggaagaaauaguuuauaccaauaguuacugccaguggacagaggguuauagaccuugggguaggauggaaccuaaaauagagacaaagacaggaaaaguauggggcuuagagagugaaagccagugaauggcaggcagcacauuccaugguggaauaaacagaaaacuucuaggcauuuaccuugauuuggagugcaaauuggagaacuugcagguaagugcaaguucuuccgugaucaaaaaaauaaccagccuaaagaaugaauguuugugacagugucuaguacauaagaccuuaguaaaugugcggaguuuugcuuaagagcaagagugguauuugggaugacaaggacaagcagagaggauccccaggcaucucuuucucaguguuugacauuuucucucuuucuuuuucuuuuugagacgagucucucucugucacccaggauggagugcaguggcgugaucucugcucacugcaaccuccgccuccuggauucaagcaauucuucugccucaaccucccgaguagcugguacuacaggcucacgccaccacaccuggcuaauuuuuguauuuuuaguaaagacgagguuucaccauguugaccaggcuggucucuaacuccugaccucaagugguccgcccgccucagccucucaaagugcugggauuacaggugugagccaccacgccuggccauguuugacugggauccuuggguguggggaaauguguuuuuaggugaguaguuuucaugguuccauauacauauauguauagagcuuauucacuauuuuucauaguuaguagguguucuacaguguggauguaccuuauuuaaccaauccugccuugauggaaauuuaaguuguccccauucuuuuguuuuacaaacggcauugacaugaagauccuuuacaccuaagcuuuggaggaaaaaucaccaaaaguguauugcugggugagguugucuuuguguuugaaauuugauaaauauugcugacuugucuuggcccccacugagguggcaccaguugucuugccaucccuguaugagagugaaagauguaauuucaguucauuauggucggugucauguugaagcccacaaggagugaggagcucugaggguggggaagggggaacugcauuaggcuucacagaguuggggaccuuuucgaggagucaggagcauucuagauagaggaaauggugugugugaagacauggaacuguuauguggagagaaaagggugaguuuggguuuggcugaggcagaggguggguggguggcuguggauggugagguggggacaguaagucagcuagguuagggccaggugaugaaaugguuuaaucaccccugguggucagguagcaaagacccugggcggcaguggugauggggcuugcaggugaaagauacuugagagagaauguacgaccagucuuuuuagcaaucuuuuuuuacccccgaaaaacuuucuagacuuguuagaaccagaaucacaaagcugggaagggcuuuagugcagggcuuuucuggugcucuguaggcccauagggauucuuggaggugucacagacacuagguuugggaguacagacaggcauuugagacccccuccucuacccuuauuaauuaagcaguuucucauuuagucugcuuuauauggugggguucuaugcaauauuucuuucuuuaaaaagaaaaaaaguguuugcugcuagaaucaugagucuagucccaaacucuuacuguccugaacacagauggaggccugugggacacguuuucauucuuacauucuucguuugcagcagugagaggugauuuguauauaaaaaugaaagugaaaaggcauuuggcauucuugggauguuuuugagcauuuagcuaauuuuuuauguaggauuuuuauuuuguuccuuuuuuuuuaagcucauugacucaccagugaaauaucuagugaaauaguuuugcucauuuauggaugagggugcuaagggauuuacauccauugaugucauucccauagcuacuuggugagggggaguacuguugaaaguucauuuugcaagugaagaaacuugagcuccgagagguuagguaauuugcucaggggcaagcagauaaguaaucaggaagucaucauuagaugcgaccugcccugauuccacagcccacacccuucaguucaugcuaaggccuucccaggacaagcguacccagccaccuguuggggguggaagggcccaggaagaagaaggguguuggauuucuggucagucuuggcuuugggcuggugccuguagaaggggcagagcugagagacggacugagucacuucuagcaaaauugguugagaaucgugggacgggugaugcgugcuugcugugcggggauugaaggcucauggaaaaccccauguagaguuaucaucuucucucuccagggaugugagcaaggccaagguuauuggccgaguaccuguuucauuucaccugugcaccgacucccuccagaaaggcgccaucugcuuucuugcugcucacugccaccacagucaccacuaccacuguuuugccuuucuaauccagugccucgccagugggguggagggauggaacuguguauaguuccaguauuacaauauaguuuuuuauauuguacaaguuuuaguuuauuaguggaacccgggcacaugaaagucccugguuagagaguugcuuugcagcgucuucucccuuuguggcuaguaaugaucugcggggaugggaggagcauugagaaccuauuggccaugaagagucacuuccucccgacacagaucucugcuugugcagcgcccccacacuuccugcguaaugcagugcccucagagaucccccagcagcugccaccccggcaacauuaucuauauuugcagggauacuuaaggacccuuuggcaauuggcagugauauuuugagagccuuugaggaacgugacugaacaugaauuuuaaaaaaguauaaagguggcacuagguguauucagagggacaagcugguggcaacuuagggggacuuugccuuuauaaaaggagacccacacauggaguuuacguaagaagaacuuacagugagggagagaugacuguaucagccaauacagaugaagaaugcuccaggagcuugcgggguuugcccacagugccacagacuagacucaguagagccaggacuggcucuaaucugguacuuucucugccugccaugcuuggcccuguaccccucaguggcagcacuguuucccauuagagaaaacaaaccuguuaguuuucucauugcuuauguagaggguaaccuuccuguguccccucauucuugcuuuagccuacauucagggggguuuugacugcacaccaggugggagcaguauuggggcacauucuucugguccugucuccacccucucauuucuuccuuuccauaggagugauuuaucugauugguacaccagggagagccucacuccauugguccacaucuacccagugugaggucacugcaucagaacacugccuggcuuugugcuugaacucucuccccugcuuacccuuaagagaagccuguccuuagcuguguccuaccuuccuuuuguggcuagcaccauucuuugucccuaggucuggaggcggguggcaaggccaacuagaaaugggaagggcgaggcauugcagcuuugccauugacaaagaggaugguagacuuugguuugcucuugguuucuugagacuuuauagcaaccgaguggaaccuggaggggaugauuaugcuaccccaguucccaguaguaauguggucuagagauuuuuaccaaagucaaauaauauuauaacuuuuuuuuuuuuuuuuuuuuuugagacggagucuugcucugucacccaggcuggagugcaguggcccgaucucugcucacugcagucucugccaccuggguucaagugauucuccugccucagccuccugaguagcugggauuacagguguccgccaccaccacuccuggcuaauuuuuguauuuuuauuagagaugggguuucaccauguuggccaggcuggucucgaacuccugaccucaggugaucugccugccucagccucccacagugcugggauuacaggcgugagccaccgcgcccagccauuauguuaacuuauuuaaaaugccaagucuaccugggaauaauucaggaugaaggugguuuuacaagagacuugcucuuaaauagcacaggugguaauagcagcugaaaugaaauuacucaccugagcaguagcguuaaucaucauguuagauuugcagcaugcuuuuauagugguucgucaguuucauacucauucauuaccugaugucauccaaugccagguaaagccagcucauucaucauccuuaaaacccuuggagcagaacuccucugugcuuccucaagggguguaggagcugucacugggcaagagcucugguggccugccccugucuucacuugacccacagcuagcugacuuugggaggaugcucucucucagcuucauuuuccucauuguagaacaagauuggacuugcugugcucugggguuuguuuacuucugucuuaagauucugugaucguguuuuagcauuucuugguagcuugccuuguguuaaugugcccaguaaguaucuuuugaguuuaauacuaggcaugcagauauaaacauccauccuccugggauauguaccugggaaagggaagcagaugggacugugaagacagagccuacucuuggcuguauuacuuacuuuagacaguuucugcagaauaacuauuuuuaucauuuacuuuuuuuggcuguuuaauuaagccuucugacuggaauauaaauaaguauauaaaauauauguauuuuagcuccuaguggauaugguuuguugcccaaccaguagaugcaaacauuuuaaugucuaggcuguguaacuguggugaaaauaaaccuggcaccugagagaauaauucuuuccuauuguauccuuuucuccauuucucuuucccauaugccuagcuagcugggagcagccaggggcaagguagaggguaccggccaguggaugguauuuuaaaaacuguuuauuucaaaaugauuucaaauagaaagauuucaaggaauaaguuauacaaagaucucucauacccuuuacccaaacucaccuaccguuaauauuuuguccuguuaacguuauuugcacguucccucuuuauauguauauauagacauauaugcauguacaugcauguacauucacacacacauguauuuuuuucugaacaauuuuagaguaaguugccuuugucaugguccauugcccuauaucauauauuucuuaauaggggcauucucccacaugacuaugguacaguuaccaucuucgguuaauagaacauugauucaguacuuugaucuaaccuacuaccaccuguauuccaguuuugucaauuggcucagucaugccuuucauagcauuuuuucccuccaguccaggaucaaucuguggucagguguagcauuuacuugucaugcucuuuagucuuuagauuuguuguuuaaaauuauugaaaccaggcugggcacgcuggcucaggccuguaaucccagcacuuugggaggccgaggugggcgguaucgcuugaggucaagaguucaagaccagccuggccaacaugaugaagucuugucucuaauaaaaauucaaaaaaaauuagccaggugugguggcgggcaccuguaauccgagcuccuugggaggcugagacacgagaauugcuugaaccugggagguggagguugcagugagcugagauugugccacugcacuccagcugggcgauagagcuaaacucagucucaaaaaaaaaaaaaaauaaagaaagaaacuggugcaccucuccauugguagcugauugaugagucuuguuuuuaugcauucuccaauacuauguggaugagguuucccagcauaaaacguaccauccucuguauacaaagauguuuccucuaacuggucuccauggggagaaaauaugcugcuuccauguuaucacugccacagugggaucaguugaacuuccuggcccagacacccggcagucaucuugcuucuaacucuugguccucagcaguaauuagaggaagagacagacaaucugacugggcacuuugugcaaacccaagaaauaauagaggaauguucugccaucgaucaacuuuaugguaguuuuagauuaaagcagaaaagugcuuuuuaaugacuaaaauuauguuuagaugcagccagaguguauguuuuaaucaaauauuaaaugucugugugaagauauugugcaaaguuaugucuagaucuaagcugcagacaagaaaacaagaagccuuucucaugcgaggggaugacuuuguuccagauuguguuaauagaggggugggcgcgccugcccagccuuagcaguccuguuacaugcugugguugucuguuugcuucaguagaagacauuuuuuuuucuccugcaacucuuguacacaauguuuagaaugaauuacaucaauguauauuuguaccucggucuucccucugcuuggccuuacgcuguccuaucacagucaggcuaaggaaaggaacucacauggguguggcuggggcugagauucuggcuggcugcucacuggcugugugucuuugagcgagucauccagugucucugggcuucccugauugcccugcugacugcuagacuguggagggucagugggcuucaccacuuuuucuuuuuuuuaaauagaggaauaaagugagauuuccacuucaauaugcugugcuuuuuuuuuuuuuuuuuaaaggaagugucagcugggcgcgguggcucgugccucuaaucccagcacuuuuggaggcugaggcaggcggaucgcuugagcccuggaguuuaagaccagccugggcaacauggcgaaaccccagcucuacaaaaaauacaaaaaucagcuggaugugguggugugcagcuguggucccagcuacuugggaggcugagguagaaggauagcuugagcccgggagauagaguuugugccacuguacuccagccugggcgacagagcaagaccugugccuccagaaaacaaaaggaaaaggaaaauaucuacgggcugggaugcaaaagagcaguagugaccggagggagagaugggaggaagcauuguucugaaugucguucuccugacuggggcuuccuugaugcacuuuucuagcuuucuggcuuuuugagcugaaugacuucaggagggggauagguagaugucacucgcccugguucccaugcauguuauuuuaagcuuaguauuucaucucauacuugugugcaggccuacaggucaaagauuuuuuucucuccuuuuuuuuuuuuuuuuuuuuuuuuuuuugcaguggugaaggguguagggaagugagagugaugaucugagaguuuagacaucuaugguaauccuguuagcuuucagagaaaguuuacaugaguuugaauaucuuugcuaaucgcauguguuguaacacaccggauauguuuugcauacuuuuuaaccuucguuggcagcagggauagaaucacuuuucuucgaaaccuuuauauacagcaaauaggguaaugacacuguucuagauaugccacagggauauuugaauggcacucugggauacuaguccucauuuuguugagguuugguaucuaugagcccaugaaccugaauauaggagacccauaugauucaccuccuaguagauuauacaaaaugaggcucugggaaaggauggcaaaaagcuuaauagaagugucuuuaaaaaauagucauuuuuggcugggcauguuggcccaugccuguaaucccagaacuuugagaggcauaggugggaggauugcuugaaccuggggguuuuaagacuagcuugggcaacauagcaagaccccaucuuuauuuaaaaaaaauuuaaaaaauagucauuauuccccaagauuaauuuuguaaaaagguuaugcuuagaggggguuguuuuagaggccauuagguaacauauuacagauuuaaucaggguuugaggaaaccaccuucuagcugcuacaucuuagggaaaagcaccuuauuauccaccuucagucucaguguuagcagucuccuguuuuucaacacagauugaaucugcgugugagcagaagucugcuuauggucagaacccuuaaaggggaaaauguaaagagucacauguaucuucaauuuggaggaauuaccaguauucuugagaaacugaaagugauaccaacaguuuucuuguuccuuuuacugucuugaauuuggucuuuaagauaguugagccaccagcccaugguagauauuguagaaaauacagacauacuagauagagcaucuuuccagacaguugauguucuggguagagaagccuaauaucuaugacguaugaacagugacuuucagcccacacuucaugccugacauuguguuuacuauguauuuuacauuuuauuuaauucucagaaugacccaauauguuagguacuuuuacuguccccacuugugcacaagaagaaacagugacacauuaaauaacuaggccaaggucaagcugcacauuuggauucaaacuuggggaaccugacccuagagccugcauuuuaaaacuuuugccauucugaaaugaccagagaacagcaccaagggcaaaauucuguaguacugauuacaagacaaagacacaagauguaaaugaccugaucuguacuguaaucuguguaggaaaauucaugaagguuaaacuauaaauugcagucucagaagcaaaugcaggauggggcuagguacucgcuuaugagaccaugaguguucagauuggaguggcuuccuauggcgagugacauugaaucaggcaugcuuuccuucuuauccuccuaguaaacuuccuugcucuucaaaacccaaaucaccccuuugaagcuuucuuuccuucagauagaguuaguuuucucuuuggucuucugaggcuguuuauauguacgccaggacuacaggauguaacugcuaggccaccuucaguucuuugaaguuagggaccgucuuacucaucauuguaucccaggggcuuaauuuaagcaauaucaguuacuuagugaguauugaauucucauuucuccaacaaauagcugaguugcuuagucacuccagaauuaaagcuagguuuagaauaauuggagcggugugauggcaugugccuauagucucagcuucucaggaggcugaaguggggaggaucgccugagcccagggguuugaggcugcagugagcugugauuguuccacugcacuccagucuggggugauacagcaacacucugucucuaaaaaaaaaaaaaaauuaggcugaaugcagaggcucccaccugugaucccagcauuuugggaggccaaggugggaggaucacuugaagucagguguucaaccccaaccucggcaacagagcaagacccaggcucuacaaaaaugaaaauaaaagccagaugugguggcaugugccuguagucucagcuauuugaagcugaggcaggaggauugcuugagccaaggaguuugaggccucagugaacuaggaucaugccacugaacucuagccuggcaacagagaccaugucuuuagcaaaaaaaaaaaaaaaaagaauaacuggggcagaaaaaucuauauuuaagagaauuuaucuggcgguaaaguacuguuuggauuggaauuggaaaaccuggaaaccagguaaaagcaauuauaguaacguaggcaggagaugauuagggcuccguagaaauaguggugagggagaagguacaaaccugcaaaagagugagaagcaacaguccgcagaccugaugguguuugcuguggauggagaauauggggaagaagcaaaggcgaucucaaauuaugucacccuucugcuucuuccaaguuuuaauuuuuuuaggugauuaugggucuugguggacuuaguagucccuuaauaaaugagucaauggcauagaucucugaacugcugacccaugagcagcaaaguaaaaggagcagauaaagucagggcaggcacaguugcaagcuuaucaccuuugcaguuuuaacuguuucuggaacagaaaacuuggguuuguuuuagaucuaugcagagcucuccaagaguauauucugagccaagcuuaauucgucauccugcccaaggauuuuaaguguaugugccauuugcuauugaggugagccaaguaacucuuggggaagcauaggcuuaugggguuguaauaccuugugcugccauccuggcagcucugaagacaagagaugguuccuagaaaucaggagccucaugcucacacuguuaccugcaggcuuauugccaguccccagagccauaguugugcugauagagcuaaaauacaguuucuaaagagucugauaacaccaaccuggacuuuagaaaugaggauuuuaaaacauuaaguguuuaaaauugcaguauauauuuacacagaagcagauaaauuguaaaguugaucaucuuuguguaacuaacacucagauaaagaaauagacuauuaccagaaucccuccuccuccaagguaaccacuagucugauuauaacaccauagauaaguuuuacuuauuuaaauuauuauuauuauuauuuuuuaagaggcaaggucuugcucuguugcccaggcuagagugcauuggugcaaucauaccucacugcagccuugaacuccugggcucgagugauccucuugccucagccccccaaguagcuggaauuauagaugugggccacuaugccuggcuuuuuuuuguuguuguuguuaaaauuaauauaaagugaauaaugaaagguuguguuuugguuucuuucacucuacauuguguuugugagauucaucuguguuguugcauguagcaauauuaauuccuguugucuuauaauauucuccucuaucaagaaaucacuauucauccauuccaguggugacggauauuuggguucuuuugacuuuuuggguauuguguauaauagugcugugaacauuuguguauguuuucguuugguauacauguaaaaauuucuguuggguauauaucaaggaguagaauugcagggucauaagauaugcauauguuuagcugucaguuuucuagagugguuguaccaguguauacucccaccagcaguacaugcaugugcugguugcucagccuccucaucaacacuuauuauugucagucguuuaaauuuuagccuuucugguagauguguagcacuaucuuauuuuaaauuuguauuuuccugauaacuaaugaggcugaacacuuauuuauaggcuuuuugaauacccucuuuuauaauuaauuauuugccuguccaaaaaaauugaaguccuuugucuuuuuuuuuuuuuuuacugauuuguugaaguuauuuuaugcucugauaugaguucccuguuuccauauugcagauagcuccuauuuuguggcuuucuuuuacacucucuccauugugccaucugaugaacauuucaacuuaccagucuuuuccuuuaugguuagugguuuauguguucuguuuaagaaauuuuucccuaccccuagcucgugaagauacucuguaucuacaauccaacuggaauuuuugugugugaaugugucucacuuaguuuuaaacuuaucuuaccuuuccuuaguuugucaagaucugucugaggcuuaaaucccaagcacaagguaggaggcagucagauaaauuuucuuauucuucauaaauuaaugcagcgcaggagauaaaguuuuugaauagccuuugggaauggaagccuugucucccuaccacacgauggcacuuggauuuuguuuuauguucuuugucccuuucauuacuugaaaguguaaucugcuuggaguauuaccucuuccucacuugcaguuaauuccuuaacucacccaaucuacuuucuggcuucaccacuugcuugaaacagcuggccaagguuccgguggcuuuguugccaaacgggagccagggaauucuccaguauccuugaaccaguauccuugaaugugccuucuaugucuuuucuaccucuguucugauugugugauguuagcaaauucuuggccuccugauuuuucccgccuauacauuuuacauagcuucauuuugaaaucuagucugaaaagccccacuagauaugauugggagaaagcccuuaaaccugagggcaugagucucuaguuucaaaguaggccugaccacuuuuguuguuuugcuuuggucuguuuucauuugguaucuaagaccaaauaaaaaugagaucagccauaacuacagauuagauaauuccuuaugguuuauguagcaguuuuacauggaucgccugauuggaucucauaucacccugugaggcagguauuguuguuacagauauagaaaugauuaaaaaugcaaacagcacuuauuuguucuuguugagaaacaccugguaaugccccggauuugguuuuggagcuuccuuuuucauguagccaucauuuaaugggaaaaugcaucuggguuuuuuuuuuuuuuuuuuuuuuaaacuagugaaguguaguagugagaacgggggaaagaguagaacaaggaguuggaucuguaacugacugcaaacaguccagugagauaacucaguaccuuugggccagcccaucugggauucuuaggaguacuuuuguccuuccacuuucugcaggaacuguaacuucuuggguuggggcagagaguaaaggguagaugggacugggaaugguggcagaguuggauucuuuuuggagauuaucaggaacuuuccaguaaucauuuauuucucagaucucuuccucaagaaucuaguacuaaauaaaugguggugguugauugccuggaugugauaagcucaaguuugcugcaggaucuacuuuaaaaugauucaacacaagaaguuauggagagauaugauuugcagauguguccuuaguuuccaggaacacauuuuggcuccagaagaacuauugauuuauuuuaacaugugcuauuuuuuuugauucuucugcaucuucccacagccuuuuuauuuuaaauagcaaauccuuuuuucaaaugaaauggcacaccagacucgauuuaugaaacagacuacggcguucuuuuauuauguacacucauuuuagagguuugcauuuauagcauuuauuuauaaagucagugagaacagugaggcuguuuugaucaacacaaacacuugaaacauuuuagaagauugcagucuuauuuuagcuucacuuuucaguuuauuuuuggguuugaaaaaauagauaguuuuuaauaaaacagcuuggcuugcaagccaaggauauuuuuuaguuaaaccgauauggaagucugaaagaggaguagggggcuaggcuaaucuuuauccuaaauacaaaguucagggaagaaagucucucucacucacaagcgcucaaaguauuguacaauaauucaucauucagugugucgcaguucaggugucauugcagagccaucauucugugaccucagugugggaggaacguggcccuguguucuguguagugagugcacuuguguguguugguuggugugcacacgcuuaugaaucaagucugauucagccucuguaauugguacugagaagugcugguuuuuccucagagaugaaaauuuguuccucagucuucacaaagucaaucacccgacggaggccgcugguauacuacaguuugacaugugacacauuugagugugggcuuguuguuuuaaaaugcaguuuuuauagucaggucucaguccaugguugauggagaggauauggggaagggagauaggugggaagaaagaaguuaagagauaauuaaauaaucacaacugcugcuggcucuugauuaugucugggguagaauuauaccagugaugacucaaaaaugguuugggaaugguuaccuuuuugcaggcagguugugugaaggaguguuaacucaaggucauuccugcgacuccuacuugaguaagaauaaaggaaguggguuuuggggcuccauaugaaccccaaagggaggggauggguacugggggccuugagcugccucuccucucauuuccaaccugagcaguucugcugagagucuggcucucacugugggccugugguuuacaggagcuaauuuugaaucccuaguuagcuuggcucucagcugcacuuuaaucucuguuggcugcucacgugagauugagaauugacuguaugacuccuggaaugccuucaaaaaccuccaagaauccauggccaguugcagugaaugacucacacuuguagucccauugcuuuggguggcugggaugggaagaucgcuugagcccaggaauucaaggcugcagugagcuaugauugcaccacuauacuccagccugggcaaacagagacccugucucuuaaaaaaaaaaaaaccacucucccugguuaccccccaaaccccugagaauccaugaagcuguuugauauaagugcugugaaucaaaauaugacaaauuauucagacacaggggaaauguaucagggaugaauagucuaugaggaguucuggccuucuugaaucucucugcucugcccauucaggaagggccaggggcuaauuugcuuucaaucauuauuccagaguugaauuuugaauuuccccuuuucuuagcauacauaauugaaaaucagcugcacaguagcaugaauuuauagaggaugcaacaacaacguuggguuuugagccagcugggaaauucccuucaguuuuuucuggcauauaccaugcauuugaagaauguugaaccaagauuuugaggaaguaaauugcucuugcuguugaaugugaccuagaaggaacugaggaacaguggaacugaagaugcagcuuauugauuuuuuuucaaauuccuuuguuaggcaucugaagaagccucucucagggcauuggaaagucugaugacagaauuuuuucacgauuguacaaccaaugaaagaaaacgugagauagguaaguggagcauugacuuguaaagaggaauuuauaaugaggaggcccugguagggaggaaggaguuguucguagccgugacuggucaagucugcgugcuuuccacuugaauucuugcucuuuucgcucugguucuguuggcugguggcuggggaaaccccuccacuugaccaaaggaaagaaaauccaucacuguggaucuuaauuucagcaauguuguugaacuuucauauaagaagccugcgacuuuuuggugggggcgucuaggguggggugggacagggucuugcuauguugcccaggcuggucuugaacuccuggccucaagugauccuuccaucucagccuccugaauagcugggauuauaagcgggagccacugcaccuggaugguuauuuaaagagaaacaguaacaacucaggaaagugucaaaaugaacauguuuugcugugcagacgucugaucugaaccuaauagugcccagaaaucccauaacugguauuacuuuugggggcuucccacugccugggcaauguaagauccugucucaaaaaaaaauuuuuuuguuuuguuuuugagacggcgucucauucuguugcccaggcuggaguucauggggcgaucucggcucacugcaaccuccgccuccuggguucaagcgauucuccugucucagccucccgaguugcugggauuacaggugcccaccaccacccccggcuaauuuuuuguauuuuuaguagagacgggguuucaccguauuagccaggugggucuugaacugaccucaagagaucugcccaccucggccucccaaagugcugggauuacaggugugagccaccgugccuggccauuagucuucgauauucugacacucuacuguauucuuugaagucuuguuuuagauuauaauugaaaugcuuuugauucuuuuaauuuuugguuuguaaaucaaauauuucucaccuucuauuucaugaauuaaacguagaaccuucugaacauguucauauucuaaucugaucuuaaaagagauuuaaguagccaaaugcuccagaugccaaauuugagugcaggcugaggggaauccagggguuuguuucuauacaguaggcuugucuuaguucaguucucuuuguaccuagucauuguagcuuuauuugaguguguggacuuggacuacuuauugcuucuuuucuauggucuugggauaaacucuaggcuuuuccuaguuuggucagagaaaggaaggaagccuuuucuucaaagggcuccacccacccuccagcaaagguaaaucacuagugcucuagaaauugauagagcuguuagcagggaccucgagaccauguggucauuguagaguggaggaaacagaagcaucaagggggagcagugacucaccuggggucagacucagagucuagaacagagcccagaguuccucaguuccagucugguuugacuucacuuuggggauucacagaaaccuuugcuuaauuauuagggcaggcuguuagcuuccuuuuauggauuuguaauuaacuuuuauuuuuauuaaaauaauguuuuugacuaggcaugguggcccaugccuguaaucucagcacuuugggaggucaaggcggguggaucacuugagcccagggguuugagaccagucuggguaauauagcaagacuccaucucuacaaaaauauguuuccccccuuuucuuaugucuccucaggaaaacagcaccauugagugcuauggcguccuauagagaacuucagucuuuggucauagcauuaagagcucaugguuucauagccccacgagcccucuuugaaaugaucuaaaauuaaaaggcuuggauuuuuuuuuuuuuugaaauggugccucacucugucgccaggcuggagugcaguggcgcaaucuuggcucacugcaagcucugccucccggguucaagcgauucuccugccucagccucccaaguagcugggacuagaggcacuugccacuacgcccagcuaauuuuuguauuuuuaguagugacgggguuucgccauguuggccaggauagucucgaucucuugaccucgugauacacccgccuuggccuccgaaagugcugggauuaacgggcaugagccaaugggcccggccuuuuuuuguuuuuuuuuuuuuguuuuguuuuguuuuaagagauaggauuuugcucuaucacucaggcuggguguaguggcgugaucauagcucauugcaaccucggccuccugggcuaaagcuucaggcacaccaaagcauguucauuuugacacucuccuaaguugucgaguuuuuuuuuuucuuuaaauagccaucugugcguggugucucaugcuuauaauccuagcuauucagguggcugagacaggaggaucacuugaggccaggaguuaaagaccagccugggcaacagagcaaggucuccuccugccucagccucuugauuaacuaggacuacaggcacuuaccaccauaucuaguuaaguuuuucauuguuuuguagagacagggucucaguguugcccaggcuggucuuucaacuccuggccucaagcaguccuccugccucagcuucucaaagugcugggauuacagaugugagccacugugccuggccuuuccauggauuuuuuaaugagacugcgucguugcauuuagcuuaaguuguagggaacuagcagagcaaugacuugaggauuagaagaagcugcuguguguucugcuuuuccaaaggcuuucuagaaucucucaagguugugggccuuugcacuuuuacccuuuuuggauuauauuucaugaccagugcagcaggucaaggugacuaagggacagcauguccagaaacaugaugguagccccguaaugcuugcugccuuguggguucuggcugaugccaucagcagccucaggaggaggaaaaccguuucuaaccaacgugauguguggacagggcuacucgccgcaacacucgucaucguugcucuugccaccggucgauucacuuuuuugguggcaguguuuuaaaauaaaaccaacccaaaugaagaguuagccguuuugaauucucuugcauuuuuuuccuuuccuaucuuuguagaauuagucuuaaucuuuucuuuuucugccuuucuagccgucauuuugugugugugaacaauguaggcuccacugaagauuuguagaggaauggcgaggcccuagaauguagcucauauucagacgaaguaaguuagcuagcaguuuuaagaagauggaaggguacucuuagaacauuccagccacacauuagcuuaaauaagaacuuuagcagugaaaguuucucugccuagagaaauauccauagcgagguuauuggcuuuuagguggcugaaaacauugucaguguccauggucaccucagacgcagaaaaauauuguaugauuuauucuuucuaucuuaaagaauccgcugguuuugacaucauuuacauuauaugcagagagacauguuuaaauaauaauaagauagcccagucuugucuaauuucauguauuuucauagcuuucuuuuguugccauuuaacuuuuccagaggagcuucuuaauaacuuugcccagcaaauaggagccuggagauucugccuguacuuucucuccagcacuaggaaugacuauguaaugauguacaguuuaacaguuuuugagguaaguugucaguaauuuuauacucuucugaaaaggauuuuguaguucuauugccauaucauuagcacuagacuagagcuguaaugugcugggagaggguagcucagcucugggaugucgucccacauacugucuuuauguaguugucugguguuuggggcaucuuccaucuuccacacuagaaagguaagauggaugguugacuuuaggguuaaguagguaggucauuugugguaacauguaacuauucccugccuguuaucauugauaaaggaaagauaauuaaauaaaaacauuuuaggaggagaaauaauaaccauaauaccaucauccccaacaacaaaaaguuuuauuuaucaccucucuuccaauccuugucuucugugccccccuuuaaaaagccuaacuguaggccgggcgcaguggcucaugccuguaaucccagcacuuugggaggccgaggcggguggaucaaugaggucaggagauggagaccauccuggcuaauaaggugaaaccccgucucuacuaaaaaugcaaaaaaaaaaaaaaaaauuagccgggcgugguggcgggugccuguagucccagcuacucuggaggcugugguaggagaauggcaugaacccgggaggcggagcuugcagugagcugagauugcaccacugcacuccagccugggcgacagagcgagacuccgucucaaaaaaaaaaaaaaaaucuaauuguaaucauauugcccaugcuauuuuguauucuacuuuuccccacuuuauuuuauauccccacaugugguuaugacauuauucaccaaggcaugcuccuguuuuugaacauugaaguugcuucugucauuauauuuugguggccauuagagacagugguguaaaaaaguuuuugcacauacagcuuuuuguuucuguuauuuggcaguucuuccuaggaaugggacuguuguguccuaagauuugaauacuuuuauuauucuuauugccauauugccccaaaccuuuauuuaaagagggauucuuguuuauugaagugauaauagcuaccugugggaugaaaagcaguuauuuuuguguauagguuguuaacuuaaaagauguauauuuguuuuucagaaucugaucaauaaaauguggcuuggggucccaucucaggauaagauggaaauccguagcugucugcccaaacuccuuuuggcucaccauaaaaccuuaccuuacuuuauccggaacaagcucugcaaaguuauuguugauauuggacgucaggauuggcccauguucuaccacgacuuuuuuacuaacauuuuacagguaaggauaugccuaaggaaacuuuaucuugugaauaguuuguuuguugaagugauuauuuccuuguccugaagaggacuuuuaagauuagcaguuuggaacugcaguagugagguuauuguaggacugauuaucgcauucacuuuauauuuauaagacauauuguaucuuugugagguggagaaagugggggagaaaaacuuaaucucuuuuuaaccucuugugcaguuuguucagccaguauuugaaagccuguuaggugcuguacuagguguuggggguacaagggugaggcuuucaguaguuucggcguuuagugggggaaauagcugugcaaacagugauuacucaacaauaugguaauuauuguggaaguauaugcagagugcuaugguggcauagcauguagacuugguguuguugggcugagaugugagauggugaaguggcagaguaaggggcuagauugaugggcagaggccaggccaggaaggguugggggguuccauugugcaauucguaguuuuuccuagggagcuaaugaaaaguuuuggggagggagaaaacauggcuacauguuuaugguggaaugauggcuagcuggggucuggauugcagaggggcgaggugagagggaaagaggcaggguguagaggaucugagccaaaaggagacgaccugguggguggaggugaggcacccaggggaugggggcaggaggccagugacaauaggugagaggggagagaagggaggaaucuagaaugacuuccaguuuucuggcucagauagauuuuucaggccaggguugaaagaaggggaaugaauuugggcagaagauggugaauucaguuugauagaaaaugcauuuaaaauuuguguguuccuucuuuguaauaacuaaugagacauuaggaaguguggaucugggaucaggauuuggaagucagaagggaguaacugggaccuaaaagcuacgagggagaugcuguugcucauuugaauccugugaucaaguuggaaacauuuucauguauugagcuagucuuggguaugcaggaaguggguauuauauacaguuuauagaaauaaaguucuuugaaaauuguuuauagucucagugacuguaggauuuuccagaacaauaucauuuucuaauguucugccugcucuucauacaaaccauuuuaaugaugcagcaauucaaaaagaauucagcauccaaagugcuucucucagauugucucucaaaggggcacaaaaauucuucauuuaguuuuguuuuguacagugcuucauuuaucuagagauuuauuggguuguuacugcaaaggagauucaugccuuuauucaaguaaacuauuuguugaacacuaagcacaugaggggauauaguaaugaacaaagaccaagucccugccuuccuggaauuuaugaucucagggcggggaugagggcaucaacgaacaauaaacagguacacacuuggagguauuuauaaguaugaugagaacucaauccagggaaggggaaagaaacuagcggggguuguguuuagaugggaugcucguagaaggcuuuucuggggacagacauuugagcagaaaccugagugggggugauggcgugcaccacguggguaucuaggggaacaguauuuugggcagagagaauaggaagugcacaggaccugaggaauggcaagcaggccaguaggccuggacuggggggacacgaggugggagacacuucccuggcguucuguccaauacacuugccuucaauccaaguugaggacgguuaugguaacccucuccaaggcucucuuaagugggcgucagggaagcccacuggagacaggaaagaccaagaggguugggagucuaagugaaccuauuccuggguugguuaguggugcguccugugacaagaagagagggaccuugagacggagagucacaggccugaugauagcagguaagguggagccacaguuccaccgcugggauuggucccuuugaugaagaacagaacguuuccuggcuacauuugaaguauaauuauuuguaacaaaagauggauuuggaagagagcacuuuuaggugaagggcuucuggagguuuaaaaaggcuaauuguccacuguucuccaccaccucccgcuuucaaccccuucaguauugacuccuuuaaccucauguagcuuucgugacuuugaaacaccauguaguagaaggagccagacugugaggcagcagguuuggguucugcacccaacuuuguguaaagucuucuuuuucuuuucuuuuauuuuaauaaauagagauagagucucacuauguugccuaggcuggucuugacuucuuggccucaagugauuuuccugccauggccucucaaagugcuaggauuauaggcgugagcuacugccccuagccuaaaguccccuuugauuuuagcaccuccugccacuuagguaagcuucccuuucuuucuuuguaaaaugagaggguuggacuaagugaucuuugaaauccuuuccaguuguguuauguccugcuucuuauuuauucuugugaacuagacaauggcauauaagccuugucaagaaugaucaguacucaaugaucagugcccaauugcugacauuucugauaauauaguggaguuaucccucuguauccgugggggauugguuccaggaccuccuuggauaucacaauucauggaugucgaagucccugauauaaaaaggcauaguuugcacguaaccuaugcacauccuuuuguguagguuagaccaucucuggauuacuucuaauaccuaauagaagguaagugcucuguaaauaguuguuauacuguauuguuuaggaaauaaugauaagaaaaaacuauacauguuuacuacagaugcagccauuuuuucuucuuuuuccugauuauguucuaucugugguuguuugaacccuuggauacagaacucauggauauggagggcuaacuguaaacauuuucuucagguauugguaaauaaugccaaacugguucuggaauccauuucaccaucacuugauccuuugaguaaaucaucucaaggguuuuuuuuuggcucauguuguguuugcagucuggggugcaugguuuuguuuuuuuuaaacgcugugacaguuuguugggugguaucuaugcaguuuuuguuauaauuguggugaccaccauaaccagauagagagggguugauuugguaacccagccuuacgugcgguggguugguuauacccuuucuaggcuccuggagaaguaaucgaaauugaaaccgaccgcuuuccuucccaccugccugcauauacgucagcacacacauaacacuaaugguucuagaaccuguucuucaaauuccugaagucuguugagcagaaccuguggucacauuguacguggggcuagagacuuaaggggcaagcagcauaggagagaauugcuguuucuucuguugggucguguaauaaaaacaauggaaccuuuucagaaguucacgcuagaaaccugaacuuguucuucaaccugcaggagcuuauugucuguuaaauugcagagauuaccuauguuacaggcuuaaauuauagaugugaagaugguaaagggagacacuauuuuaaucaaaagcuuccuggguacaaagcuaaugagaggaaaaauuauacauuuuaucaagcucuuuuucaaguaaagaauagcuuucuuuuuucaucuggcuucuugccugaccuucuccccuuccccuaaauggugagaggaaggagagcuugcagauagauuuuccauaucguaggggauuuuuauaucugggaagcacagcauuucauauuuauaggaggguguauauugccaaaugggauauuuggcauuacgagucauuuccagcugagagaguaaggaugcagccuggaggggaaaauagagacaaaagagguagaggagaaagaaaggaaaaggaggaaguaaugggaaucuuuuagaauauagacugauaagccaaaggucuccaaauggaaagagaugcuuaccaaggaucaguucuauuucauugugugaagagaaauuuccuguccucccuacacugcaugaucugaauuuaagucaguguuagaaauaggcccaauuuguagaaaacgaagauaaaaauuguggagaauauacaaaguuuuaguguucaagagaccugaauuuauagagagcauuuuaaacacaucauucauugcugcugguuaccuagugcugcuucugaagacacuugaauuuaccuuaaguucccauuauugaguacuuguccuguucuuuaggggugagcuuuuccuugcuuugugauagggagaguuauuucuaagggaaaggaauguacccuguauuucuuucuuuuucuuuuuuuuuuuuuuuuuuuuugagacagagucuugcucucuugcccaggcuggaauacaguggggugaucuuggcucacugcaaccuuugccuccuggguucaagugauccuccugccucagccuccugaguagcugggacuauaggcgccugccaccacacccggcuaauuuuuguauuuuuaguagagauggaguuucaccauguuggccagguuggucucgaacugcugaccucaagugauaaagugcugggauuacaggcaugagccaccacgcccagcccguacccuguauuucuugaagugaagaauauaaagucuguaugggugcaguuccugaguguucugcucuucccuaaaguuuauauauuuuuuuagcuuaaguaaaaaaaaaaaaaaagugugucagggaauuaacuacauuuaaaguuaagauuaaggaaaaacuugaagugcuuuucaaauugucugcucuuuuauagauuguagcaauuaacucaacagauaauuuuaguggcaacuuguuuacuuuuaucauuucuggaaauuaaaaaauaaguguaauaguaaugcuuugaauuuuguaaaaaugauuaggaagauguaaguagugcuuugcuguugaaggcguacuuuuuuugucuuguuuaguuaaacuuucuuaugguagagagacuauuacacgugauagaaacagcaacuuaauuugcuacauggguauuugcaaaauccuaacuaaucuuaguuuaaugacauguauguaugguguugcucugcuauauuuaaucaugaacuuuucugaagcaugcaaaguuuagaaguguaaaguugauuuaacaacaugcauauugaaaagacaucacaaauugauuuacacaucuuaaucacuaauacagauauaauuuauauacauacacacacaaaacuuggcuacuagacaaaguaacaaaggcuguguuaggaaucuggacauguauaaaaauugucauguuagguauaaaagaccauuguuuucuagcuguuuuuaaguucaugguauuagaauuuuguccauaaaauaugaugagaauguauuuugaaugguuaaaaagagcuaccuaaauauccucuaagugauguuucuuuuuuuuuuuuuuuuuugagacagaguuuugcucucggugcccaggcuggaaugcaauggcacgaucucggcucaccacaaccuccaccuccuggguucaaacgauucuccugccucagccucccaaguagcugggauuguaggcaugcaccaccacacccggcuaauuuuguauuuuuaguagagacgggauuucuccauguuggucaggcuggucucuaacucccgaccucaggugauccgcccgucucagccacccaaagugcugggauuacaggcgugagccauuggagcuggccucuaagugauguuucugaaguguugauuuauguucauguaagauuaaacacacacagaugcuucauagcuuuaaugcuacugaguccucuuuguacuuuauuaguccaacacucugcucagaacaugcuuuuuccuggcaguugauccaguccccugugacaaccccccuugggcugaucauguugaagacaacuucagaagagcuggcuuguccccgugaggaccucaguguggcucggaaggaggaguugcggaagcugcuacuggaccaggugcagacagugcuugggcuacugacaggugagcaguaugguagugcccagagauagaggccugcccgcaggcacccagaguucaggccuuggcacucagcagcuuugagcaguuguuugcgcuguuucugagauagcaugaaaaugggaagcugcguucccaacaccuauagcccagggucuagcacacaguaggacuacaaaauagauuuguaccuuauuuuccucguagucuuucacgaaguggucuucacuguaacugugaucagugagguagaguccaggucauaggaguauaccuacagugccgaucacugcaugguaaguuagguggguggcaagcacucuauuuaaaauaauuugaauugaagaucaggagaaguuggaguaggaggauaugaaaauuucccguucuggguaaggaagugagacaugguguggagccagccccuugugcacuagguuguaguuguauguagcauuuugucuuuucuguuugaugagagccucaugacaagguguaaaggguaagaauaaacagaaagcaaaccacaacaugagacaggaagguaggaggagaggggagugcccugggugacugggguggcugcugugugcugcugugauaccuguuugcuagggagacauguaugcaaugccuggccgugaggcccugagggugccgggagccugggcuugcuacuugagggaaucuuguagugaaaagaaguuuuuaucucuaacuccuuuauccaggcuucuucuuggaugucuaggaacuuucuuuauaucuccaguuuagugcuuggcauguggugggcacuuaaaguuggcugaaagaaccauugauuuaaaguaaacuuggguuagugcaauggcucacaccuguaaucccagugcuuugggaggcugaggugggaggaucacuugagcccaggaguuugagaccagacuaggcaacauauugagacccccauuucuggaaaaaaaaaaaaacaaaacaaaaaaguuagcugggugugaugaugcaugccuguagucccagcuacucaggaggcuaaagaaggagaauugcuugagcucaggaguuugaggcugcagugaccuaugaucguaccacugcacuccagccugggugacagagugagacccugucucuuuaaaaaaaaaaaaaagaaaaagaaaaagaacuuggcauuuguccccccauccuucccuaaagccccagggguaaaccuaaaccuucagaguauuuauucauucaaagcacuuuuuuuuucuuuuuuccuuuuuuugagacaggaugucucuuuguugcucaggcuggagugcggugaugugaacauagcuuacugcagccucagauuuuggggccuaagcgauccuuccaccucagccuccccagaagcugggacuacaggcaugcggcaccacgccuggcuaauuuuuguauuuuuacuagacauagagucccuguauugcccaggcuagucucuaacucuuaggcucaagugauccuccugccuuagccucccaaagugcugaaguuacaggcaugagccacugugccuggucucaaagcacauuuuuugacaccccaacuaaauguuaaauuucuaauguuagggaccauguuuuauaccucuguguccuacagugcccagcaguauauuaaauauuuuaaaaauugagauaaaacucaccauuuuaaagugcaauauugaccggcuuuuaguauauucuugagguugugcaaccuucaccgcuaucuaauuccagaacauugucaucacuauaaaaagaagcaucauacccauuagcaguacccucccccaccccgccccauucuccucucccccaaucccuggcauucacuaaucuacuuagucugucucuauggauuugccuuuuuuggaauucucauaaaaauggaagcauacaauaugugaucuuuugugucuggcuuuuucacuuaacauaaugcuuucaagauuuauucagguuuuaauaugaaaaauuugagaauaagauauuuucaaaagccuuugugaucaccuuauguuccggguucuguacggguacaaagaggaagaaaacacaguucccacccucagguaauuuacacuugaguggggagacacaaguaaacaguuaaagauguuuuaagagcuaaauagagguauguuuuaugugcaggaauuccugaaggaggugacagcugaauggaauuuugagcgacagacagguggcauuuagucugguggaaaggugauguugaaauugggaggaggagagcaggucagagguugagagggacacauguagaaggaacagcagacaguugagcauagcaaggccgcgucugucgggugagcugaagccugggucaggugaggcuagaugaggucagcagaagccaggauuuccagccuguuuccugcaugaggaacgaaaaaggauugguggcagguuuguggggaacgaaaaguugaguuugggauaugcacguagcauuguccaggaagcagguggacaugcaggucuguuacugccuugccuuguuucugaagcccccaucgugugaggcagagcuugguguauauagucaaggugaguuugggccaagaacaggagacuugagaggcuucagaauauauugaagccauagcaguggaugagucacucuagcagugagagugaaaugagaggagaagcaggucagucagggaaccuggggaaacguguguuuaaaugacucaugggcagaggauggaaguaauagugaaagggauagaauugaguucaaagaaaccagagaaaagccaggaaagaguggugcuaccagcucagagaaggguuuaggcaauggccuguaaugccacaguguggucaaggaggauggggauuaagugaccagugagugcaugcagcaaccaggugacucuggcaaagagcagugcuggaggcaacaguggggagaggccacaccacaaggccacagugaagcaguggagagccagaagauagcugugaagucgagaggcacagccgcuagcuggaggaggacauggucaagaaagggauguucaaguacucauguuugaucagagguaucaagaaacuuucucuaaauaugauuuuuauaugcuggacauuauuucucuuauaacucuguuucuccuuucuugguagguaucuuggagacugucugggacaaacacaguguuacugcugccacuccaccaccauccccgaccucaggagaaagugguauggucugccugccagccaaggcauucuucuuuuuaaauguauugggggccagguguggugauuugcaacuguaguccucaguacugaggaggcugaggugggaggaucacuagaggccaagaguuugagaccagccugggcaacauagugagacucuaucucuguuuuuaaaaauuacauuaaaaaaauaguccuagguuguuucccucauuuuuuuauuuuuccugaaugucaugguuaugugcuugugcugagauuguuaggagccuuugggcuugaaacgucugcuuguccuucuguagggguggcaggaggugggcagcagccugcaggagaggacauaggaacaggaauauugagugcuuucuuccucacuggauucauguuggccaaggcagaguggagaccucucugccugcauaguggagaccucucugccugcauaguggagacuaugcaguaguuagcauugaaucaacauugguuaagagucauuugguaaagcggggcauauuugcagaggcuauuaaauaguuuacugguugcuaguuauuguccacaguuauguuaauaucugcuucaaaauucagaguguaguucuucuaaagaugacuacuuucaaggauggauggaaagaggaaauugcaucugaacaggaacuuuuaguuucuaaaugcugcuguuuacacuaaaugaucacaaaugcuuuuccagcagaguacauccugugaauugacacauauagcuuccucuacuguaaagguugauguggcuaaugagaaauauuuccacaucuucuccuuuauuucaaggagauaggcuguggaagucagacgucucuaagcccaagcuguuuuauguagccuguuguuaguauguggaagcugaaauucuuacagaguuacucuagaauugaaaaaucuaucuggaaguuuuggggaguacucauagugcacuaauuauuacaaauuuucauuaucuuacuuggauuaaaaauuauuagagagccauuugucauacugcuuagauuacaaacaauuauagaguucuagagugcauuauaagcucauaggaaauggaacuuuguauuugguggcaaaccuuuauucuuuagguagauauuugagguggcucagcagauuuauauguugcgguaucuggagauuaaagaaacauuuggaaaugauucagagauuugauuuuaugagugaacgaaugucuuggaguauccacaguuaaguuuguuuuuucguuuaaauucuguuugcaaauauuaauucuuuuuuucgagacaaggucuccuucugucacccagacuggagugcaguggugugaucacaauucacugcagccucgacuuccugggcuccagcaauccucccauuucagccucccagguagcugggaccauagaugugcaccaacaugccuggcuaauuuuuguauuuuuuguagagacgggguuucgccauguugcccaggcugaucuugaacuccugagcuuaagcuauccacccgccucagccuuucagauuucugggauuacaggugugagccaccauacccagccaagauuaguucuuuugaguuagauuuauuuuagacaguugaauacucgcuagcaugguuuauuagcaacagcaguuuacuguagaagaaaugcuuguuuguguuucuguuggcuucauccaaacagguucugagcuaacucaguuuauacuuugauaggcucuguuuuccucagggccauguuggggaaugucagauaauacaaaccagagauaugugcuuacuucuuccauguguugccuagguuuuaugcggcuaagcggaauaaaauaugaacuaacuugacauuugcuuguaacaaaaccuaaaauguggugccuacuucuugagaauugccucuuaaaauuuuuugaaguguuggauuuuaguauuugagaaauaacaaaauaaauugagacugugggggcacuuagggaguuauguaagcuuuuaagcugguaaaguuccccuuuaaaaaaaaauugcauguucauuuguuacaguauuuuucuuucuuuuuaugguaauguaagugaagucauuagaucuugccccacuauuuggacagugcugaugaugcaaucaccauucauuuugaugcuuuuguucaacugucuuugugcgcuuaagaugccaaguuaagcaguaaaacuuccagaaaguuguuuugcuuucuugaccguaucaguuuucuagagaaaauuuguucugagaaacuguagggcccagugaagcaaccaaaugaauuccuuagcucagccccuguggggcucuccugcccugugucuuagguuuaguagccaccugaggcuugugggguuuuuuuccccauauacuuucuuuuaauguaauuuucugucuuauuacuuuuaaagaacaaagcccagggacuaguuccugcaacaacuccuuuaauagucuggauguagaaaaaaguuugaaggagugugugugguuuauuucucagcauaguucccccaaauuguuaccuuaacuccuaaacuggcugcaauagugaucacucaccucacgagaucagacuagucugucucuugcuuacaaacaaggaagcuugccagggguugcaucgccagugagcagaguggggacaugaaccccuaccagaacccuagaauuccaaaucuaggugcacggucauuguccuagcuuugcuuucuuggucguucucaccaauucuguccacuuccuucuuccccugguuuggagucuuggcccugccacuuacucugugaccuugaguggauccuucaccuucucugaccgcugauguccuugacuuuaaaaaaggaauagcuuccucugaggauaaaugagggaagauguggacauugcccccccgccugcugaggcuguuccuuccugcugcacuugagcagccucaucuuccuucaucuccucucauguucacuucucuuugccuggaccauuggggaaaaaagugcacagaaugagauuaugugacuacagcaauucugaguuagcuuugauugcucugcaguaaaauuaagggaccauaucuuucucaugcacaugauauauaguuucaaauauagaucuguacauacgugaugaugaaaaguucuucaggaugaggauguaucagagagugugaauugaggccagucuucuguuuccucccaaacucuuaacagauugcauaucuucaugcaaaucuuuucauguauuccuuguauacuaccuauagaaaggugggacuugggagggucacuuacaacuccugugaucuuauuuucuccuccaggggcuccuugaauagaguuuucccccauuuuacuggccaaggcugcaguuagagcugugguuuguccugcaggggauauuugucagugucuggagaaauuuagguuaacgcgacuggagaagugcuauuggcaucuagugaguggaggccagggaugcugcuaaacaccccgcgguacacagcagaccaaagaaugaucuagccccagaugccaguagugcugagguuggaaaacucuuaaguuaguaaauauacaacugauaggaaaaacaugaaguuucaauaauuaaaaagcuuugcacgaaaguuuauuacagggcugggcaugguggcuuaggccuguaaaucccagcacuuuggggggccgaggugagaggaucacuugagcuuaggaauuugagaccuguguuggcaacauagugagaccccaucucuaauauauauauaucugggcaugguggcuccugccuguagucccagcuacuugggaggguugaagugggagaauggcuugaguccaggagguugaggcugcagugagccaugauugcaucacuguacuccagccugggcgacagagcaagacccugucuccaaaaaaaaaaaaaaaaaauuacaaauaugccaaccaugucuucauuccuucuaagucaguaaaugcaccagaguugucuacacagcucugugggcauuggugcguaucgcugccagggucacagguuuuguaaucaagcuacccucuuccauagagaacuugauaaagcucucuuagguuugcauuggaagugcugcugcaugaagcagaaucuguuuugugcugauuccuuccacuuugauuacgguguaauuuuugaaaaacacuuccgccauccacuaaaauaccuugaaacauuuaaauuugaguaaaaucguuuuuauggagaaauagccuuaacagguucuuucccucaccccaaccuuuuuaggcaaaugaguugugguacacuccuuagcagaugcugacuuccaugaccaugguccugcuauuuucuuucuuuugaggacaaaaguaaucgcagaucauucauauccaccuaaacaguuuuugccuuugcauaaucuuguucagucuuugucuucacauauuugucuuucuaugcuuguagucaugguauacacaugcuauuauuuuacauaugauuuuaggccauacauauuuuuccauauuuauuuuuucacuuuaauacagaggagaacaauuaggaauauuuuucuguauuuaaauauuagcuuucuuauugcucauuuuuccugguugcauaaucuuuccaguuaacuugguuuuuggaaggaaacauugguuuugaggccagacccugguuugguuucauuucuaccuuaugcuagcagagggacuuggggaaacacuuggucugucugugccuuaguuauuuuaauggucuguaaauauggguaauaaugcccaccuuagaguugugaauauuaaaugagaauaugcauauauaguuuucaguauagggccaagcaaguagucacacagcagaugguggcuguuacugcuuuuaccauaaguauuauuauagauguuuuguuuuuuuuuuuccuuuuagcauccauucuggaaaaagucuucugagccacaugcuagggacagcuuuuaaaucuacuuuucuuuuuuuuggcuccucauaaaucaacuugauaaguccacuuuuaagaauagaacuuaaacccuucguuaaugaauucacaaaauccucauuauaauggcggaggagguugaggcugagaaaggcuagccaacuuguucauguucuuccagcguuagcauaagaccucagcucucaauaagucuggggaccccuggaagucccccaaacccuuuuagggagucccaaaggccagguauguguucauaaaaauacuaagacauuguuugucauuuuuauucccauucucucaugaguauaugaauaaaaaaguuaauuccagauuccacauugcaguuaacccuucagaaaugacuauucaucagacuuuaaucuaauaugauagaauagacacaguuauuugaaaaggccacuaaagcccuuuguucauuuguaguugcauaucuguguggaguugcauuuucuucacauacuucagugaaaacaaucuauugcaaaagagugaaggcagaagcaguugggagagucuaguuaucuuuuaaaccagccacuaaagagauuucaaaaauagaaaaacuguacuaccuuucucacuauuuuuggguaaaauacaguuuuuuucauuuaaaaauguuaugcuaacaugauggcuuuguaauuaaaugaauuaaauauuuaaacacuucucagcuuuaauuucuaauauggcaaauaucaauagaaguaaugcuccuaagagcuuucucuucgggaugcuuaguaauuuuuaagagugaggacuucugaaacccaaacauuugagaccuagugcuguaaaguacaaaauaaaauguaaacauuuacccaguaucuuacauagaaagaacaucaaauaauauuugaucacuccagacaucucuacacagagauaagacagauaaaaagacaaaaauggcaucagauuauauauuuuuuaauaacauuuaaauuuuaguuuuacuugauuuuuuuuuuuuuuuuggugauggagucucacuuuguuauccaggcuagagugcaguggcaugaucuuggcucacugcagcguccgccucccaggggcaagcgauucuccugccucagccuccugaguaguugggauuacagguggcagcugccaugcccggcuaaguuuuguauuuuuaguagagaugggguuucaccauuuuggccgggcuggucuggaacuucugaccucaagugauuuauccgcuucagccucccaaagugcugggauuacaggugugagccacaguacccagcauuuuacuugauuuuuuuuuuuuuuuuuuuuuuuuuuuaagacggaggcuugcucuguugcccaggcuggagugcaguggugcaaucucuacuuacugcaaccuccaccucccggguucaagcaauucuccugccccagccucccgaguagcugggauuauaggcacgcaccaccacgcccagcuaauuuuuguauuuuaguagagacaggguuucaccauguuggccgggcuugucucgaauuccugaccucaagugauuugcccgccuuggccucccaaagugcugggauuacaggcgugagcgacugugcccggccagguuuuaccuaaacguaacaaaaauuguuaaacuuaaggaauugcugaccuugaggugcuuuuucuacaagaaauacuaauuucuaaaagauaccuuuaugguuaagaaaaaaugauaaaaaucaauuuuguacuacauguuugaauuuuauguaucaccuccccccgccaccauguuuaauuuuagaccauguauuuugagacuucuuccuugugaaagaugggaaaguuagcuagcgcacccucuuaauuccuacgucuguuuagucuugagucucuauguaauuugaugccaguguguccuuuugcuacagcuucuccauuccuuaauucuuuauuuugauuuaucucuuuaucugugugguuucuuugucuguuauccuccuugagaagaauuuguggaguuaccugaguuuuugcguguuugagagaauguccccaugcugugaauguuacuguggagaagucugacugagguguuuucuccuuuguaucuguacuuuuucugccuacacugcuuccucauuuuaaacauucuuaguauugaucacucuucaucauuuuuuucuuggaacaggauaaaacccuuucauguuguagagucaugucaaauuucaggaaauuuuucuucuuguuauaguuuuuuuucuucuuuucuuuuuucuuuuuuuaaagacagagucuugcucugucacccaggcuggagugcagugguaaaaucguagcucacugcagccuugaccuccccgggcucaagcgauccucccacuucagccuccugaguagcugggccuauaggcaugugccaccaugcuuggcuaauuuuuguauuuuuuguagagacggggugucgcuauguugcccaagcugguuuugaacuccugggcucaagugaucugcccgccucagccuaccgaaaugcugggauuacaggugugagccaccgcuccuggccuguuguuauaguuuuaaauauuuuucuucuuuugucuucucuaaaauaauuuuauagcuuuuuuuccccuguuucauuuuguuugauuuccuuuagucuagugcuuucaaaaaucaagcaagcauaagaaucacuuggagugcuuauaagaacacagauuccugggccccaaccccuucaggcucuacuccaguaggugugggauggggccugaugauuuguauuucugacaaguucccugauuacauuacugguccagguccacagaguagccccgugguccuccaauuuugggucuuggggucccuugacucuuaaaaaauuacugagguccucaaaacacuuuguaaguuauaucugcugauagaaaaacugagaaaaauguacaaauagucauuaauucauuuaaaaauaucugugaugaacccauuacauauuaacagauaauaugcuuuaauaaaaaauaacuauauuuuucaaagcaaacagaaaaauucacugagaagagugguguuguuuuacaguuuugcaaaucucuaacauguggcuuagugaaaggcagcuucugcauuucaucuguugcaauaucccaugugauguagccucuggaaagcuccauuguacacuuggagauaaugaaagugaaaaaggaaaagaacaucuuaguauuccuuuaaaaauaguuuugaauuuguggacucccuuccccguaaucaacagccauuuuaauguagauaaccucugucuucuguuugguaacauguucuuguaagaacuuacuguuuuguguccauguauuuuaauauguaagugguauaguaaaacugucauucuguuucuuacuuuuaauuuaacuguaucuuuuuaaggucucuccaagcuguugcccgucugugccuuaguccucuacuucugcucacugugugauaugauaccugacucugcauucccuauccucucccgccaaggaggaggccagacugccuccagcucucccccucacgccugucccuucauggacccgugugaggguugcuuugggagcauaccaggagaauggucaggugaaaggauaugugaauguuuaauaggacuccagagugccagguccuccucagaauggcccuucuuccugcaccgccuugugaagguuccugcauccauuccuuguacuugacgucuggcauuugccaacauuuuuucagacuccuuuuaauuugcuuuuucugauuacuaaugaauuugaaaucucuucauaugcuuuggaguuucuuucucugaaaauugucucuccauaucaacugccuguuuuuguacugggguuguuguguuuacugauguguagcauuuuaaaaauagauuuuaguuuuuaguccuuuucgauguuagaaauugugaauaucuucucacagucuguugucugccugguaacuuucccuuaauguuuuucauugauuaggaacucuuuuuuuauuuuuauuuuuuauuuuuugagauggaguuucgcucuugaugcccaggcuggagugcaauggcgugaucuuagcucacugcaaccuccaccuccuggguucaagcgauucuccugccucagccucccaaguagcugggauuacaggcaugcaccaccaugccuggcuaacuuuguauuuuacuagagacaggguuucaccauguuggucaggcuggucuugaacuacugaccucagguaauccacccgccucggccucccaaagugcugugauuacaggcaugagccaccgcgcccagccuugauuagaaaaucuuaauuuuguuauauuccucaguauuuuuuguuaagguuuucuuuuuugguaguuuuaaggagucuuuuucucucuuauauuucaaauacucuuauauuuucuucuguuaacuuuaaaguuuuaucuuugguuuaagucuuuacuucauuuggugcccaacuuuguaugugguguuagggauuuuuauuuguuuauuuauuuaauggucauguaucaugcuuuucaaaagcaaggucaugauuugggggaacaguagcaagaaaacaaaaacuugaguggauuugggguuuugcagccagagaauaaucccaucuucucuucacuuaugucuccugggaaacugcuguuguacaaaucucacuaaaacuaaauuugagucaaaacacuaaagauuguauccagaucccccucacuaagaaucauaaucaauuaucuuauuuuugcuguacuguuaaaauuuccuaauuaguguuuaacuuugagcauauagauuuuauuuuuuuauuucauagguaacuaaacugauacauauauguauacauauauauauauauuuuuuugaaggagaauuacuuaaagucauuuguaagagauuugaugcuggauagcuuaaaagccuuucuuauuuucaggugacuuacugaguaaccuguugcagagucccaguucagccaaacuguugaaucagccaauucccauccuugauguggagagugaguauaucuguucccuggcuuuggagugccuggcccaucucuucaguuggauuccucugucugccagcaucaccccaucccuccuuaccaccaucuuccacuuugcacgauuuggcugugacauccgggccagaaagauggcgucaguuaacggcagcagccagaacugugucucgggucaggagcgcggccggcuggggguccuggccauguccugcaucaaugaacucauguccaagaacugugugccuauggaauuugaggaguauuuacugcguauguuccagcagacuuucuaccuccugcagaaaaucaccaaggauaacaaugcccacacagugaagagcaggcuagaagagcucgaugagagguaaugaaaccaaguguggagcuggugugccccaagaaagggcccugacuguuuaccaugcugugcugcauggcaucuguaauccucuuugauuucagaauauggggcuccuggugaggaacagaaagguaggugugugccaguaagucugagauuagcuggaagggcuugggugguuaagggaagugacugaguuugaaaaaugcuugugccuuguguagguuuguugucuuuucuccccauccaucuccuguccucccuucuacuccucuugcccccuuuuccuuacuauuugcuugcaggucugagguggugcagggacugagacugcugcuccugcguagccaagaacaggagaagagguccguggagguacaggaguuauaaucgccuuuugucacuuggugucaguuuuuacuauuugacuuuucccaagugaacauccugcaguauucaggaauguuguuguuauugugaguuuuacaccaauggcaaguuuucaucaaacuauaggagggauguuaaugugugcacagguuaauguagcacacagcuguguuucuuuguuauuguccucucaaguggagccuacaaugaccuacuuuuuuuuuuuuuuaaaagcacucuaaaagacgacuccaucacaguacucugaggcaggguuucaugauuuaugucucuugcagaugaggucauuuauguaucuuacaacugcugcuguaugaaaacaggagggaauuuggaaacuuauauuaugaacaaucagauugacgguuuagggacuuucaagcaauaaaucguaucgaauuaguaaauauuuacagaugacauggcagcaaaaguugcuaauauucucaguuuuccuuagauuguccuuuguuauuaagcuauauagaauuaagcuauuuucuuuuccuuagaguaaauagcagaauauaaaaucaagugcauaaaguugaaaguuguagugcuuuuuaaauugggcaguuuuguaaaauauuucuaaaauuaaaaaauugguacauaagauuauuuugguuugguuuauuguaaaaccgugauguuugcucuguauaagaacacaaucugauaugguaauauguucuuaaaaauuauuuggugauagcuuuccauaugaauucaaaggcaucauuauucacacuuucauauucuuucugucugugguuaagaaaggcuguauuaccuuuuuuuuaaugaucugugugucucaugucuaucucuucauauguuaauuuaaaaaucuagcugcuuguaucaacuaucaaauaucaguuguuuugacuuuaaucauaauguagucacagacaacuuuguuguggcuuccauuuggaugguauagaaaugucauuauggauugucuauguacugauguuguuacguguaacuuuugugcucuugguuuuacauuuuaauccugugcuuccuauugcccugugaaagcugagaggugccugggagcagaaaggugacauaaauaaugcugugugcuugcuuccuggcucuggguccccuaccacuaauucuaaacagcucaguccauucucaguuguuuaggagcugcuaaccagauccuuggcuucucuuucccucuacugccuuuuccccuaacuuucuacuguucauuagcaccuguaccagaaggugggcaagggaaagaaaaugaggugaaauaaaaucuguaguuuuagcuacugaacagccuuguuuguauuuuuaaaaaauuggguuagauacuaaaguaaaauugagauuguucuguauuuagcccauggcuuuuuuuuuuuuuuuuuuuuuuuuaaauggguaguagggaauugagugcaccuuccuaaagaacagucagcuggguggugacuuugaauauccauguaaaacuaucaugcgguacauaagugagugaggaaggaguuccuacucuugaguauuagugauugaugacaccagagagaagugucuuuguauguuccugucucuaaaaacaguugauuuuagugccuuacuguuuuucgaguacuuggccccaugauccacagagacagccauucucuuuaucaaaacaaauuaauauguauuuuuuaaaaagcugcaaauaagcucggccgcauagaggucaggcaggcaggcuggccacccucagggagauaggucccaggagcaacaugggacauuuuauuuccgggccaguuuugcuuuucugaguaguaguuuucucugcuuuuauuauuucacauaucucuguuuugaaaaauagcuuuugcaguaaugagcuucagaauugcuuuuagccauuauuucauuuucagcuaaggccuaguaugucuuuaccuuuuuguguuggucucugaaaugugauuuaugaagguauggccaucucauuuucuaaucaccuuuugguauuuaggggcuuaaaaugacaguuucugaaaugugagagugaugaugugcuguguauuuaauaacagagaucucuuauccuugcagcugugacccauacucuucugugaaaugauuuugugaauacaaaugaguuggggauucacugugaagugaaaagaaagagcacuggauugggaguggaugauaguccuguucugccaugaguuggcugagugacuuugggcuggucacuuuaccucucugggcuucaucugcaaaacggaagcaucagacuaaagucccugaggcuugcccaguucuaauagccuuccucccuuauauuugaaaucacuuuuagaguauuggguugugcuguguuuaauuagcaccaggaaccaaagggggaaaaauggccauuaaguugcaagccugaguacaucuuaccuggaugccaugcccuucguagccugguuuuguuuuugugucuuuagcaccauucacuuuaguauuuuggccucccggaaagaaaaccagccuucuagacuugccagauugaaaugacacagugaucugcccaucaacuuuuuaucauuucccuucacuuuaauugggucacaacacaaaugacuuagaaaaugugagcgcacuagauuauaagaagccuuagcagacagugucugaggauuaaaguugcuuuucugcuauguuucaggugguuaauggaaugaaggguugccuguccuguagguaauuguugcaggccuuuauauuuuuaaaagaaaauauauuacaaauuuguauaguucuguacugaaagaacuuuggauugaauuuaaguucuaaggagguggcuggguuucuuauugucaccuuuugucuugucucauuuagcuauaucgagaaguuuacugacuuucuucggcucuuugugaguguucaccuaagaagaaucgagucuuacucccaguucccugugguggaguuuuugacacuuuuguucaaguacacauuucaucagguaaagcaccaaagucauccuucccuuccagagaaaagguuuauuaccuuguuacuuugagaagaaagaacuuuuucuuucaacuuuauuuuccaaacauuaauauaaugcuuauuaugugaagagucacagguuuaaucuuccuaacaucccugugaaguagguucuauuaccauugucaucucuguuuugcagguaaagagacugaggcacaaagaguaacuugcuuagagucauacaguuaguaagugguggagcugggaucugaacccagagucagggcucuugaccacuauuaugugaacaaagcaaaagaaaggaaaagucugaaauuacggccuuuaguucuguucuguaacugccacugaaaccuccuucaagaagauuauauauagugaagcucucaagaguuaaguuuugguaguguccaaguuuuucucccccucacaaauauuuuuugagcuccuauuguauuccaggauuuagacauacaaccuucacaagcagucuuugccugcauugaguuuacuuacauucuagugacccuagucauucuaguauguguguguacacacacacacacauaaaaaauauauaaaauuauauauguggcuuuauugagguauaauuuuauauaccaugaaauucacucauuguaauuguauaacucagugauguucagugaauucauggagcuguccaaacaucaccacaguacaauuuuagauauuucuaucacauccuaucccccgugccuguugguguguguuuuaucuuaguuuuuaaaguuuuugguagacauugggucuugcuauguugacgaggcugacuuugaacaccuggccucaagugagccuccugucugggccuccugaagugccaguguuacaggcgugagcuaccgugcccagcuguguguuuuuaaaauaagcuuuuuauugaaguaugacacacauacagaaaagugcauaaaucuuagguguaguuagaugaguuuuccccaaauugacauaugcauguaaccaucaccuaagucaagaaguacauuguugccagcaaccaggaaaucuccucauguccuuuccaaucacuuccccucguuucuccccagaaguaaccccaggccugaccuuaauaccacagacuaguuucgccuguuuuagagcuucucugaaugaaagcacauaauguauguuuuaucuguguuuuuauuggccaucguguuugugagcuucguuugcguuguguguggcagucauguguugauuuucguugugcuguuguuaagucauuguuugcaaguucacuccccugcugauuuggcugcuuccagugcuuacugaucuugcagugaacauucuuguacgugcuuuuggauguacacagauagcuguuuuaguugauauguaccagggaugaaacuaaugggucacugaggacauuugauuuuagaaguagccuuuuuuuuuuuuuuuuuuuaaccacuaguguuguagcuuaaugugucuagaggaaaggcaagggucuaggcuaggaggguuguguauaugacuuggagcagggguuuguugggaaagcuguccuuucucaaggaagaucuuggcaugugaaaauagaagaggacccagugguaaggaugagccaguccugggagcaggggagggaaggccaaaacuugaagaagcucagaggugucagguagaggggcaagugcgugcagagcaugaggagagccgugccgaggucauaguccucaggagaacuugaagugacugcaggagggugaggauguaggggagaagcaucagagguggaacaguuuugggacauccagaggaauuuuaaaggagaccaugaaaaaagaggauuugagagaauguugagugaguguuaaauagcguaacagaaaugagggagcugaggagccaguucugaggccagaaacaggaggcuuacuugggggagauggaaugacaaugucuugacauuucacucucuauguaaaauggggucuucugguguguauaguauagaagaaagugaaacaucuuuuaaaguaggcaugucuuaugccugauucuuuggauuggacccaaaaguuuuguguuugaggucugcuuauuucuauuaguucuguguccuuggagaaaccuuaaauuuacuuagauuucaguuuccucaccuaagaaaauagacugcaguggacaucuucaggccuuuccccuggcuuauuuuuuaugauucuuucaguagacuccuaugugucaucgaauugaaaauggugguuuuauauauuuauauauuauauuuauauauugggaaaguaauuggggaaaaaguaugcucaugaagcaaaccacaagcuucuuuccuccucucuguaccuggaaucgucagaugagcuccuuucugcucuccugucuccuguaugaggaccuuccuuucugggagcaggcuggccaccugugggaguagguaugucuuugacguccagacagaaucagauucugagcauuagguagagggacaggaaccugaaagguacacugucccagcuuacuguggguaaaccagggcagacagcccuuugcuggggagguagaauggugaaaagguggcaaggugcacucuaggaccaaggccugcuuauaggggaggucuuuggaauaagacuuaagaauaagaaauuaaaugaucucaagagacagcuuuaaguucucaucuguucacuaacaaguaugaucuuacucucucauagcuuuauuaccuguaaugugggaaaaugugucuuucucucgucuagaggguuauauaaauauauuuaauauucuugccuguuguuucuaaaauucacaaauuuuaguacagucguguguugcgucccuuaauugacagggauguguucugaugaauguguuaggugaugucaucguuguguguacaucauagagugcacuuacgcaagccuagaugggagaguccaucacacaaguaggcuaggugguguaggccacaaaccugugcaguguguuacuguguagaguacuacucuacuauucuacuguguagaauacuguaggcagcuguaacacaaggguagggauuuguaucuaaacauagaaaagguagaauaaaaauacagggguuaucuugaauugggccacugucacacaugcagucuauuguugauggaaauguuguuauaugguacaugacuguacugaugaacauaauuucgaagaacagucauaagacagaagauggugcuaguaucuucuuuaaccguuucuccuuuucuguuucuuuuccugcauuuuucuguaaaugcccugccgccagcgccuccagguagcagugcucagcaggugucugcugccuccugccuugcuuugcuugcugagccuccuggcugucuauaaaccuaugucucugucuuaaugcuccuaagcuuagugcguccucaccacuuccuucuuguucuuguguuuuucauuuugccccuucuuccugaaacugugccugagaugguauacccugggggggagggcuguggaccacagagccuuaagauccaccuuccuuuuguuuuuuuuuuuuuuuauuuucuuuuuuuuuggagacagaguuucacucuugucgcccacgcuggagugcgauggugcgaucuugacuuacugcaaccucugccuccuggguucaagcaguucuaccucucagccuccugaguagcugggauuacaggcaagcaccaucccacccggcuaauuuuuuguauuuuuaguagagauaggguuucaccguguugaccaggcuggucucgaauuccugaccuuaggugauccacuugacucagccucccaaagugcugggauuacaggugugaaccaccgugccuggccaagauccacuuucuaguucugauuuuguuccuuaauugucuuguuaccuugggcaagauacgacuggacuugacuuuugagccuugguuucuuuaucuguaaaaggggaagaugcaaaauauuuguucacuuuccaagacuuaugaagaucacauagaccaaugcaaaugaaaacuaaacacuguaaaccacuuggaagauagaaugguaucauuaguuucuuaaagaaaccuggauuuguagcccuggaaucugaaaaguaaauuggggucuagguccauuuuaaaaaugggucugugaagguuuugaaaaguuaggcgacuucaaaaauggagccagcccaucaucuugaugaccggaaugaaccauguccacagcaacuaucagaggccaggucaugggcggccugugggcagugcacaagcccucgcaguggggccugcaggaauggaugugaaagguggugcuucagguuauacagggugugucugcucaccuuucccccagccuugagcauauagcaaguccucaauucacaugcaugaaguuuauauguauaauuauaaaguacuuugacggagccauaauacuuggauuuaugugguaaccuuucccaaaggcacuuccauaugcaucugaugagcugugcucuuuugagggggcuaguggauaguuuugaaccaaggagggauaaccuuggugauugacuugagggaagcucagcaaguugaaccuaggacaagagugugucucuuggaugggcaagucuaguggccuguccaaggacuacucauaucauuucuucuuuuuuuuugagacagggucuugcucuguuguccaggcuggagugcaguggcacgaucucagcucacugcaaccuccgccuccuggauucaagcgauuuuccuguuaagccucccgaguagcugggaucacaggcgugcaucgccaugcucggcuaauuuuuguauuuuuaguagagaaaggguuuacaccauguuggccaggguggucucaaacuccugaccucaagagauccacccgccugggccucccaaaguguugggauuacagaugugagccacucggucuggcugccguaucauuuccauguggcuuauucauuguuuuuccugguuauucuccugguucacuucaugucguggauauugucaguauugccaaguaugagguagagacaggacuuggucauuuuguuuucugagguugguccugucuaguuccagagcuacccuuugggucgugaaguuggaauuugccuggcuuuuuaaguuacacucuuuucuuuuuucuuucuuuuucuuccuuuccuuuccuauuuuaauuuuuuuucuaaaauauacacaccgagucucacuauguugcccaggcuggucucgaacuccuggucucaagcaguccaccugccguggccucucauaaugcuggaauuacaggcaugagccaccacgcccagccaaguuacacuuauucugucucagacuucagcuuagguacagaacucccacuggauaccaccacccauuguuaguuauuucuugggcaccuccauguaugcccuuguaaacgucuagauuuccauguggaucagcaauggaaagaaacugauccaagaaggucauguuauuauuuauuuucauauuugaucuugucaccaaauaugugguccagugagacagccaccagcaaaaccaaaggagucuuucagguagugagcauuugaguggagauaucaggguuuggagccacaaguugaaccugaaugcauaggggaaggaguagcuguuggagauuguguugccuggacuuugcaugaaauagagucucagagcccuugagaaaguuaacuagugcaguggucuucauuguacuacuaggauccuacaaagacuucucacuuuguuccuccacaucagcaccugguuggagguugcuauuagcacguuugacacccuugcuuuugcaaaugggauaaugcccugagggucagacuuaaugagcucauuuucagucuguucuguaggaagacugcaaguguuacuuuccuuacauucaaaugugugaaccugucaccuuuggagccacugaaacugauuuuugcuuucguaaugguuuguaauggaaagagcauuggcuggggguaaagggacuuguuuuuaccucuggccuugaacaacuuauaucucugaaucucgauuucucucuggaaaauagauuuaaacuagaugaucuguaagagcccucucuaccagucucagauuuuaagauagguuuuugcuugacuuauuuuauaacucaguuuaugcugcacaguaucucccucaugauguguuccaugguacccuugucuuguaagguucaggagggcccaaugguauagaccgacuaaaagccaccaguuuugguuaccaggaaacuggggaaucuaggcuuaugauuucaucauucugcuggaauuaaacacuggcauguguguguuucuaaggaauaguagcauuaaauaauuucauugucuggauuuuuuuuguaccauagccuacucaugaagguuacuucucuuguuuggauaucuggacgcuguuuuuggacuaucugacaaguaaaauuaaaagucgucuuggagacaaggaagcaguucucaacagguaaacuccucaaacacugaaaacuagauauggucauuuugccaguuauucuaguggccuaagagacagccaugcauuuggaccuuuucagugaagcugagucauguaagcuguuuaggcaauaaugccauugagcauuuccuuuuuuuucuccuuuaaguauuuuguuaagacuuuuuaaaauuuuaaaaguaauauguauuacuaauuuuuuauauuuuagugcauuuguguuaauguucuuaauuuuuuaauagcccuuauuuuagagauacaaacugaaguauuuauuggauaaaaugauaugacaucugggauuugcuuaaauaacccaguggggguagaagggaaguggguuccuguagagaagaaacaggcugcccauguguuggugauugauguuggaguuaguuccuaggaacuugggguucauuauguucuuaccccauuuguauguguuugaaaauuuccuaaauaaauuaauaaauaccuguuaagaaaaagguguucauuuuuaaaucuaggaaaagauauaggaaaauguaaggaagauaaacauaaucccacaccccagagauaauugcuuuugcacuuuuuguuguauuuuuaaaaaacagagaaugcggaaugguuuguuuccccccccauauguuucucaaacccauuuuucuugcuugcaggaagagaguauauuuccuguacaauauguucuuugugccacaggguggggagaagaggaggggaagguggagauucagcaugccaggaaaauaauggcagcauccauauauggggaaaguaaauguggcagcuuuucuuagcagaaacauacccaucauagucucaguaggugacugcaucccagucacacagugagcaggcagucaugaaggaggcaaagaagcuauauuuugcauuuuaggaucagaguaguuuccuaauaaacuaaaacugauucguguaauuuguauauuuaugcuaugagauuacaaacuaggugaucuagcccuaaguacuuuaucauacuuaacagagugccugcagauuuuacucaguuugguuauagcuccuacuucuuugcacaguauuuauaagagcaauuucagauuagguggucauuguguuguaaaaccagugcaugaggggguucugucgaguggaagccaugacggggaaucgcacagaccuauguuuggauccugguuuuguaguuccuaccuagggguacuuggguaagguacuuagccuguggaagcuucuguuuccucauuuguaaaaugaggaugaaaauaauaguuguugagacauuaauugaaauaacgaacuaacauauuuagaaugcuuggcacacugcaaguguucaccugguggugguguuagugaauacucuuuccccauaaauguaccaaauggaggaagguggagaggagagacuccacugcagagaaaagguugggcuggaacuccaaaggcuuuuccauugcugagguuuuaugaguuuaaaaaauucuaaacaggaccuagaugugguaguauguaccuguagucucagccacaugggaggcugaggcagaagaaucgcuggagcucaggaguucagaacuguugugugcagugaucacgcuguggcuggccacugcucuccaggcugggaacauagugagacuccuugugucucuugguaccagucacugguaccauuugcugaacucugucucuauugaaaauuaaaauaaauaaauaugcaaauauucuguugagaauuuuauuuuccaaguuuaaacauuuguucuuuuguucccaaagaugguuuuuguaauuguggaauaaguuccagguugcuauggugucaggucacaugugugauuauagguaguacguucauauaucagaaaucguauuacacacaggagauccuguuuuuggugaaguugccaacuuuaaguaauuauguuuuugaaaugagauucuugaaggaaaaguuacuuuugccaaaauaaucuuucuugcaugcuaaauaggcauaucuuuuugguucugggacuaugccucauuuuucuauauuuagugguagauauuccuucauaucucucaagcuuguugugagaauaaacugaggaaaugauuaauaugaaaaugcuuuuuaaaaaacaguacaaggccgagugcgguggcuccugccuguaaucccagcgcuuuaggaggccaaggcagggggaccacgaggucaggaguucaagaccagccuggcugagaaggugaaacccugucucuacuaaaaacacaaaaauuagcugggcgugguggcaggcaucuguaaucccagcuacuugggaggcugaggcaggagaaucuccugaacccggguggcagagguugcagugagccaagaucauaccacuggacuccagccuaggcgacagaaugagacuguuuaaaaaaacaaaaacaaaguacaaaugagagaugugaagaauaugguccuguugagaaaauauauacuagcagauuauuaguauuaaacacacacuuuugcagaucauuauacuaauagagcagugguauagagaauuuaaauucuuuuuuugcuuuaggcuagccguguuacuuuuggucaaguuauaugcugaucacauuuccucuugcaaaauggacguacuuaacacuucucuugcaggaugguuaggauucaaggaaaucauguauguaaaauaccuggcacagcaucuagauguauuaggcacucaguaaauggucacagugaugacaacagcaaugaugaauaauagaagauguuacugccuuuagacugugguugugacuguagcguuagguggcauggccccuggacagucuaaaggccuuuagcccaccugcagauguuuaccugccugcccuggcaucuguugucuaaugucacaguugucaguuguucuggcugaccacuugaaacagugggaauuuuucucauugaucaugugauuaucauccuaaaugaggcuuuuuaauuuuucaugauuuauucuuuuuuaaacauaacacuuucauauaaugccuuuaugccuuugaaaaauaaaacaacaggccaagugccauugcucauucuuguaaucccagcacuuugggagacugaggcaggaggaucacuugagggcaggaguuugagaccagcccggccuacauaaugagacccugucucuacaaaaacuuaaaaaacaaauuagccagacaugguagugugcacguguaguuccagcuccuuguggggaccaaggugggaggaucacuugagcccaggaguuugagaccagccugggcaacauagcaagacucugucuguacaaaaaauacaaaaauuauccaggcaugguggugcaugccuguagucccggcuacucaggaggcugaagcaggaggacugcuuaagcccaggaguuggaggccacagugagcuaugaucaugccauugcacuccagccugggcgacagagcaagacucugucucuaaaauaaaauaaaacaacaacaacaacaaaaaccccuccaagcuccucugguuagugcuguuaaauaguaaccaccgucuggggaacugcauguccugucagauaccccuuaguggucuaagacaguagacuacaaagaacauguguuaguccagugggcugcacaaagaaaauauuucaacuucagcuuauaauuuuuucuguaacccuuaacauucaccacuccagacuaugagagacucuuaauauaucagagauaugcuguuuugcaggagcagcugcugaagaacacuggcuucuggugaugaccacauuuauguuaacuaagagcaugcacaugugaucaaauguuugucaacugauaaaauauaccagagagaaguugggauguucuggaaucauauuucagaagcaacuaaucuugcaggaaguagucaaaaauguuuucuugcugucuuaaaugggaaauguaggugugguuaagucacaaaggcagcacucauuuccuguccccugugguuuaaagguuuugcaucauucaucacaacaaagugguaagcauuguaggcuacaaauuuagaagcacaaauauacauagauuuauuuuugguccuaggagcuuggaaauuggagcucugcaugcucacuugccuggucaggagcgcaguggcgcgaucuuggcucgcugcaagcuccgccuccuggguuuacaccauucuccugccucagccuuccgaguagcugggacuacaggugcccgccaccacgcccggcuaauuuuuuguauuuuuauuagagacgggguuucaccguguuagccaggguggucucgaucuccugaccucaugauccacccgccucggccucccaaagugcugggauuacaggugugagaggaauuucuugaugagagacuguggggacuugagagagccugagccccaguguuaaugggguaaauguucuguagccauuccugcagaguggaauggccgaugggguagaucauccugaucuguauuuugaggugguggcauggaaaggcccggauuuuccuuucccuuuccuuguuugugcuuuuggaugguugugccuuccucacagauuguugagaaagugggaugaacuaaugagcguaaagugccuuggcugacaguaggugcucagcaaauaagcauugguucaccuccccuuucucucucacuuccggcucuuugugcuugucaaugugaagggagucaccuguguagaaacuuauuuuuacaggaaggugaagaaaccugagugugugaagcaaccuaaagucauugugucauguucugugagccucuuugugacuagacuucuggcaagugcuggccacaaaccaacguagggauucuggugacauuagauaggacuguaaacaaaugugagugagggugagaaaaacugcuccuugcuuuuuggagugggugaaccugcuuaauaaagaggaagugccacuguuacacaugacauuguggugcaauaaaggugugaacuagguuuagaucagagcucuagcagcuuucuaguucuugcucuugacugccccacagggcaagugaauagagucuuaguugcuuuauugaguugaaaaagcuauccaggaauaugcuucaauccuuuguauuuaccugacuuggaauuuugucuguuuaucaccuguguguuuuucauucauuucuuuguucauuuguucuuuauucauauauauuuuauugagcaccuacuauguaguugccuuaacauguauaauuuuauuuaacucucagaacuugaggcuuauaggcuuaucucugugguguauauaagcauuuaaugcuguaaauuuccuucuaagcccugcuuuagcuuuaucccucaaaaaaaauuuuuuuuuuuuuuuuugagacggggucucacucugucaccaggcuggagugcaguggcgugaucuuggcucacugcaaccucugcuucccggguucaagcaauucuccugccccagccucccgaguagcugggauuacaggcacaaaccaccacacucagcuaauuuuuguauuuucaguagagacaggguuucaccauguuggucagguuggucucaaucucaugaccuugugauccgcccgccuuggccucccaaagugcugggauuacaggcgugagccaccacgcccggcuauccuucaaauuuuaauguuacauuuuaauuuucauuugauuuaaaauauuuucuaauuucuuuggagauuuccuguuuaguuuccgaauauuuggggauuuuccauauaccuuuuuguuauuguuuucuaguuuaauuuguacaugucuuuuuuuuuuuuuuuuugagauggggucuugcucugucacccaggcuggagugcaauggugugaucucggcucacugcaaccuccaccucccagguucaagcgauucuccugccucagccucccaaguagcugggauuacaggugcccgccaccacgccuggcuaauuuuuguauuuuuaguagagacaggguuuugccacguuggccaggcuggucuggaacuccugaccucaggugauccgccugccuuggccucccaaagugcugggauuacaggcgugagccacugcgcccagccuguacauguugucuuuauccuacuuauucuaucaguuacugagaggggggugaauucuccaaaaauaauuuuggauuugucugucuccuuuuaguuugaucaguuuuugcuucauuuauuuugagacucuguuaguugcauacacauuuaguuuucuuuuccagugugucuauugaguguuggaccacauuucuuuauguggguuuuuuuggugguugcucuggguauuacaguauauauacuuaacuuuucagagucacauuuuaccacaagggugguauggaaaccuuaccaccauauagauuagaguccuuuagccucucuucuuuauauugagguuuuacauauacauacuuggaaaaccccaccagacaguguucuaauuuauacacguacccaucauucauauuuuauagcucuuaagaagaaagaaguagucuauuagauuuacccagacauugccauuucucuugcuuuuccuuccuucuugaaguuccagguuucuuucucauauuguuuaccuucucuauuaguuagauugggcuaccauaacaaaauaccacaggcuggccuuaaacaacagaaauuuauuuucucuuaguuuuggagucuagaaguuccacuucaagaugcuggcagauucuguuucugugagcucucuugguagcuugcagauggcgccuucucucugaaugcucacguggccuuucuugugugcaugugaggaaagggagggagagaacccuugugucucuucaucuucucauaagggcaacaguccuauuggauuaaggcccuacucuuugaccucacauaacuuuauuaccuuuuuauaggcccugucuucaaauacagacacauugaggguuaggcuucaauauaugaaugaguacuuuuugggggaagagucgcacaauucagaccauagaggaaccucauggagcauuguuauuauagcuguuuuagagucaucgauaauuccaacaccuuugucaucuugagguuggcaucugucgauugucuucuccuugagaaguugugucucuuugaguagcaaguaauuuuuugaauccucuuacuuauuuguucuaccauuaggcguggcuucccucuccaucaucaucuuauggucagagauggaugcuggaugaugcuacagacaucauacccaugauucaggcaguaggaacgagaagugggauagguugggcaaaagaagcuuucuuagaagucccacccaguagcugcuuuuaggcucucguugaccgcccccaucuucaggggagauguuguccuugaguuggccucaauacccagugcucucuugcugaggaaggagaauggguauugggcaggcaaccagagugucugccacagccauauacuuucuccaccucccacaugacacuuugggagaucagugaucuaugugcauguuugccugguuccuacuuggacuuaauuuucuaagcgauacggguuuuuuuugcagccagaguugccaauugccaguuaagauuuuaggucuaauuuaggguuacauuugcauagaaagucucuaaauuuccuuuuagcacagcaagacaauuuauagaugacaaaauucaucuguccucuggucugaaguagauuuucuuuccuaggagaauuguggaaauauuuugaucugucacagcaauuuauaguguggaacuucuguaacuuuagaaauuuaugucuugaacaaaggcaaaaacauaaacucuaggccuaaauguuugaucuuaccuuucuauggaguuuacuaagugggauuuugacuuuauugggugaauuuucccacagacguugcagauuuuauuagugccuuuuucccugccggcauucuuuccugggcccuguucaguugcuagucuacuuuagggcuggcguguguuagguuguuaagucguuugcauacaguuggggagucauugcuggauaugggcaaguagggagugucucugucucuaguuaagaaacgagcugucgggagcuaaauagugggugcucguggacauaggauggcaacaacagacacuggagacugauagagagggaguggggaggagggcaggggcugaaaagcuauuggguacuaugcucagugccugggugaggagaucaguuauaccucaaaccucagcaucacgcaguauacuccgguaaccagucuguacauguauccccugaaucuaacauaaaaguugaaauuauguuaaaaaauaaguaaauaaauacaaaugucaauuuuggcauagguuaaauuuuuaaguuaaaaaaaaaaaagauacucuggucaccaaaaucugaaaugggacaauccaggaggauuuguaaguggucuguagacugauucucaucacaugggcuguaccuccuggacuaaauggacuguauuuggucuugguauuggauaucuuuuaacuuugguuaucauguugucccaguacucaacuguauuagauugggugguguauuagaguccugucaggaaaucagaaaccauacuuaauuauuugaacagaaaauucauuuuaggaaauugauuaaauagguuucagaggaaacacugagauaacacaguugauaaguacaggaaguggcuucaccccuaaggcuagaaguacaaaggcaagaagcuggggcugucaaaaucuggaagaucacugcuuggucccugagcaacuaggguucagaucucugaagagagggccccaucuagcugccacaggaguucagaggagggaucuuuucgaacugggaccauuccuuugaggagaggguguugccuccaccucugagggugcacgauacuaguucugggaauguggaaugaagcuggaaaccggaaccaguugcuucugccaggugucuguugcuggggcagcacugccaggacagcaagcccacaggaaggaugcaguccuuuugucccuucugccuuccagucucccuccagugucccugcuggcagaaccuaacagaccgaaacaaaguguccuuugagucucagccccagcaucauagcuuuggagagcagauugauguggagagcuuacuaaccagcacuggugguuugcucugugaaugggagcagucccuuaacuuaucuuagaagcguuucaggauaggcgaguauuuaggcaacaugauuuguucuugaaaaugagcaguuuguugguccuugugguagcaauuguugcuuauaacuugguaucuucugaguuggguucuuauuacaugugggaaauauccaaaccuaccgcucugaguauuucuuugagaaauuauucuuagacacaaaucaaagggucaggguuuccccaggcucuuuuuaguuucuaagucuucuuaaaauggacuaaagauuagguuuugggaguuggguggagcaggcuuaaaacccauuggugcugggcgcgggaucacgccuguaauccugacacuuugggaggucgaggcagguggaucaucugaggucgggauuucaagaccaaucuggccaacauggcgaaauccugucucuacuaaaaauacaaaaauuagccagaccuagugggucaugccuguaaucccagccacucgggaggcugaggcaugagaaucacugaaccuggggaggcggagguuggagugagccaagauugcgccguugcacuucagccugggugacagaggagacucugucuccaaaaacaaaaacaaaacaaaacaaaacaaaacacuucauuggugauuuauguguagcgagaacaugauuuugaauuagggggcccuagguucgaaauagcuuuguggccuugggcaguuuauuuaacuucuguuaauuguuguuuccucaucagaaaaauauugauaccauuuacuucucacagcuguuaaaagcaugaaaucauugaauuagguaauauuuauaugcagugccuaucauccccagagcagcugcuaagaucauaacuugaaaauacuuaguaaaagaaaggacaagggauuuaaaaugcagcacuagaaaauaccuguuugacacaaaagaaggcaggaauggaggaauugaggaacauaagucauagaaaauaaauagcaaaauggcaaaaaugaggccuuccuuaucaguaauuacauuacauuuaguggauuagauucuccuguuaaaaaaggcagagaacagauuuuuuaaagccacgacccaaugacguguugucuacaagagacucacuuuggauucagauacaaauagauugcaaguaaaaagauggaaagagauauuccgugcaaaaaguagccaaaagaaagcucgggucacuauacuaauaggagacaaaauauauuuuaagacagaaauuauugccagagacaaaaaaggcuguuauauaaacagucugucaggaagauacauggugccugguacgucauuaaauaaauaccucugcuucucuuccaugggcgcacacacguaccaacccauaaacucagccucaggaauuucgaugcucuuuuuccauggugaucaacauagacaccauuucuuuuauagugcaggaggcauuuuccaaauucuaagcugaaagccuccuuucaauguugaauuucucccugccacauagguacgaagaugcccuggugcuccugcucacagagguguugaaucgaauccaguucagauacaaccaagcccagcuggaggaguuggaugaugagacucuggaugacgauguaagcggcaugcccugauugauuuuuugucgcugucauguugugacaucaaucagaauggggaccuggaacccagagcccucugcuccgaagacuguucugaaaccagaguagucuucugguuugagucguacauuugaaauuuuuaaucuccugcuggucccuuuuggcuuauuaaccauaaaaaauguuuuacaggcuuuuuuaucuauguggacuagagauguaaguagagaaaccauaugcacaaugaaaaacgguuuagugagaacucuguauccucucugucuccccugccuugcacccucaccucugcuccccaaccugggcagcaguaacagcuagcuggaugcuuguggagaccguuagcaagauacugaaccgauaaggcuagaaugaaaggaagucuguuuggaguacauuaugcaaacuucugcuucuuaaaaucagccuugaauuuauugaugcugaugugcccaacauuaauaaggaaaaugucuuuaaggaaacaauuccaguguuuuuuuuuaaaccauuaggcacuuuaaaauuuuucaaauaacugcugcucuucucaaaguaagagugacugcggcauggucaagagcuuauggguggucauauuuggguuacagagagcccuuugcuuagagccagauggccuggguuugaagcucugcaaccuugggcauggaggagauuggagggcuggguguggcauuucugugagccuuaauguccucaucucccaaaaggggagugacgugucuugcuucuuaaaugucaccauggauaagaaucacuggaacagcuuguuaaagcagauucugauucuggaggcuuggggugaggaccauagaauuugcaucucugacagcccaccaggggaugcguuugcuggcuggcuguggaccccauucugaguggcacugagucagucaguuauguggauagggauacaguaguggaccgugucagaaggugaugcgugaucauuuccaacaggugauuucacaaguggcucuccaucucuguauccuauaacccaaaggggggaaaauagcuuauucuauguggaucauuuacuuucugaggaaguaguuuuuugugaaauuaauucauuguuuuuaaaaaauucuagcuuggccuuuuuauaguaccagauaaccugguuccaucauuuuccauuucuucaaaauuuuaugucugagaguggucuugagguuggcaaggaagaugagaggauucugggagagcugauucuccugugcuuccccuacagcagcagacggaguggcagcgguacuuacggcagagcuuggaggugguggccaaagugauggagcuccugcccacgcacgccuucuccacacugguaaugugcuguccgggggaguggagaguguagcgauuucucuguacacagagcauggcugguugacuccccuggaucucucucucucuccccucuuuccccucuauguaauuuuuaaaaacagaauaauuaccauaagugaugcucaaacugaacaaauauuaacauuuccacaaaauauuaaaccaacuuuuggaaccuuguuuagucuuggauauaauagcaauuugacuaaagccuuaauaccuuuaucaguagcuugcaaguggccaggccgagugggagcuguuacuuauagaaguuacauugcugaaaagcuggccuuuguaaagcucgcucuuggcaaauugcuagcuuucucugcgugugucuauacgugcuggaaucuuuaguuguaaggauugauucccuucccuguguggugcguguuauucaaagagauuucauuaaauucaucacuucuucaaggcaaggcaguuauuaggguaauuuuuuuuuuuuugagacggagucucacgcugucucccaggccggagugugcaguggcgugaucuuggcucacugcaaccuccaccuacuggguucaagcaauucuccugccucagccucccgaguaagugggacuacaggagcucaccaccacacccagcuaacuuuuuguauuuuuaguggagacgggguuucaccguguuagccaggauggucucgaucuccugaccucgucgucugcccgccucugccucccagagugcugggauuuacaggcgugagccaccgccccuggccauagggucaucuuuugcauugaaugacccagcuauacuuguguucucuccuggaaagcuucguacuuugccaucugccuuucuuaggggccagucacguuuuaaucuuacuggugaguguagcagcuugagaaagaaagaugcagcuccgguuaugacguucugaccgcuacuugagccagggaacugacuuccaaauaauuuggccaaucuuaucacuuuaccaugugcuuaauaaggcauagcugacauuucucucaagguagagguucccuuggauuugaagggagauauggucccuucucagaguucuagaagguguaggucauuucaggguuugaucuccucuauuaggaacguaagagucauaccacaguguccuuugcuuuuuuuuuuuuuuuaaaaaaaggguugaacuaauacguuuucuuucuuauucuguguauuaauuggcgguuucaauuauagaaacuaguuggggggcacugaaggggggucauagcuuuuuagcugcauuuaaagguucccagagaaaagguuuugauccuguuccucacaccauaguuacguguuaauguuguaauguuaaaaugcuauuaaaacuugcauuuauggcuuaaaauuuuuguuguuuuuguuucuuuguuuucaguucccuguucuucaggacaauuuagaaguuuauuugggauuacaacaguuuauagucacuucagggucagguaaacugguuuuuauuuucuaauuuaaccaaacauucaaaaaaccaucggacugauauuucauuacugcugccguugcugucggaacaugauuucuucacugcagccuccccacuggcaucucuccccacuucgaaacagggaacguuuuuaaaggcuuaugaugaaaagcugugggggagguaaaagaugaggucaugacaguguauuccaaggagguguuuggaaaagaaacugauuuggaguaaagagacaggacuuacuaaaaagccucuaauuaguuuccuuauguccuuucaaccagcagguguacuagggagaacauggccuugugcuuucuugcuuccugcucacuuuagaauuggaaggccauagugcagcugauggccuguggucccccugcccccugcaccuguugcaaauggccccaggggcucugaccagagcugguugaaaaggcuuuuggcugcuguuuacaggcccugccugcuugggguuuaggguuaguuugcuuuguuauuuuguugauaacaauaauaguaauagcuuccauuuguagcucucauuacaugccaggcacuguguuauugacuuauauuacuuaauucucuccaucguccugugagguguaagugcuauuacuaguuaccccuguuuuacauaagaggaaauugauguucagagauguuaauuuacccagggucccauggcuuuguugguacaagucgcaugaugguauaauagggaaugacaaaauguugaaauagcuaacaucugacauucauuuuugucaacugaaaacaccaguaacugaaagccacauguguccucccugccccaucagcugcuaugcaccacucucacugcccuuccuucuucccagcaugcuucuuaugggaucugucccggcucuggugcgcagccccuguguuggguaacuguuguuucagcccagcacagagccgcccagugugcagcccaucuccuggaugagcuugugauucauggcagagccuccacaggagccuuuuuccgaggcuguccuugguggucugugacggcugguuuccaugacuauauaagcuucuaaauaaucuagugggccccaggaggcugaugggccuuggcaugccccgaauguaggcccugacuuuguagauaggguaagaaauuuaaaaagacaaaacuuuaaaaagacacuuucaaaacaaacaugcuuauaaaaugugcugucaccacuaaugaaaaucauuuggcuguguagaagugcuacagauguuuccagaagccauuuuugggaauaaucgugcccagguggucuuuccuucaggaccacuauucaaauuagaauguacucaggacccugaagacacuguucuugaucuauuaaaaaaaucaagcagguguucuuuccucccccacacugacccuucaguguccuguuuacuuuuguaaaagcugguguuuuuacauucuguugugucugucuuuaggugaaagucuagugaaucugaaacucuauuucugggacauagcugauaauucugagcucuucucccuagaaggauaaugugauuuauuuuuuccuauaggaaauaccgcauacuugcuuucacuaaagccuguuuacuggcaauuucacagaacucggcucguccggaucauuuauaaaucucauccucagcacugauccuuggcuuguacuccaguggcaaaaccucccaggccagaaaaaugcuuauuuccugcuuuaaaacgagcucucucauccaugacaaagcauuccccaauuuuugguggcucagaagccaaguuuccagugcaaaggcuauuaacaaauggaaacucugaguacauuuuuuccccugguucccauagccauuuacccccucaaauaaccuccaugccacaccagucagucagccucaugacccucagcagaaacugugcccucucaucccugauaggcucugggccuuccuucauuugcauuuacuuucuagcccagccuuuaguucuugggucuccucuggagccuguguaaaugggcgccagccgcgauucuugucuacuccuggugcugugaccguguaugacaaugggaugcacauuuuggccagcagugaggccugcagugugguuacccagccuggaaggcucccacuuuugcuuuugucagagcaguuggauucagaagaucucgugcuucucacuguuucccuuccugcugcugagccugccuccacuucccugucaagaccaaggcacagcuugucuugcugggccacguugguugcucugugcugcucuggcuccuggcaggucauccuuugcucccucugucuuuucuaccuuauguggguuaagaaacccucauuggugguguuccccuugcacagcauugacauccguaugugaccccaaagccuccauucuguauuugacuucugccaccccucauuggcaucuuccuucauugagacaguauuucuccucuaaguaacccuuuaacuuuucugguuacccaugcaaacuuuccuguguaagggauuauuuugccuacaacauuuuauguaagauuuuuagacuuaaauuguuuguucugcuuggguccguuuaugauuuaugauuaugauuuguucucucagagggaaaugccugaaugcuaauuuuuagaccucccucaacuccucaaaaagagaagacuaaauuauguuuaagacuuuuuuuuccccuagggcagugaauugccaaggagcuguucuuuggauguggcuuaggucauaccuagacagcuuuagaaugacuugguuuguggaagauaggacuuuuguguggccaugauguuuugugccuccaaaccuuucagcauuauucucaucugaagguucuaccuugcagauguccugugcuuuuggggggaaaucuaagccuugaccagacagaagaaaguguggguggaucugaacagcuuuucacagugggacacuggccuauccccucaaguuuacuugaugcccugcgugacuuuugugguggugaaauuagguuuauaggcugaaggagggggugucaaggguagagaauuugauuugggguauuuauugcccaugcgauugucugccuugcagauagaacaggaaagaaccagcuguacuuuugaugaacauggaucuuagauacacauaugugugaaguggaacuguauggaauugcaguuuuguugggucagaagugaucaagugucaacaguuucauauuguucaaacucacaguuuaaaacacacacccagcacuuccaagcuguuuuccauccuggguacuggaugcuagguacccauaguugucauccuagguacugcucuuugcuagacaaaauaggacaaguucagaggggagggaucaggauggcaaggauucucaggaggguaaugagggguuacauccccagggcuaucaugcugucagcaggcuuuggcuuguucuguguucuacccucaaggagugggccaggggugaugagcaaucacagggagauuuacuuuacccguguuugugaccaaguuguccagagauggaagggcucccuugagcucccuagcauucagccgagguccaggaagaggcugaagggccgggugugcaggggaagugcugggcagaggggacggcuuggucagggcgacuuuuaagcucucuaguaauugucuauuaaggaccauacucaaauggaaacuugauuuaggguaguguuuugguuugguuuuuaaaacaaauacaguguuccccuuguacacuuaaaauacuuaagaagcuuguucucagguauucagcagguaccuaguugaaggaauuggauacuauagagaaguuggaaacugguggucaggguagagccuggggggagguggaggugcgaaaugaagguugagcauguggagagugccagggacugcugaagcggacucagugacccccaguguugcucugagaaagaaaagcuggccuccccucuuuuugggccuguacuaugcuauacccagugucaggguguauuuuucauuagaguuuauucccacagagcccugaggucugguuggugugcagaggaggagcagguuuuagaagucaacccugggaguugguugcauagauauaaccuugaaaaucccauugacauucagaggguguauaauuuuggcacuucaguuaacugagagauuggggcugucucuuuuuguagcccaugaagucuguguucccuuucguacaaccagugugaugaaaaucccucucaguucauugguuccgugaguucgucuggcugggugggauggucauucuguugcugugguuggaggagcuggcuuacucauuagcugcacccacagccucuucagggcugccaucuuguuucugcgccagggcacugcuguccuuguggaguggaggaggcaggaccaggugauuugggacaggucaaaaccagccuuugucacuggcccucucugucugagguccuuccaugaguuaccucuucuuucguucuccugcuccuuaagauguggcccucuguccccucuuccagccucgugucuuccuuugggggcugucgcaggcacuguugcgagccucaucccuugacguugguggcggaucgaggcauucagccugcuacuucauuugccacgugcuuuguagguguccacccuuccuuucugcaggugccacccauccguguuuacugucaguaauacaugccaguauucccagggacagggugaggaaggaagcugccugggacucccuguccugcucuaguuugccgucuguucuguugcaucuaaaucauucauacauuuacggucacucacucuguaccagcugcugugcuggcugcuggacauagcugcucaccacgagggauuuuguggucaguaaggagauggacuuguaaaucaucgguuuaucuccuuaugggcacgggugccaaggaggaaggcaggaguggggaggccccacagagacaggaugccccugagaggcuggaggcuauguaggagcuugcaaagcuugggugggcagaggaugacaugaucagcagucuaggcagaggcacagagacacgaggcucuggggaauuaccaguggaucuggaugacauaguggcauaguagaagguggcgaggccaugagagagcugaguugauacuggagagucuaggcucuccccuuuuagcaggagagagccuccagaggcuucagcaccugcuucaggggagcugcaagcuuagucugggcucugggaagcugauuuuggagcacagcgggaggaggguugguggugaccagugugaggaggaggguuggugaugaccagugugagucucgccuccuaagagacaggagagaacugaaguagggggagggagcagguguggaaaguacccggggaguucugggaucguaggugcccuaguuacggugcccuagugguguuaccaccccacccucauuccugcugugucagugagaaggacuugaaucagaccugcaggucucuguuccugcaggucucugaaaauucuuacuaucuuuuguggacauuugugaagagagggauccaaaaaccaaggaagugaccgaaucaagggaggauguuuuguccuucaucuuagcauccuccuuauucaguuugaagaaguuguguugaaaaguaaggaaauuucagaccuuaguaagucacuaguucuuuguuauuuauaauaauuagaaauacugaacaaugcucuguagcuuagaggguuauauauuuuaacauggcccuuguaauagugauacugaggcuuaggaggguuguaugaggcacugagcccagaaguggcggggaaucugugucuucggaauccaagucccauacucuuuauuucauacugugucaccucccagccuucagggguggagugcugaguguaccucuccucucuuagcaggggcggguccuaacuguugguccauggaaauuucauucugagauagggcccuauccuaaaggaaccagauuuggagucacauagacucagcguagaacaccagccuugccccggaaaugugacacgugcuuggcaagugccugggccucccugggugugccuccuuguauguaacagugauggugucaggaccuuacagggucaaaaggaaucagaucaggggcucccuccacguuagcacacuccaggcugucugccccuucccacaacucugucucugucccuggacucuggagcacaaacguguaguguuagguggauaccgggcccaguuucccugcucaguacugggaagcagcccguggguugcuuuguuucgcgaauugguuuugcugcugguuuugcuguguguggcuugcuggaccagcuguuaucuguaguaucuaaagcguggucuuccugugaaaaacugucuggcguguuguguuccaggacacagguugaacaucacggcggagaacgacugccggcggcugcacugcucccugagagacuugagcucccugcugcaggccgugggccgccuggccgaguacuuuaucggggauguguuugcugcacgguucaaugaugcccucacagucguggaaagguaggcuggcaguuaccuuauggagcuguuccuucuucagaguucagcuuuaccuucuugugugaggggcagcauauugccaaauagcuucugcucuggccccggguaaaucuaggcucugccacauacaagcugauagggaacaaauuacuuaaccucucugaacuucaggucccucauuuacaauaugaaguagauguuguuuccuguagguuuagugugagaauuaaaugagauaaagcacuuagcacugugccuagcacauaacaaaacgccugauaaguuauuuaagguauuguuucuuugaagaucuuguguauaaauguaaacacaguuguagacccaggagaaaccaggagaggucagucuucaugucuuuccucauaggauaaagagauauuaagaaagcccuacugauaaggagucaacuccauuguccaaguaggcagcuagaugcacagggugcuuuuuguguuuuuuccagucccauuagggccucgggagugaaagcuggguagccuccacgccuggcccgaaaggugguucccagccuuucaccacugggcuccuuuucuucuccuuccucuugggucucacaccagguuuacagaugcacuuguugaggaacacuugauucuacucagucagcagucccuccucccuuucuccccucgaaaaacccaagauguaagugacaggacauuuagaucauuucaaggcagcuguugaauugguuagaucaaaacugaguagauguggauccagcccaaagccaagacaccugaugcuucgacuggcccagcagccgcaucacuggugacgugcagaggggaagugagccucaggagccugggugcaugcaugccagacuucacugccacaucuuagcugaaaagcaaagauagccaaggggcuuaaaucccuuaaaagccagauucauauuaauaauaaaaacagcacacaguaguaggacauuuucuguguuuuugcacauggucuuucauuuuguucuguacuuugagagacaggcauugccguuuuauuguugaguaaguacauuguggcucagugaugugagugccuugccucgguucacacagucuuugagagggagaguggauuuuaacaguuuccuggguccacauguugugcgcuuuccaaaccguagcguuuguauugccaguccguuccuccuccucuucuuguacugggcccauuugcacugagguuuagcagggauaagacauguuuuucugucugaaauccaaagauaaguccauuauuugaacuuacucuguuaagcaauauagauauaucuuaucuguucaguuggcggggcgcaguggcucacgcccguaaucccaacacuuugggaggcugaggcgggcagaucaccugaggucaggaguucaagaccagccuaaccaauaugaugaaaccccaucucuacuaaaaauacaaaaauuagccgggcguggggacaugcgccuguaaucccagauacucaggaggcugagacaggagaaucgcuugaaccugggaggcggagguugcagugagcugagauugcgccagugcacuccagccugggcaacaagagugaaacuccgucucaaaaaaaaaaaaaaaagguauaucugucagucaucucaacuuuguagugagaugaugucucaaagauccugaaucauuugauaggucccuaucuuucugcacugcuuagauuuccaagcccagugcuuaaacauacuuguuauuaauauuuugucuucauuuagaauaaaaugugagagaaggcucuuguuaugacuacaugaccuuaauagccaguaugauuagcaguguuuucauuuauugguuacauaaaacaaagcuaauauuagaacugcuaaacacagacacauuaaaagauguuuggaaaugcauuuuuaguguagaacaggauuuaaacaccaggugcauauugguauauuguuuucugauaauaacuguucugaucacgaggacuucgugggacuuugggaaccuuaguucuuuugcccucacuuucuugacugaccggaagugcuccuuuuugauugcuuucucauugcuccccagcaaucagaaauacaaauacaaguuuguauuuguaacaaguuccuuaguugauuguuaugcugggacaaagacaaacacugccuucccuggcauccauuuccagguuuccacgcagaguaggcagagagaaacuagccaggucuuggguuuuuuccccuucacucagaaaggaaugucuuucaacuccaggcgugguggcucaccuguaaucccagcacuuugggaggcugaggugagcagaucgcuugaguccaggaguucaagaccaaccuggacaacaugacgaaaccugucucuacuaaaaagacaaaaaaauuuagcugggugugguggcaugcgccuguaguccccgcuaugggagggggcgcugaggcgggaggaucacuugagccccagaagucuaggcugcagugagccaagaucacuacaauccucuggccugguugacagagcaagacgcuuucucaaaaaaaagaggagagaaaggaauguuguccugucuguaaugaaagaggcauuucccauuuccuacuagauagagcuauuaguuauuguguuuaaugcucguuaguauccagugagcccuugagcaaccagugggcucaacagcuugcuucugaaagaauuguacuugaacauaaaacaccuccaccuauucuagaaacauuugcuccuuucaucugccuccuccaaaguuuuaucaaacauuuucaaauuugaagaaaaguugaaagaauuguacagggaauacacauauacccaccacauagauucuaugguggacaguuugcuguauuuuuuuuauuauguaucaacccaucugaaacauuuccuuuuaaaaaugauuuuaaauaaaagcuaagaugguuuuaucauuaucaaauuuuauagaaaagcccacgucauccuauuucgauaaacugccaaaagagcaguuuuuuuuuuaaaacaaaacaaaacaaaacaaacaaacaggauuuuggucuuguucuguuacccaggcuggagugcaauggcaugauccuggcuuaguccauccucaaccuccugggcucaagcaguccucccuacuuagccucucccaaguagcugagacuacaggcaugugccaccacaucuggauaaaauuuuaaaagacaggguccuacuuuguuguccaggcuggucuugaacuccuggacucaagugauccucccaccuuggccucccaaagugcugggauuacaggcaugagcaaccacauucugccugcuuuuuaagaacuauuuuuuauucuccucauuuauaaaacauuauauauuaauuguagauaauuuggaaaugcagaaaaauagagggaaaaaaaucauccauaaucuacccacucuauccucccccuaaaacaagugguaccaauaagcauauuuuggugacacuucuucccgccugucuucuguuaauagaugaacauucacgauguauucuguauguauauuuaguacaaccaugucauguuuaaaacauccugaauauuuaucauuaaauaugccucuaagcaugguuuuuauuguauauauugcauuguauuaccuccucuggguuggauauuuauauuguuuucaaaguuuuugacaccuucaauaaggcuuuaguuaauaugcuuguauauaaaucuuuaugcauaucucagauuauuuccuuggcauaaaauugaaagucuggucuugauucuuuuuuguauaugaaaaagucugcccuuacgcucuuugcugguaccagccuugucuguuuugucugucuuaguucauaagcugaauguucuuguuuaccugccucuuugccaacagguuggucaaagucacucuguacggaucucagauaaaauuguacaacauugaaacugcugugccaucaguauugaaaccugaccucauugauguguaagucuagaguuugauguuugugcauuuuuaggaaagaccuugcccccaaucuccaaauaauuugauugagaaaaaggaacaguaguggcugccaugaaucagggaaaaacucuuaaacugcaaaccuagaaagagagagagauuuuuuugacuauaugucuggggcagaggcgguuggagaaaguggaauuagguaagugagagcugggauggagauucuauggaguaggcauuucaggaggaaagaacaguacaggcugagacagucacacaggcaggagguggcuacuccauguagugcaagaagagacuggauagguguguugggacuaaugggaaacaccucagaugccaucagucuuuccuguagaucauugacuaaaacuguaggauacuguaggaugcagaagaaugcuuggggaacacauuucucagagauucugauuuuagcagaauggcauaaggccauaaggcuuggguauuugcguauuaaacaagaaccccagguuauuuugaagcaggacaucuagagaccacacucucuaccuacagaaacucuacagauaacaugggaugcuguuaggaaagugacauauggaaggacagggacaggagaugggcaguaucccagagauuucacugcccagaagacuugcuuuagaugagagcaggggguuggcaaacuauggccuuugccaaaucuggcuuacugacugcuuuuguaaauaaaguuuuauugaaacacagcuacauugauuuacauacggucugggagugguuuugcacuauagcagcagaguagaguagcugugacaguguguauguaugcccugcaaaucugaaaauauauacacucggguuuuuacagaaaaggucugccgacuccugcuguagagcauucuugagcugcagauuagauaaacgauggaaagagaaucuuacuuacuauggugguuuuaaacuuuuaaaaaauauauugcuuucccuuuugagaauuuagagaaaguuguaaagcaucucccaagaaagaugccaguuuccuuauaaauacaacaacuuguacacauuuugggaguuucagagccccuccuuucagccuugaggagcucuacagaugugcuagauugacugaaauucuuacuccuaaggcugacuuugauguccuuucucuuuauuuugguauuuagaacuuaaaggguaaugugauucuaaauauaaaauaaaauuuuaaauguaaaauacaaaauaacuguguggucacuaugaauuucaaacuuucaguaacuauauuuucuuacuuuaaaguacuagcacauuuucuuacccaacugcuaauuuugaaaaaguucaaaccuauagaaaaugggaaaaacaggcgaauaagcacccauggacccuuagccuagaguaaccaauuacaaauuggcuuuuguuucuugugcccucucugcacacaauacaugaugaugaugaugaugauuauuauuauuauuuugcugagccauuugaaaauaaacugcauggcugaacgugaugauucauaccuguaaucccagcauuuugggaggccgaggcaggcggaucacuugaggucaggaguucaaguccagccugaccaacguggugaaacccugucucuaccaaaaaauauaaaaauuagccgggcaugguggcacuugcaccuguagucccaacuacucgggaggcugagcugggagagucgcuugaacccgggaggcugagaucacaccacugcucuccagccugggugacagagugagacccugucucaaaaaagaaaagaaagaaaagaaauuacagacaacaugucacuucacccguaaauccuucaguguguguauccuagaaauaaguucauucagcucuuuaacuaugauaucauuaucaacccucacauaauuuaauacauacaauaaugucaucucauauauaguccauauuaaaauuucuucaguugucccaggaauguuuuuguaucuuuuuuuuuucuuggauccaaggucuaacuaaucaugagccacacauuaaauguauuuccuauagucuagaacaguucacccaauuguguuuguaugucugcaugugcgugugugugugagagugacugaggaccuuuugcagauccagaucuuaauuuuuuuaaaagcauguccuacaaucuggauuugucuaauuauuuccauuauauuagauucaguuuaaacauuuuuagcaagguuacuacauaggcaaugaugugccuuuccucuugcaucaugucagaaggcucuuaauaucaaauuucccuguaauuguugaugcugaguuugcuuuuaaaauggugucuaggcuggacacacuggcucauguuuguaaucccagcacuuugggagguugaggugggaagaucgcuugagcccaggaguuugagaggagccugggcaacauagugagacucugucccuaccaaaaaaaaaaaaaaaaauagccggacauaguggugcaugccuguggccccagccacuuagaauugcaagccaggagaauugcuugagcccaggaguuggaggcugcugugagcuaugauugugccacugcacuccugccugggcaacagagcgagacccuguuucagcaacauaaauaaguaaauaaagugauaccugccuauauccuaauucugucugcugaaagcuccuagaaacagugacaauccaguagcaauccuauccguuuuccccaggucuugguuucucaaauccauucuccagagcaccuuggagaaaaaagcucaagucugggggggugauguuggacaaucuugccaagucagcaaguaaggaagugcucagugacuguugggaacaugugaagaggaugcaggacccagcuugaaaggguucuuccuggucaaacuugacaguucagucaucaagaaagaauaaggacaauaaugaauuauaccaguuugaaugaaaauaaucuacucauucaaagugauuaacaggcuaggccggugcagugccucacaccugcaaucccagcccuuugggaggccaaggcagaaggaucgcuugaagucaggaguuugagaccagccuggccaacauagaccccauuucuacaaaaaauacgacaauuagccuggcaugguggcauggaccuguaaucccagcuacuugggaggcugaagcaggagaaucacuugagcccagaagguugaggcugcagugagccaugaucgugccccugcaugccagccugagcaacagaauaugacccugucucaaguaaacaaacagauaaacaaaaacccaaagugauuaacaaaauaaggaugagaggagggaaagccucuuuuuagagaagacugccaacuaaugaggagaaaaggaaagauagaaaaauuaccaauucacaaccaccaauguaauacugauuuaggcaggagucguuaauaaaugcccaaaccaugaggaacacugucuuugugucaccucauaguaguaccaccuuacaacuuacuaauuauuaccgaaagguaauuacauuuagguauguuggaaggcuugguguuuugaagcuccgagacaacugucucuccuuguuuaagauugauuguuuauuauauuugaugaauugcauacuuuuuugauguauauuuuguugcauguacgaugcagucaguacagccuuugcugaaaccaaacauagucuuugccgccucaguuauucccuagccagguggaauguguggugcaguggaagcuuaaacuccaaaaucugacaucaaagcucuguuuauaaagcugucacaccugguaguugucuacgcuuuagucugcagcuaggaauguuaaauuuguacuaguucugaagucaacacaugaucacuuaaguucuuugauuuugcuuuuauaauuuaccuuucucuuaggugagcaugugucacagaaagauugaauaagauucaguagacauugacuaacugccuucugugcucuagucagcgguggcaauguuuagaugaugaauaucuuaguuuuuagguucuacgugaaccgguaaaugauuucuaugcuguugcccaugucuuagaacagcaaaugcaguggaugcaauucuuaccuccuaugaaaaugaguugaacgcuaauauauuuucaccuuaaccuuuaaaaucacaucuucuuuucuuucugcaggcaugcucagucccuggcugcgcugcaggcuuacucucacugguuagcacaguauugcagugaaguucaccggcagaacacgcagcaguucgugacacucaucucuacuaccauggaugcaaucacaccucuaaucagcaccaaggucucgaaacagcaaagccuacaccuuuuaucuaacucucugucucuccuucuguuccuauacccauuuacuagaaaaucuaaauaugacacagaguuagacccauaaaucuuucugcuguuauacaucuguuuuauuucauguuccuuuuuaguuguagccuacaugcauucagauacaacuuuacuuuuuuaguuaucugaguuccacaugaauacaugcucacugugaaaaaguaaaauaucauucagauuuccagacuaaaaaguugugauaccucugaaacauuuuccuucgcgcgguaagcacaguugggcagugguugugcaggcacaccucauuuuauugcacuucccuuuauugcgcuucacagagacuguguuuuuuacaaguugaaggcuuauggcaacccugcaucaagcaaaucugucagcaccauuuuuuugacaguauuuggugcuuccauguguuacauuuugguaauuguuagaauauuucagacuuuuuuguuacuauaucuuacagcgauuugugaucagugaucuuuaauguuacuauuguaauuauuuuggagugccacaaaccaaagacugcaaacuugauugauaaauguguguguucugacugcuccacugauuggaggcuuccccaucuuccugucuuuaggccucccuauucccugagccauuuaauaacccuacaaugaccuuuacguguucgagugaaaggaagagucacaugucucuuacuuuaaauaaaaaucuagaaaugauuaagcuuagugaggaaggcgugucaaaagccaggauaggccaaaggcucuuuuuuuuuuuuuuuugucguuuuuguuguuguugagauggagucucgcucugucgcccgggcuggagugcaguggcgugaucuuggcucacugcaagcuccgucucccggguucacgccauucuccugccucagccucuugaguagcugggacuacuggcgccugccgccuugccuggcuaauuuuuuuguauuuuuuguagagacgggguuucaccauguuagccaggauggucuugaucuccugaccucaugaucugcccgccuuggccucccaaagugcugggauuacgggcgugagccaccgcgcccggccuggccaaaggcucuugagccaaacagccaaguugugaaugcaaaggaaaaguucuuggaggagauuaaaauuucugcuucagugaacacaugagugaugagaaaguacaacagccuuguuguugauaugaggaagguuucagugguuuggauagaccaagcuagccacaacauucccuuaagccaaagccaaauccagaucaggcccuucaauucugugaaggcugagagaggugaggaagcuacagaagaagaguuggaagcuaacacagguugguucaugagguuuaaggaaagaagccaucuccaggaugaagcagcaagugcugauggagaagcugcagcaaguucuccagaaguucuagaucacugcugaagguggccauacuaaacaacagauuuucuguguagaugagacagcuuuauacuggaagaaggugccaucugggacuuggauagccagagaggaggagucagugccuggcuucagaggacaggccaacucucuugucagggggcaacugcaacuggagacuucagguugaagccagugcucauguaucauucugaaaauccuagggcccuuaggaauuaugcugaaucuacuuugccugucucuauaaauggaacaacaaagccugaaugacagcacaucuguuuacaucaugguuuacugaauauuuuaagcucauuauggagaccugcucagaaaaaaagauuccuuucaaaaucugcugauuggcaaugcaccugguuaccuaaggacucagauggagauguucaaagauauuaguuuccauaguuuccauggcugcucacacaacauccauucuguaguucuguagcccaugggucaagggguaauuuuggcuuucaagucuuacuguuucagaaauacguuucauaagacuauagcugccauagauggugguuccuccaguggaucugggcaaauaaacugaaaaccuucugggaaggauucaccauucuagaugccauuaaagacauucaugauucauggaagcagaucaaaauaucagcauuaaugggaguuuggaagaaguugguucccagccucauagaugacuuuaagggguucaggacuucaguaaagaaaguaacugcagauguggaaauaacaggagaacuagaggcggagucugaagaugggauggaauugcugcaaucucaggaucaagcuugaacagauggggacuugcuucuuguaaaugaccaaagaaaguggguuuuugagauggaaucaacuggugaagaugcugugaacauuguugaaauaacagaggauuagaauaacacauaaacucaguugaugaagcagcagcaggguuugagaggacugacuccaacuuugaaagaaguucuacugugggcaaaaugcuaugaaacggcaccgcaugcuccagagaaauauuucaugaaaggaagucaaucgaugcagcaaacuucauuguugucuuauuuuaaguaauugccacagccaccccaacuuugagcaaccaccacccuguucagucagcagcagucacuuucaaggaagacccuucaccagcaaaaagauuaccgcucugaaggcucagaugauuguuagcauuuuuagcaauaaacuacuuuuuaacuaagauauguacauuguuuucuuagacauaaugcuuauugcacacuuuauagacuauaguguaaacaaaacauaugcauugggaaacaaaaaaauuagugugccuugcguuauugcauaauuugcuuuauugugguggucuggagcugaaccugcaguaucucugagguaugccuguauauccuuccagacuuuuuucucuuuuuauguaauaaguaauaacuaaguuuguagauagcuggagauauagcugcuuuugccuaacaguaugccuucauuuuccuuuacauauguacagcaacuucagauugucaaaauguccagugguuuuuuuuuuuuuuuuuugugaggauguauaauaauuuuccuauugcuagaaaugaguuccuuuuauguccaucuuacauaugcuagugggccugaaggauagauuccuggaaguggaauuacugagucaaagguuauauccauguuaaaacuggacagauucuauuauguuauccuccaagucugcuauauuacuagagcauauauguguuuauucuuugaauuuuuuuguaguuuuagucauacauaacauuuuauacauuuuuaaacaguguauuguuuuaauaacaauguguugcuuuccauaaauuuauguuguauuuauaauuauaacuuugaaaauaguccuaucccaucaggaauauguuucauuauuuuccuagccauugcuggacuucuaggcugccucccuuaaaaaauaaaaaauuauaaagaauucugaaaugcacacauucaugaauguagcuuuacccuuuuagguaaucuucuuagaguaaguauuauagguuauagguaaucuuagaguaaggguuaaagguuaggaauauuuugugacuuugggaaaucauaguaauuuuuuucccgaaguaauucugccugccuugacuuuuuggugugcuguuuuuaucuuagucuuaccagcauuaggucccaucuguaacacguuuuucuccuuugcuaauuugaaagcaacagugguaauugaaccaaguauuugauaggcaugcugaagggaaagcaguaggagagacuggccugaguguuaaggcacagaagagucgggggcucggggagaucuuggcucugcuggaacaauuagugaggugaagaauucuaggaccuggaugacaugccagggagugugauuuaauagcugauagggagccacugcagacucuaagcugagaagugccugaguucaaggcugcuggugacugugaaggaggaacgggaggaggugauaauggcugcggcaggagcuguggacaugacagagaagaugggcuucucuuguagucaucauaggaaaaauucuugagcuagauagggccuaggugguguaauuuggaaaccaagaaugacacauagcuuguggcugccucagcaaaguucgaaucccagucuuacagggauguggugagcugacgugcccucuucccucugcagguccaagacaagcugcugcuaucugcgugccacuuacuggucucacuggccaccaccgugcggcccgucuuucugaucagcaucccugcagugcagaaaguauucaacagaaucacugaugccucugcccugcgacuugucgauaaggugaggccccagagcucccccgggguccccagggcugugugacugagacccaaggaagcugaggaagaagagucuggccuuugauuuuguacucagagcuuacaggcuguaccagcauagacagauuucuuauuguguggcacugacacagacucagugauucucaucgugcccauucuaaggcaggcagucagugugcugauugaggcguggaaaagcaccucccagugugcagaaagguuuugcugcuuugcagccugguaauuucggccaguguugugagaauucucuuugcauucuuucugauucaaagcagucugguuuuuguugucacuguucuguguguguucuuugggguugagaagugccaggcaagugcauuuucuuagaauccucaaaggaggcucaagcuagaaguuuaaaaaccaccuaacaggagggagggcaggaagguuugaagaggguaccagagggcaccaggaugugauugcaggaugugaccuggugcuaggggcauggauugucacggauucuccugcaaguccugcucuaaguagcuucucagaggacucagaagccaccagcugaacaaugccugagauucagugucugcagugugauuuuucccucucuaauacuucaaguaucagauuagagaggaaacgagagguuagcucuggguuaugcuagaccuagacauggugcuauuacuucauuucaucuuccucccuaaguugccuuccaguuggaccaaaggccuugcccagguugcaagaaacgagccugggggcuaggguuccaggugugcagccagcgggugcugaaggcuguguugggcaugccgcaccacggucuuuggcucugaccucugauggaugccuuuggggucucuuguaggcccagguguuggugugccgagcccucucuaacaucuugcugcuuccguggccaaaccuuccagagaaugagcagcaguggcccgugcgcuccaucaaccacgccagccucaucucugcacucucccgggacuaucgcaaccugaagcccagugcuguugccccacagagaaagaugccacuggaugacaguaagugaccccuaggcuaggacagcuggggaaggagguaggcaggcauuguucuuuguggcagaugagauuugccccggaggcuccugagguaaauuuuuuuuguucauagucccacagaggcugagcaggaagucauacuugggggugggauccugcuaccuuuggaauucaguuaagacagcagccagaccuauuuccagaaucaaacugucccuucucuuauuuaaaauguaaaaaaugcuggagcccuaagaaaaaauggaagacacuggugauggugccuucugucuauaaaauacaucuuaaggugguuauugaucuauuucagaugcuuguguaggcaaacaaagcaguucaccucuacacgcugggaaaaugcgcucaagaacuauuuuuccagauugguuucaaccuuuuuccaaauacagaucuuccagagguuuugaaagagcuuaguuucuuaaaaaauggcacuugaaguuugcuuguuuauauuaaagaaagagggaaaaaaaugaauaaggaaauaucucuuugaaauaacaaauaguaccgaaauauuuuaaaaauacgagcuccuuucacaaaaagaaaauaauagaacauuauuagauggugccauuuauggaaugucagcaaaaaugcuuugugaaaugucagaaauaguaauaaauacuauacucuuuaaaaaacacuacuuuuauaacuaggaagauuaacauaugugcauuguacaaauacauuaaaauagaauaauacaaagaaggaaaaaguaacuccuaaaucugaccaguuuuaauauuuuagaaaguaaccauuuuaaccaugcuuccuucuuaccuucccuuuucuauuuuaaaauaugcuucaugguuacauagcuggaugagaguagcugacauauugaggguauacuguguacuaggcucuugccuuggugauucuauauccaucgucaagucucuggcuaugccaguaucaacuuucaaagucugguguuggucucuuccugguucuaaguauuuuucaaaaaucaguaauucauucaguucuuacauuagccuuaugaguucgguacuguuaggaucuugauugaugauuagcaugaggaagcugaggucuagaagauuaaggaacuugcccagggcuugcauccagcuguuguggagucaugcuuuaucacguguaauggucuccuuuccgcacuuuaucuuacaugggaguuauguuggucugcaugggcgaggauaugcucagugguaacaaacaacuccaaaaguguaguggcuuaauacaagaagaaaaaggauauguuguuuguacuauauguccagcuugggucagcagaguggggaggucacauagggacccaggcuguggaaggcuccauuucaguguguucacucuggaagggauuguggugaauugcguagugguucuuaaaggucuugccugaaacuaacacuacuuccaccucuauuuccuuggccagagccagcuacauggccuuggcuuaacucagagggcagggaggugugaugccacugugugcugaaaggguuugcaguguaguaugugaaugacgucuucaguaugcugacugugugcaggcacuggguugagcacuuuguauacguuauuucauguaacuuccuguguaacccuguaacccugugagguaugucuuauccucauuccacaguguugaaauuaagguuggaaaguuucauuuuucuuaucucaacuuuauacuuugaaaaaaaaaaauuccaaaccuacagacuagccaaaggaauaagaaaaugaacaacugcaucucucucacccagauucacuaauugugaauguuuugccacauuuaugcuuuuuucugcaacacacuuuuucuuaaaagccagcuguuuaaguugcagauaauugacacuucaucucugacuacuuaaccuuuguaucuauauagaacaagauauuaaacauugguacaauaauguuauuuaaaauguagccauauuaacacuuuccccaguuguuaccaaauuguucuuuuuugcuuuuaaaaaauccaggauguaaucuaggauaguuuuauuguguuugguuguuauaucucuuuagucuccuuugauccagaagagcaugcccaguuuuugucuuucgugacauuggcauuuuugaagcguccaggccuguuuucuugucauaugucuccuagucuuguuuugccugauuguuuccauagguugugguguaguggugcauguucguguucgcauuuccucuugcauugcuucuguuugucccauccuuggugaugcucagucuggaugccuguugggaguagggccugccagucuguccauugggaaggugcuuggcagguguaauugcucaggacuguagagaaagugggcgaggucaagaguuggacuugggucugaauggcuccagcuccuguguucugcaccacuuugcugcauugccucuuucuucuugaaaacaaaaaaaaaaaaaagaaaagaaaaaagguuuuaaugguuuuauaauguccugucucauggaaguauaacaguuacccaccccauucuccuauuauuauauacuuauagugcuuucaauuuuugacuuguauuuuuuuuaaauacaucuuuuguccucguuugaauuuccuuaaaugccagaggucagauuuuggucucuugacuguugguuuuuugcucuaaacugcuuccccuguugccugugcguucuugaggaaguggcugcccugagugcaguuuccuagcugaguagaaguccaugugcuuguaguuguggacggcucccugcucagcagugugggugagccuuuccuuuacucuccagugucacugugacugggggaccaggaccaggccuguggcgagaagcgucuuccuucauccucagcccugugaguggggcgaugcucucuauccacguguucagaugaggggcagcagggccaggccugccuccaucugccuccugagcaugucuucuuucugccguaccccuuccucaaagcugcggcagucccacagaggcugcugagcacugggguucgggggacccagagacugcugccaagugggaggcagcucucagcccagcucuggcucagccucugguggucgccaggguugagucugcuaggcucaggcugagccaugggcgucacuuuggggaggcuggugggaaacucugcaucuuaagagggugacuccacucgcgcugggaacaauggcagcaucuccguccuggaccuucuuagauggcuggcacacugcuagcaucguucgggaccuugucucuaauccccacugcagcacugccagagugggguugucggcucucccagauggaugaggguccugcccauggcacauagccuucagauggucaccugugguucauagccagggcucucugaccucugccuguuugcggcccacuacaucuguuuucccugugugccauauggagucaaaagucaucucaggguuagcauuauguauugucaauaacauaauaacaguaauuauaugccuuaucaagcuacggggcuaauaggccaaagauggaucaggcagguuguucuugcagccagcaccauuacaugugcauggcagguguuugugggauuacugggcuggaguagcaucccacugagugacaagguuugagcugcauguguccguccuggccugugaccuuaugacacucauuuucucaccagucuauucaccaucuuuuagauuugauuaaauccaaggcacccaaccuggggguacauuuauuuaucuuuuuucuucuguggacuuguugccaauggccagaggcaaaacagaggcaaaaaccugagcaagcaggcaggcaggcaucuucuccccaacacacauuccaggcuucuggaguccuggcaguaauaauaguaaaaacaaaaacuaaaacauaaagagaggagaauuuauauuguaaucaagagacuguuccuuuagugagacucgugugaucaucuucuugguaccuuugcaaguuuccucccucucccuugugucuccucuuaccaugcuuucuccccagacagcuuauaaccugcaacucaucuugauuugcagccaaacugauuauccaccagacacucagcgucuuagaagauauuguggagaauaucucgggggaguccaccaagucucgacagauuugcuaccagucgcugcaggaaucuguucaggucucccuggcccucuuuccagcuuuuauccaucagucagguaggagcuggcccagaggccccacugguggguggugcuaacaagggccagaauacccacuuagaucuguagaacacacugagucggugcaguacaggccuugacuuguuccgugcaacgaaacccgguacugaggggaaagggcagugauguuuauuuguggagucuagggccaaggcccuuuggaaaagugagcagagcucuccauaugggccuuggcaccuacaagagaaggcaagagagcuuuuuuggcuuaguucuccuuauuuuguggcaaggugcauuugccgagaucguuccccucacccuugucugucacugucagugauagagggccucucuagcucuguggauguacuugccuagcucucaugacagcauuauaguagucuugucaguuuuacaagagaaauaucaggcacuucucagucagcaaauauucauugccucuugcaagcagauugcgugcaguuagggcugaaacacacuacacaagaugauuguugagaucuggaagugaaacugcccuauauguaaccaguauuuucugcaauuaauccauuuaauggaccagggccaugcaaccuaaauacaccuucauuauccacuuucaaccacuuaaccccugacccagcugcagggauuauuagucauagggggaaauggcuuaagcacucagguguugacccaguuggcauucaucagugugggcacaaagugaucccucuccagugaaacucugaccaucacuggaugucgggcaaugagggaggguucgagaugaccuucauuuccuguagugagccaccagguggagguucccuauaccagaacuauuuucucagcaugucccuaaucguuuuccacuuuccaucauuggcccugaugguguuggggaaauguuuccagcaggaagcuguagagaaagcugauagugcagauuucaggaguagguugaugaagcccaggguucugguucucacugugugcaagccucugacgauaucucugccccuuuccucagaugugacugaugagaugcugagcuucuuccucacucuguuucgaggccuuagaguacagaugggugugccuuucacugagcaaaucauacagacuuuccucaacauguuuaccagguaagcacagacccaccaucuauaguuuucagauucaagggagaaguggugggucuggcgacaaaguguggcuuuuugcuccuguucugcacuugccacagcauggguuuucaugcuggcccccagagaaacaugugguugcucacuguguggcuuucuccucuguagagagcaguuagccgagagcauccuccacgagggcagcacaggcugccgggugguggagaaguuucugaagauccugcagguggugguccaggagccaggccagguguucaagcccuuccuccccagcaucaucgcccugugcauggagcaaguguaucccaucauugccgagguaggggcucagacgguccccugugcagcaccccccaucuccagauugggaagggaaugagauuucacagaaaauguauuguguuuuaaaguucauuuguuaguuuaauaugcuuguaaaguaguuucucccaaggaagaaggccuuuaguggugugguacaguguuuuuauauugauugaguucauuggagcuagucuaguguaagcauggcaguuauuccacagggucaguugcuaagaucagucuccugcggcaaauuuuauaccuuuaagagacucugguuuucuauagcaaacauucuaacauauguacuuuccuauuagaaacauucauggucucgaggauacaaggcaaguucuugaaaccauucaaacaaaccuuucaguguuacaggaaagcccuuuguccuucuuagaaaauaggcaggcacucagcauaauaagacccggaauaaguauagauuuaauuucaguuuuuuugguaauagucguauaaauaagaguuaaucuuuaacugucugaacugagacugggacaggucugguugcugugcauuacgaaaugcacugggccuaugaggcuucuucuguggaugcuuguggccccuggugucuauuuaauuuuaaucaaggcugaacugaauauaugugggccuucuaauuuugaauucugcagagacauuuggaauaagggauugggggaguuggagucaaugagaaaacacugcugagccugacccuucuccucuaacuccucucagaauccuggcuacugggaaagaggagacuggcccagagagccuggcucccaaguguucuuuaaacccuccccuucuggggagcagaaucgcuuuaaggcguugggucugucuuuagccuccgugguuguguaagaccaacagguuagugggacagcauuuuuuauccugggaaaaggaacaagcaagaagaucugacaggucgaauagaacaggaaauccauacuccuaauuguucauccacuugguagcuuuuuucuaguguaaaagcugagugcucaucagaaaaaggggcccuuggcacugacccgugcauucucucucaaaugugggccaugucucuccugaagaacucgcggugugaaccgccaacuccaggggcuagaugucuuuugcacaggcagugacaggacuccaggggcuggaugucuuuugcgcagguagugacaggcauguggauggaguguugacacucggcuugcugucacgaggcgucuccuaggcaucuuugcugcccugggcccaggccggagcagcuccgcaagcugcaggucugagcgucugugugucuuugcagcgucccuccccugaugugaaggccgagcuguuugagcuccuuuuccggacgcuccaucacaacuggagguacuucuucaaguccaccgugcuggccaguguccagagggggaucgcugaggagcagauggagaaugagccccaguucagugccaucaugcagguaacgugggggcgggguugcugccaggugacuuccucuaaccugaccacugcagcgaguccugucuucgaagccccacagucucgggucugaagcucaguucugccuguuaguauugaugaaguuaauuaauuucuuggagccucaguuucuucaucugcaaaguggagcuaauguugccugggucacagguuuguugugagguuaaaugagaugacauacacaaagugcaugacacuuggagaugcuugauaaacgucaguuccgcugaccucauagugcuguuuccccaaguguaaagagccugccuaugccagagucaccgagggccuucuuagcggggagcugccugaauaugagucuccgcaggagggccccagaccugcacugugauucugacucugaccauacugggagaaacacugcccugggagggagcauucgcuuucagggcagaugcagcuguccauuggagagagugcacugucugggggcuaaauaccccuugcuguggaagacugggacggcaucaccucgcccagacagccagccugcucuguggcugugucaggcacgcucccagggucugcacucaagugucugacguucucaucugagucuagcuaggggagucucuuuugguauuuucagugcaugcuuuuccucauggggaagcaagagggauuuccacccucccuccagcucccuacuagcacacagcaugcacacaggcaugcacgugcgcaugcgcgcgcacacacacacauacugacucuuguguggcaguucuuuucaggcacgugcccuugcccuggccuucccaucccuggcacccaccgaggccucaggucugcaguacucaaguguuugcgccuccccugccuuucucuugaacccuguccuugccuggaagacuucuuuggcacgcuggugccugguccccacugagggcuggugaaaggcacuuuggagaauaguuucacaguuuggcaguuucuuuuaaaguuaaguguguaguuacuguaugaccuagcagucucacuucuaaguauuuuacccaagauaaaugaaagcauauguucacacaaccuguacacugauguuuauagaagcuguuucauaauugccaaagcuggaaacacuuugaguauccagcagcugaauggaugaacaggcucgugcaugccucuaagggacuggcacucggcaauaagcaagcauggauucuugguacaaucagcagcauagaugaguuucacaugcauucugucaggugaaagaagcuagaugccaaaggcuaugcaugguaggaucccaugccauucuaugacauucuggaaaagguagaaccacagggacagauaaugagcagugguugccuuaggggugagggugugaggggacguuccaggugauggaaguguccugucuugguugugaugguggugguacaaauccacagguaggucagaauucauagaaagauaaaccucaaaaguuuacucuguuauacuuccaugaaccuaacuuuaaacaguaaauaaguggaaacuauuggucaucauggagaucucaucccugcugcagggauuacaagauccuccucugguagcuuaggggcccagggacagaaugacaaagcagucaccacuuguuuuguagggggguccugcagaccaccggccuccccgacugcccccauggucacuuucuauucuuucuguuggagcagggcacuuuguguuggugugcgggguguuucuuuuugccccugaacuaguaauuuuuuucuuuuuucuuuuuuugagauaagucuugcucuguugccuaggcuggagugcagugagugguaggaucucagcuuacugcaaucucugccuccuggauugaagugauucuccugccucagccucccgaguagcugugauuacaggcguccgccaccacgccuggcuaauuuuuguauuuuuaguagagaugggguuuuaccguguuggccaggcuggucuugaacucccacccuucagugauccgcccaccucggcuucccaaagugcugggauuacaggacugagcuucugugccuggacugaacuaguaacuuuuacacccaggaauuccaaagcaguuuaaaaauacuuugcuuagcccccaggcagaggcuuaaccuccagguggaggcuccaugaaggagccuguagggcuuguggcuuuugagacgggggaugcaagaaggagggcaagggaggggauugcuuggcuugagcaggagcaggcaggcaggcuuuggugucugucugccaggauugcugagggauuugacuagaggugugagcuucuugcuucaaagccagguccugugauggguuucuagagguuuguuaaaaaagguauauaugagaccauaauaagaagcaaggcccgguggggaaaacaugaacucugagacuuaggaggagcgucguagaggucugagcuggugggccagaagcaucaagacaauggguacccuggcccuggcacuuguucuucugacaugggguagaugcuccagaagugcuuggucuugcaguuuauaaaaugguggucucauuuccuaggcuuucggacaguccuuucuccagcccgacauccaccuuuuuaaacaaaaucucuucuacuuggagacucucaacaccaagcagaagcuguaccacaagguaagugccccagcucuuggaaauauucuuccaucaggggcauuguggccugugucccacccucagguuacucacuggagagugugacagaaaguggaugggacccgggacaggccccugggggcuggcugcugcucaccuggucucucugccugcagaagaucuuccggacugccaugcuguuccaguuugugaacgugcugcuccagguccugguccacaagucccaugaucuucugcaggaggagauuggcaucgccaucuacaacauggccucagucgacuuugauggcuucuuugccgccuuccucccagaguuccugaccagcugugaugguguggaugccaaccagaaaagugugcuggggcggaauuucaagauggaucgggugaggagagaaagaggccgggcuaagaggagggcagagugggcacgcaagccuggcaccugugcagcaaggagggggcacauugaggccucugggcguggucugugcccacccugcagcuuggcggcagcucacgagaugccugcugaccuggugcuguagccugauugaggggcacagccuuuuccccagucuuggugucuguagcacguauguucuuagucucagccauggaggucccgaguuccuggcucugcagccccuccauuugucuuggcaucuuuguucauacccaggacccugccguucucccuccugggugaugagccccgguggggccagcauuggagugugcccaggcuugcauucaggcugagaugguuggugcuugggagcugcacuucuggguccccaggguuagaggugggacccagguuccccggcugucuugggcucuuuccagaccagccccagcucagcuugggcugaguugcugccagguccugggaggagcccuccuaguacucacccucuugucccacugcugccaccugugcagggacugucaggugggcuguccccacccgugcagcaccucggugggagcugggugcugcuggcucuugguguccaugaggccaucuuguuggagccugacagugccugggaccuccuuccccauggggcucaccuguucucuucuuccugugucaggugaccaggccucucucuugccugauaggaacuucugggaacuuuuccuuguaccguuuuauacuugaugaaauuaggaaaagaaaucgcuuucucccugguccucuugggguucuugaccugaguccucugugaagcagcuuguccacggcuccaccguagugcucagaugcacacacugcucucacuggugcaaaccuggccgccugcuuuccucauuugccacguguggcagggaagcuuuugcuuagacucauccuguucuccuuugucuuggggucuuccuuuucuugggacuuguucucuccuaagccucuuccaguucacuucagccccuggauauguuuuuuccuuuuucuagaggccagauccuaauacuuaaugaucagcuucuaacgacaucaauaucagucaacuuuuugauuuaaagcugugguuucaaaaucuaguuauaggccaggcgcggugucucacaccuguaaucucagcacuuugggaggccaaggcgggcggaucacuugagguuaggggguuugagaccagccuggccaacauggcgaaacccugucucuacuaaaaauaaaaaaaauuagucaggugugguggcacacgccuguaaucccagcugcuugggaggcugaggcacaagaaucucuugaacccgggaggcagagguugcagugagcggagguugugccacugcacuccagccugggcggcagagugggacuuugucucaaaaaaaaaaaucuaguuauaucagaagcaccugggguacuuauuaaaaauggagaaacagacuucuguguucuacccaggaaauucugguuuggcauuugggagccacugauuuaaaagacaucccuuaguugguuuuuugaggguaaaauaaaagaaucaccaccuuccauucagucacgcacuguguguuugaagccagcugcuucucaagccccgggccaggaacuggggcaccagucccagccuucaccaagucuuucaugguagacaggccaauacagcacccucuguggaccacauagugccaagcaugugacaugucuuggcucgaguaagccuucuaacaagccucugaaguguggguccuguuacucccccauuucacagauggugggggcucagaaggugagcaguucacagaacuuggaagugguagagcugcgaagcaggaggcagaccuggguguucuggccccagagccugcacacacuccccagaagcagauugcucaggacagaggcgcugagcuggcugcuggggccaggaaauaggaggcaucugugcagacuuugggaagaggcaggcuuugaauggaguucuggaagaggaauagugguugggcaggaaaaugaacuugguccugcucauggcucugcuggggcuugcugggccuguuugaguccucaccgggaccuacacugaaaaaaaaagcagggucucaccgugugcaugauggcggaggucagggccucacuucuggcccagggccuuccauggcccacgcugcgcccagugggacaggccuugggacuguguuugcugcugcucggguggcucucgaggggcaggggcggccuggagccccguggguaaagguucugcagacauugcucggugugcgcgucaccucaaggggccauggugaagaagagggcugucaccacagccaugucugcguuugaggggccggacucaggagcaagugugcuggucucuucagugugagcuggggccagcuucuucauggugcagcgcuuuggucuuucuguccuuagacuagugguucugguagggcuugguggcagccuuguggugaggacucagugaguugaugucuguauguugauugcagcagugucuggcacccgagaggcccuagggacguauuccucuuguucuuuuucucccacagcgccuggcacagagucucugugacacgcagugcaacagugaauagaaguuuugaguuuuagaaagugcuccccuaucuucagugcacacucugggauggaaguagcuguuggggucuggugggugggugaccugguguguuguuggcugcagcuaugccccugccuuccaggaccugcccucauucacccagaaugugcacaggcuggucaacgaccugcgcuacuacagacucugcaacgacagccugcccccuggcacugugaagcucuaggccugcuacugccuggggacacggacuucugcugcugccaccugcgccagcccuaccuuccaccacagaugucucccagaugggccuuggucacacuccuuggcuucucccaccgcaagcaacgcugccugccucugccgcuccuccacaucuugccgcugcccagcagagcuggcuucuggguccaccugagcacuggacggugcucccagggcguuggagcaggcggagggguguguggccagguacuaggaggcaccaggaaaucccgcgggguggcccaugcagaccaggcgcacguggcucauggggcagaauugccaaggacagcucacgacagugccaccuucucaccauuccagccaaggagagaugugacguuggaacugcucuggcacuucugucaagccucccccgccccaauugccuugagaucucugcucuuugucagagauuugcaaagacucacguuuuuguuguuuucucaucauuccauugugauacuaagaaacuaagaagcuuaaugaaaagaaauaaaaugccuauguuguuguucuagaaacccuggcuggggagcugcuugcuacucacagccuccuugaggccggguucccagcaaggugcauccugaugggaaugugggcagugcggcuuggagugggcuggcuccuggcgucucccaccuucuaauggcaucucccugacugcucuuacucagcgaggggagggggucucacugacaguuggccagaugauggagggaggcugcagucugggagggggucucacugaugguuggccugguacugguggaggcuggaggcugggaggggguguugcugaugguuggccuggugguggagggaggcuggaguccaggcugccugacuccuguggccccuguggcacccacucccccugccccccagggugggaagugugggcuccaccucccccaccugcuagggaauagauuccuucccacgaugugcagcaggaccuggcccuccguggccugaagucucgcuggaggacagggagguggggucucaugauggauuggcugggugagaauagagguuggagagggagggagggugugacucugugaggguggggaugggugggacuuggggcucuaugaugugucugagagcuggggcuuugcccagacguucauguguggaagcggcauuugucaucaaauuguccagaaucaggaaccagcaccuccuccugcgcuaaguaucaugaugacugggcaggcccaaauggggugguugcugauguggacuacagcgccuggcagggagagauuggcucaccuggacgugagggcaggcguugacuggcuuguugccaggccuggggaaguggggagcuguggguugaugucuguuucugagacuuccauaggaaucaccugggcaggggcugggccggggugagcagggcgugcaugaugugugcuuguguggcaggcccucguccaugucagucacagccucccgacugcagcgagcucugcuccagaguucagaaaggagagaauagaaaugccgauggcucuucugcagaaaggaauuagcauccaauuaugccugggcuauauauaccaccucaccugccugcuagggaaggccaggagugcugucugugccugagacugugaaagggcuuuuuccuuuggagauggagggguugaagggauaggauuuguugccugugaaccccacccuuggacagaagaacacagguaggacuuaggagcgcagaggaaaggccaauggggaguaagcugggcugggauggaguuuuuuuuuuuuuuuuugagacagagucucgcucugucgccaggcuggagcgcgguggcgcugcaaccuccaccucccggguucaagugauuuucccaccucagccucccgaguaguuacaggcaugcgccaucacgcccagcuaauuuuuguauuuuuaguagagaugggauuucaccauguuggccaggauggucugaaucucuaccuuccaccguagaugucucccagacggaccucgugauccaccugccucggccucccaaagugcugggauuacagaugugagccaccgcaccuggccuuuuuuuuuuuuuuuuuuaagagacaaggucucacucugucacccaggcuggagugcagugaugcagucauggcucacugcagucuugacuuacagcuuuuagugauccucccaccucagccucucgaguagcugggacuacagaugugcaucaccaugccuggcuaguucuguuuauuuuuuguagagaugggaucucacuguguugcccaggcuggucucaaacuccugggcucaagcgauccaaagugcugagacuacaggcuuuugagacgccauggcuggucaaauggaggauguucuuuccaggacugauagcauggcccagggguguggguuguagugagcccuaauucuuagaggugugcgagcuggucuuugaccugaccuaauucuuaaaguuuuuauuuauuuguuuauuuuuuugggacagagucuuggccuguggcccaggcuggagugcagucgugccaucuuggcucacugcaaccuccgccuccuggguucaagugauucuccugccucagccucccaaguagcugggauuacacaggugcaugcucccacacccagcuaauuuuuguauuuuuaguagagaugggguuucaccauguuggccaggcuggucuugaacuccugaccucaagugagccaccugccuuggccuccccaagugcugggauuacagacgugagccaccacaccuggcucuuugauuugauucuuaccugcagugccucacauagggccuggcaugaagcaggcuuaagaagcacggguagaauugagugaguucucagguccuagacauauccagaaagugugucuccccauucugaggaaggggauggggaaaggauagagcuggacaagagugggccuuuugggccgggcacaguggcucacagcuguaaucgcagcacuuugggaggccgaggcgagaggaucgcuuuaguccaggaguuugagaccagccugggcaacauggugaaacuucaucucugccauaauaauaauaauaauaauaauaauaauaauaauaauaauaauaauuuaagaaaagaaaaaaagaguggggcuuugugucagucuuggguuggggcggauaauggcagggggcucucaagacggcuguuuuuccugccgccuuugaaugugaggcggcucuucugucuccauuugggcgcccauggccugcuuuucuucugacuugugucauuuacaucugccaagagugcagccacuggcuuugggacgagaucagaugaaaccuucaucuucccaauuuccagcauuuuccuccacugcccaucauuggccucaugugauggaggguugaauguuuuuuuuuuuuuuuuuaacagcauguauuuuucuccugacuauaaaauguuuguuguagaauaugugaaauaugcagaaaacuuugaagcaaaaaaaaaaaaaguuauccuacugcccagagaaaaacacuguuaauauuuugguguauuuccuuuugagauuacccuguauguguguaaauauguaugguuuucuuuuuuccuuuuuuuuuuuuuguaaaauugagcuccugccguucuauuuuauuuuuauuuuuuaaaaaagauuuuuuaaaaaaacagagacaaggucucgcuguguuucccaggcugguuuugaauuccuaggcucaagugaucuuccagccucagccucccaaagugcugggauuacaggugugagccacugcaccuggccgagauccugcuguuuuauggccuccuuuuuauuuaauauguugugaccauuuucucauauuauuagauguuuuuuuuuugagauggagucuuacuuuuuugccaaggccggagugcaguggcaugaucucggcucacugcaaccuccgccuccuggguuuaagugauucuccugccucagccucccgaguagcugggauuacaggugccugccaccaugccuggcuaauuuuuguauuuuuaguagagacgggguuuugccacauugcccaggcuugaacuccugacuucgagugauccgccugccugggccucccaaagugcugggauuacaggcgugagccacugcgcccagccugauauucuacaaauaucuaaggcuaucacugauauucuacaaauaucuaaggcugucacugacgaugcagugaucauccuuguguguaaaucuguguguuugauuguuuccauagguuggauuccugcaugugaaauugcugggucagaugugucugaggcuuuuauggauauuucuggggacugguuucuauucugaaggaggaaaaauaucacagauuugaccaaaucagccccugguuuugugggucuuggagauucagaacucuaauugguuaguggccuaaccaggccugcccacuucugagccacauccuugucccagugucccucuccagcgugagaccucugcagaggagcugagaccaggagaggaagguugcugacaguucuagcuggcuccuugggccugggcagaagagccaugauuguuggccauuuauuaauaacuauuauuugcugaauucuacaagccuggugcccggcugcaggcgaaggacuccuuuucacugcacaugcaguagcugguuccuccuuagguggagucagcuccgagaugggccuuguguugugugcacggaggauuuuggugacugugguuugaucacuguggcucaucucugagaccagcccuugggaaaagcugaggugcuccccugaaaugacucuggcugccccaucaaucccccuccuucucccucaccccuccaaagccuccuccuccaaucucugugaagcccuccucugugaggcccugccaagcgccccuuccuccucgcugccccgcagcaccuguguccccucuugucccaggaaccguggugucaccccuaccaccaugagaaccugcaggcaguggggggcucucugucccuagcaggcagcguagggcuuggcucagagcaggcaccaaaaaauucuuaugugcaggaggauuuuucagauuuauccaaauggguuuuucuucaaggaagaggucuagagccccgcugaggcaucuucuaacuaauuuucaacauaaugaaaccguguccuuggugucugcucagaacaccguggccuuaccuugcugggcuccuuagggaaaagcacuuacgugaaaggcucuucagugaagaauuucuguagcucaaggacucccuuuuccgcccuucccuguuuguaucauuugaaaacaucuuuuaaaagccuuguuaauuaauugccucagggcuuggaggugcugagugggggcaggcauugagagcaggccggguuaugcggccuccuggggugggcagagagagcuccguggugcuggucagagccugacucagagcccccaggggccucugaaggguggcagaagcuuucccugggucagucagguaccaagggguggguuggaaaguuaaguauuucaaugaaacgucccagagauccacagaccugacguaggcggcaggcauuuuggcaacagguagauuuuuuuuuuaaagacacucagguuuugguugggcacagugguucacgccuguaaucccagcacuuugggaggcggaggcggguggaucaccugacgucaggaguucgaaaccagccuggccaguaugaugaaaccccgucucuacuaaaaauacaaaaauuagcugggcgugguggcgugggcaccuguaaucccagcuacuugggaggcugagacaggagaaucacuugaaccugggaggcagagguugcaaugagcugagauugaaccacuccagccugggcaacagagggagacucuaucucaaaaaaaaaaaaaaaaaaaaaaaaaagacacucagguuuuuaauuuuuuccccuucucucuuuuuaauuuuuuuuuuuuuuugagacaaagucuugcucuguugugcaagcugcagugcaguggaguagucauagcucacugcaaccuccaucuccugggcucaggcaauccuccugccucggccucccaaagugcugggauuagaggugugagccaacgggccccgccccucccuccucuuuauuacagauuauuauuugcagauaaaaagacucgccuaaaccauauaacauuucaguggguggcuuucagcccuuuccuugcauuugugugcauuggcccagcuguacaccucugacuuucagugggaauaaaucauauuacugccuggcaggguucugcccccugaggcacacacucuuuuuggugguucucacggacccuagagaccccagcugucuguggcaguuugaaccuaagcccuggacuggggccagucagguagaaguggccucuguggagggucgugggagguagucuggggacccucugaccuacauggguguccggcacuauuauugguggcugaggccagagacagagccuguugucgggguaguaccugaggauggugauccccaauuagcagaggcugcagccuacccaugccugccuuccccagcaccgucccugggugccacacuggagcugauuccugagcuccccgugucucggcgaccuugcuuccagccucugaagggcacucgaggaagacugauugagacucuggggaaggacgugcguagcaucucaaucuccccucacagagccugccuggggagggcuacaccucgggaggcuuuuauguacggaggcauuuccaaaacugguuugucccuccccugccacaagagaccagcgggggccugccuucuagagacacacacccacccccuuaggguucccugccuucagagcaaaugcuuaccuaugaggaaauugaggcacacagagguuuagugacccacccaaggccacacagcgagucuucagcaaagcugggguccagcuggaggccuggcuccagagccagcgcuggcucagcucuaccuccucucagcugcucuggggacaccaaggcugcuaugugcuccucaggauuuaggggccugggaauucccugagcucaugucaguuacuccuaaacggcacauucugauggcggaaggagacagcaucccggucacuguucccauugagucacaaggagauggaggcccaaagcaugacucaccuggggucacagagcuggaagguggcugggcaggaguuuaaaccagguccauagcauuccaaaugcugccuuuuucucuguuuccagccaggggcgccguggcugcucuguccauuuuacugccuagugaaaggccugcggggggcgcugucaggcuccuugcggugcugcugguggagcgccagagccugggccuggcugcgggcugagcggaagcugagaacguggagucugagucucuuugggccccagauuccccacgucugcccaguuccuuccccuuccugggucaugucuugucucagggcauggaggggccaaugcacagaagagucacuggcuuccuggaacacagcacgacuccgugaccaccugggucggcuuuccccguggccuugagagcugcuugcagaauccagcuugcaggugaccuagguggggcugcacuuggaaacucugcuccguuuuggagugcaaggucccuggguuucugucuggcuggaggcuguggcuuugaacuguccucgagggguuaacaagaauuacaugccagguucugggcagaaauagaauuaagcauggaucaggcugcacuuuguaaccaaaagccacaaaagccaccuagcauuagauacccuggcauccccauugcuccaacuuuagaaucauaaggcuuuuguuuaagaaugacuugaccugcaugguggcucacgccuguaaucucaacacuuugggaggcccgggaggcagaaucgcuggaagcaaggaguuugagaccagccuaggcaacauagugagaccucaucucaaccaaaaguagaaaaauuagcugagcauggugugggccuguagucccagcuacucgaggcugaggcaggaggaucucuugagccugggaauucgaggccacagugagcuaugcuugugccacugcacucuagccugggugacagagaaagacccugucuguuuaagagaaaaauaaaagauugcuggagugauuacagcuucccuuuggagauggcaaagcaucugacuucacacucccacccucaacucccacccuuagcucugggacacaucucuugugcgucacucguucuuucagucaucaccagacguauccagaggugugacagguaccggauccagaacuaggcaugaggcacgguucugccuuuuaggaaggaaagggaggaucagcuagggccaggugcuuuuuacuugaauauaauucguguguguguguguguguguguaugugguuuguaugcaugugcaugcauguggguaugugcacauguguaugugugugugcaugaguguguaguguguguggugugggguguuugugggguguguguauauguguguguauggugugagggguguguggugugguauguggugugaggggugugugguguguguggggugugugugugguguguauguguguggggcaugugugugguguguggggggcauguguguggggcguguguguguuugugugugugugugagggguguaugugggguguguaugugggguguguguguggugugugugugcgggggugugugguguauggguguguggugugaggggugugugugguguaugugggguguguguaguguguauauguggugugugaugugugguguguguguggaugucugguguguaugugugugguguguguggcgugugugugguguguaugugugggagugugguguguaugggugugugugugguguauguguauguggggugugugguguguaugugugugggguguguguaugugugaggggugugugugguguauguguguggggugugugugugugguaugugugggggugugugguguauguguguggguguggugugaggggugugguguguguguggggugugugugguguguguaguguaugugugguuguguggugugguguguguggggguguguguggugugugggugugugguguauguguguggggggugugugguguguguaugugugugggggugugugggugugugguguguguggggugugugguguguaugugggggugugugguuugugugugguugugugguguguguguguggggugugugugggggugugugugggguguguagugugugugguguguguguggugugugggggguguguggggggguguggggguguggggugugugggguguguguggggugugugugggggugugugugggguguguguagugugugggguguggggugugugugggggugugugggggguguggggugugugugguguguguguggugugugugugggguguguguggggguguguggugugugugugcgggguguggggugugugugugguguguauguguguguggggggguuguguguggggguguguggugugugugugagugugugugugugggguguguaaggugauugaugaaaugcacucuaugcucucaccugacucagaugcacgcaaaaugcauguuucuuuuuucuuuuucuuucuuccuuuuuuuuuuuuuuuuugagauggagucucgcucuguugcccaggcuggagugcaguggcacgaucucggccuacuccaaccuccgccucccggguucaaaugauucuccugccucagccuccugaguagcugggauuacaggcaccugccaccaugcccagcuaacuuuuguauuuuuaguagagagggaguuuccccauguuggccaggcuggucucaaacuccugaccucaggugaucgcccaccucggccucccaaagugcugggauuacaggcaugagccaccgcgcccggccuguuucuauaacucaucucauuuugcucuggaaaacugauggcaggaaaaauaaauuuaaaaagaaauuugcuggcuaaguagaacuuauucucuccagauuuaagacagcgucucuggauaaaauauucaguuaaaguucaaacuucagacaggcucugugcaaauuucaaaaggugccucuuccucuaggcagccagggcagcucugcaccaggugggggucaagauuucaggugcccucgcccuucucagccaggccuccuugaacagugaacaaccuguguagcuguccaugguggcuuagucaagcucuccaaggaaacugucucaucucaagaggucucccuucccccgcaucccuucuccuuuuuccaagggggcuucagaggaggcagcuuaugugucugugggguugggggagggaucuccagcccuuguuuuggacuuuaguccucagauccgaaggccacucucagaugggccuggcuuccccaggacugaauauccaacguggcccucauccugcaucugaggccaagcaugucugcaggccacacccccagccucugugacaccuggucuuugcagcucucaucaggacaccaucaggacaucauauagggugaaauaugaaugaaagcugucauuggcgccugaagcccccaccuucccuguuggcaggguaggaaguuagagugcguggccuuuggccuugaggcugcuggugccguggaaggcaaggccugcaaaggcguccuggguuuagggagugcuuugaggggucugcugacuccuggugccccucugcggucgaccccagagugcaggcacccaaggcugccugggggcugggauuggaggcaccugguugguguggggcagcuuugucagggaggggcugagcagggcagccccugccuucccaguccucccagucugggcugagugggccgagggaccaggcugcggcuguagccaccugcugcgcccacccccugccugugugcucuguugccuggggcaggccugggugucccagggcucucagccucagcuuucuggaaccagacuuuguccccuugccaggugaccuugccccugcugcccuggccugggcaaaucucagcgccucccucccauccucccacugggggcuugcggggcuuuucuuuccacccacaaccacccccugggggcccagcuccugcugcccuuccagauaacucuggggaggcuauggccuuugaaaagagaguagcagccaggugcaguggcucacaccuguaaucccagcacuuagggaggcugaggcagaaggaucacuugaggucaggaguucaagaccagccuggguaacacagugagaccccaucucucaaaaaaaaaaaaaaaagucugacgccggacacaucuugaacucaugacuuaugaccuacggccauggucagugaccaucucugaaccucgguuuccucaucuguaaaaugggagucaucuuggaaauaggccggaaagagccaaccuauuucauuauuuaaauaucuguguggauuauuuugauaugaauuuuaagugauaauugaaaacaacagcaguacaaagcuguccuccccagcccccuggugcggcccagcugcccggccuccccuguuuggaaggggacuccgcccuucccugcagcagcacacgcuggggcuuccaugccucuccuccagacucagguggccuaagugccugccagccccucugggccacgcagggaacagcacacgggcaguggcucagaggcuaugugccaaugcggccggccggcugugggucguacacagcagaucuacccaucuuccauggcaccucuggugguggagacuguuuugugggaucaaugacccuccuugaaugugaaaacaggaccauccgccggucccuccgagcuccuccaaagccuucugcuguugcagaaacgucacuugcuauuccaucuggacuaggcugcguuucuguuccucccaacuguccucccuuuuucuucuuucuguuucaagaaagccccuucugcaagcucuggguagaggcagugagggugggggcccugggcugggaucccggcacugugcccuacucccuaagugacccagugcaagucaucucaguguccuaaucaaaaucaugguaaguauuuugauauuuuuaugaaaauaguaguuauaaagaaccuccuuuuuuguuuuguuuuguuuuuguuuuuagacagagucugacucuguugcccaggcuggagugcaguggcacaauuguagcucacugcagucucaaccuccugggcucaggcaguccuccucgcuuagccccccaaaguaacuggagcuacacauguguaccaucaugccuggcuaauuuuuuguagagauggggucuugcuauguugcccaggcuggucucaaacuccuggccucaagcgauccuucugccucagccucccaaagugcugagauuacaggcgugagccaccuugucuggccauaaauaaccuucugaaggaaaaaccaaacguuuuucucucucacacucaacacagaaugugucuaaaauguguggggauuucuccuuaucagcaagcaguucuccaguggacacgcugggcauccucuaguucaauucaauucugacacugucuacccgaaguuagcaucagaucccacagaaugagggcucaguccuaugagacugcccccgacuuccgaugccaauugcaaccccagguuguuuuaccugcacuucugaccaaugggcuguaaaucaacagguucccacaacucccuccucagauuucauagaucuagagcagcucacagaacucagggagacacuuuagccauuuguuuuaagggauaugacaaaggcuguaggugaacagccagguggaagggggugugcagggcugggcaugccagugggagcgcaugccaugcgcucuccggggacgccuaccucugggaaccuccacguguucagcaaccaggaagcccuuccaaacccugaccuuuuggguuuuuguggagacuucauuacauagguaugauugguuacaucacuggacaugggucaucaaccucaccuucagccccucuccccuccccggagguccaacucucuaaucaugugguugguucuccuggcaaccagcccuccauccugaggcuaucuggggacccacaaagaguccgaguccccucguuauaacaaaaggugcuccuauugcugacgcauuccaagggauuuaggaguucugggucaaaaaccagggucaaagacugaauauuaggcugggcgcaguggcucacgccuguaaucccagcuacuugggaggccgagaugggagaaucgcuugaacccaggaguuucagaccagccugggcaacuuagcaaaaccccgucuuuaauaaaauaagccaggcauaguugugcaugugccuguagucccagcuacucgagaggcugaggcgggaggaucacuugagcccaggaguuugaggcugcagugagccauguucacaccacugcaucccagccugagugacagagcaagacgcugucucgaaaccaaucaacaaaaaaccccccaaauauuagaacaaaagaguccccuuaacccccugucuacaaggguuuuacuuaagaacccacagcagagacuauguauuucuuauuuuauaucacaauaagaaagaucucuuacaauaucccauaccuccuuuuucuaaaggaaguuaaucauagcaguuucaaguuaggguucuuuucucuuuuuucuagagauagaaucucacacuguugcucaggcuggagugcaguggcgagauuauagcucacugcagccucaaccuccuaagcucaggugauccuccugccucagccuccugagcagcugggacuauaggugugcaccaccaggccuggcuaauuuccuuuuuguagagauggggucucgcuauguugcccaggcuggucuggaacucccggccucaagcaauccgucugccuuggucucccaaaguguugggauuacaggugugagccaccacgccuggucccucaaguuagaauuguugaaggaauuaaaugagauuguccacuugacauuaacgacucauuuaauuuaauggguacauuaaaaaaacaaaaaacaaaacccuaguaagaaucggcgcuucuucuuauguggugacugacuuggaauccuagcccuuuaaccuacagcacccaagagcccuuuaaccuauggcacccauaacuucucccucucgcucacccgccuccagccacccgggucucuuugcugcuccucauacgggaacacacucuuccaccuggggucucugcaccugcugccgccuccccuaaugucccauggcucccucauuccccugcagggcucacagccucaccucccuuggguguccacaaaauaaaaugcacacagcagccccccuuucccuucuccauucuccuggcgcagcucugauuuucuucaugaugcuuaucaacacuggacuugcuauguauuuuuuugauuggagggguuaucauaaguaucccuucaaaagauuggaaguggcugggcucgguggcucacgccuggaaucucagcacuuaggggggcagaggugggcagaccacuugaggucaggaguucgagaccagccugccaugaggucaggaguucgagaccagccugcccaacauggcgaaacccugucucuacuuaaaaaaaaaaaaauacaaaaaacuaguuggguguggugguggguaccuguaauccgagcuacuugggaggcugaggcaggugaaucgcuugaaccugggagacggagguugcagugagccaagaucacaccacugcacuccagccugagagacaagagugaaacuccgucucaaaaaaaaaaaaaaaauuaaaaauuagccgggaaguggugguguguaacuguagucccaccucccugggaggcugaggugggaggaucacuugagcccaggaguuugaggcugcagagagcuaggauugcacugcugcacuccagccugggugacagagcaagauccugucucaaaaauaaauaaaucucaaaauaaauaaaagauuacaaaagaagcuucuagaaggcaagaaaccacuuuacagagugcccugccccaaaagauacauccacaucccagaaccuguggaugugaccuuauuuugaaaaaguguccuauccauugggcccuaaauccugugacaaguguccuaagggacacacagaggagaggcaccucgaggaggaggcgaggcagggacuggaggaugccgccaggagggaugcccuuggcccccagagcugggagacgcagggacagauucuugccuggagccuccggagggagguggcccuggcagccccuugguuucugacuucaggccuucagaacugugagcagaugaacucuuguucuaagucacugugcuuacgguaaucuguuucggcaggccuaggaaacuaauccaccccuguguggccaacacccaggcagggacuggaauguagcagagccggcagcagcgaacauucucugaaaagagacagauagaaaauaucugaggcuuugcaggccguugucucugucucgaaugcucaacucugccaccggagcaugaacugcagccacggagaacacuaacaaauggguguggcuguguuccgauaaaaccuuauuuaugggccgggcgcgguggcucaugccuguaaucccagcacuuugggaggccgaggcggguggaucacgaggucaggagauggagaccaccauccuugcuaacacggcgaaacuccgucucuauuaaaaauacaaaauauuagccgggcgugguggcaggugccuguagucccagcuacucgguaggcugaggcagaagaauggcgugaacccaggaggcagagcuugcagugagccgagaucgagccacugcacuacagccugggcgacacaaccagacugcgucucaaaaaacaaaacaaaacaaaacaaaaacuuuauuuauggacaccaaaauuucaauuucauauaauuuucaugugucaauacauaugauucuuuugauuuauuuauuuuuuugagacaguuucgcucugucccccaggcuaaagugcaguggggugaucuccgcucacugcaaccuuugccuccuggguucaagggauucuccugccucagccuccugaguagcugagacuacaggguggggcuccaccaugccuugcuaauuuugguauuuuuuuuguagagacggaguuucaccauguuggccaggcuggucuugaacuccugaccucaagugaucugcccaccuuggccuuccaaagugcugggauuacaggcgugagccaccucacccggccaaugugauucuuauuuugacuuuuuucaaccauuuaaaaauguaaaacucauucuuagcguguaggucagacaaaggcaggugguggugggguuuggcccgggggcuauaguuugcugccuggucuagcagaugcuccguauuuguugaaggauugaagggacauuagaggugacagcuggaugcuccggucaaguagcccagagacugugaugaagccccuugcaacaaaaaucccugagaauuaaaguaggguugguguaaacugcuggaggcagcugucucaccccaagaucuucagcgacagagggcagggccaagaggucacccaggugccuggcuggggagguuguucccaggccuucagugcuggucgacgccauggugcugaagugacagaggagacacgggaaggcacuggccacuuccugaccacacugcauguguucagcuguaggcucagugaggauggguccugggauuggggucuggguggagaucuagagcacauuggagcugaaacccuaacccagggcuggaaaacuccagugacuucuaggauuaggccaggaaugcagauaagcaaaggaggucugauguaagacaacagggcaugaugggggcucuggcaaagaggggagaccgccuccuauuuaaagcaguuacucagucuuggcacuguggcccaugcugguuaucccagcauuuugggaggcugaagugggaggaucauuaagccaggaguucaagaccagcuugggugauguagugagaccccauuucuuaaaaaaaaaaaaguaaauaaaauaaaaauuauuuuuuuaauuagcugggcacaguaacaaguaucugccauuccagccacucgggaggcugaggcaggaggaucgcuugagcccaggagguugaggcugcagugagcugugaugacaccacuggacuccagccuuggugaaagagcaggaugcugucuaaaaaaaaaaaaaaaaaaggcaauuauucaguuucagccaauccugccaggugggaaugcaggcuccaugccagcagauuucuagauuguucuugagaagcugcagaauucaguuguuuguaugaaaucuccugauuuaaaaucuuggcucaaauaauaauaauacaaagucaugccaggaguuuucugcauguugaguggauauuggaaugccuucuuacagagagcuccgagaggcuagguuaccuuaccaacagcacacagcucagagaugccaaacugggugugggugaccucacagcugccuuccaggugguggcucuuugugaccucauucacugagugaagggggagaggaucagagggucucucuucagccagauuugggccccagacaagauucagaaacugcuacuaucagccaggcuuggggacucaugccuauaaucccagcacuuugggaggccgagguggaaggaucacuugagcccaggaguuugagaccagccagggaaacauagcgggaccuugucucugcaaaacauaaaaaaauuagcugggcuuggugguggacgccuguagucccagcuacuugggagacugaggcucgggaggaucacuugaucccgggagguugaggcugcagugagcugugauuacaccacugcacucuagcuugggcugggcuuuguaagagugagacccugucuuuauaaaaaaacaaaacuacuacucgcuagcuuuuuugaaaacugugguguucagaaaauggauauggucaccauauuauaauucguauggcguaguacuacuaaauaaguuuuuuuuuuuuuuugagauggagucuuacucugucucccaggcuggagugcaauggcgcgaucuuggcucacugcaaccuccuacucccggguucaagugauucuugagcuucagccucuggaguagcugggauuacaggcgcgugccaccacacccagcuaauuuuuguauuuuuaguagagacaagguuucgccauguuggccaggcugaucucaaaugcuugaccucaagugauccacccaccucggccucccaaagugcugggauuacaggugugagccaccgugcccggccugaagaagauauuaacauuacaacuugcuccuuuauuugagaacaguggcaauauuaugauuguuacgauuaugguugugauuugaucacuacuauacaccucaggacucccuuccauauccaacaccccacacccugcacccaggaaauaaauugguuuuaaccaucuggcugcuagaccaugucucucccaccccaccgcuacuccacccccacuuacccaaccaucugguccagcccugcccagccaagccaugccgucugguagaccuugcuggcuaccagcacaaagggcugguguucccugucaccuucagucacaggggugcuaggaagggcauauccagguucuuggagggacaaagccaugcgggaccuuccuucuugguugauagagaagugggugggugcauacacccaugucugauggaaguggcugucacucguguuuucgaaaaauguggcuuuuuuugugaagaaacuuugggaagugauguugcugccaugccugcauucuuuuuuuuuuuuuuuuugagccagagucucccucuguugcccaggcuggagugcaguggcgccaucucaagucacuacaaccucugccuccuggauucaagcaauuccccugcgucagccuccugaguagcugggauuacaggcgcccaccaccacgcccagcuaauuuuuguauuuuuaguagagacaggguuuugccuuauuggccaggcuggccucggacuccugaccucaagugauccgcucgccucggccucccaaagugcugggauuacaggugugagccaccgcaccccgcccaugccugcauucuuaagggccuuggaaagcacucugcaugcacgcaguggcccagccagcccacucugcaaaucccucugucugccccucucauuucacaauuccaucagaaucggcggccgugcuggugaagaaggguuugcucuuaaugagccugcccagaauugccuuguuuucuuggcguugacaaacuauaucccuuaauaaaaguuucaugacucaauuuagcacgggagguacauaaucccagccccuccugcccugaaaucaaagauugccucggaguauuggucccaggggcacuccuggguuugacacaaacgcugucugggggcaucgcuggcugagauuugccagggggucugugggcagaaggugcccccucggggaaggccucccgcugcugccuccuccugcucucuucugguggucacuggucauucuggcuguucagcucugcccuggucauccacgguagcagguuguuugcagagucaaccacagcucucccucccaucucaccagcccuuugcaaaugcuugucucaucaagagguggggucuauuuucuccucuccuaaaucuggccuaauuggcucugcccaguagaguguggcggaugugauugcaugugagugcccaugaggcagcuggggaggccuugcagcuuccacuuuugccuccuuauuuuuauugauugauugauugauugagacagagucucgcucuguugccuaggcugagugcagcggugugaucacggcucacugcagccucuacuucccaggcucaagcaauccucccaccucagccuuucaaguagcugggacuacaggcgcucgccaccaugccuggcuaauuuuguuguuguuguuguuauuguugcugagacagggucuccuuagguugcccaggcugguucugaccucccgggcuuaagcgauucucccaccucagccucccaaaaugcugggauuacaggcgugaggcacugcaccaggcuccacuuuugccuccuuagaccccagcacugcugcgcaaaaaggaagcccuuaggcugugcgcgguggcucaugccuguaaucccaguacuuugggaggccgaggcagguggaucaccugaggucaggaguucaagagcagccuggccaauauggugaaaccccgucucuacuaaaaauacaaaaauuagccgggcaugauggugggugccuguaaucccagcuauuugggaggcugaggcaggagaauugcuugaaccugguaggugcagguugcaguaaaccgagaucgugccauugcacuccagccugggcaacagagugagacuccaucucagaaacaaaaacaaaacaaacaaaugaacaaaaaagaagcccugcccaacuuacuggagggcgagggcuucuguggggagaacugaggcacccugaccagcggcugguaccaguugccagauccacaggugaggucaucauugucaccccacagccccagccgagcauggggagacugcagcacgugaaugaccccaggacagaggagcaggacugcuuacauuccagcccacagaagaagcaggaggaaucguaauggucgcuuuaagccccuagguuuuagaaguuuguuauguagcaauggacaauuguuauagccaucucuuuugcauucuuagcugugacauuugggugggaaugaccccucacccagcuccaggcguggguccugacugguguaaagaaauggaugucacuguuguguggucagagcaccucauucucccuguccacagcgagacgccaggaaccguuugcuucuccaccaucugagaaagagaugaggugcugugaggaugugaggucaggaauccaggcggcuguuuugugccgcgugggaccuccauguggagccagaggacaaagggaugaaguuaacacugaagaaaguaaaccaggaggccagagaggacccaggucuuugacagcuuugagaugcuagauucagccauaccuccagcaagaucucucccugagcuuuucaguuacauaaacaaaugacugcccuuuagguggcuucagccagcccugaacgacacaucucucuccaaggugu

SEQ ID NO: 15393 - RNA, 555 nt, Homo sapiens
uuuuuuuuuuguagcccagagguccuuuauuuuuuuuuuuaacaccuauuaugccaugaauucauagggaauagguuccagcagcucaggcuccuucccauugguucucacaaagugugcuucucuggguggagcaggcuggcgcuuuaguugaacccagguaccuuucucuuuggcuucuuucuuuuucugaucauuuuccuucacacguuucaggaagcuaucucggcucuuagagugcuuaaugugcucaauacgcacauuaauucucuuggcaagaaucuugcccuuaacuuguuuguuuacaacaaugccaacagcaugcuggguaacauuguagacucuuccaguuuugccaugguaacacuuguggggcauuccuuuuugaacaguacccauucccuugaugucuacaauaucaccuuucuuauagauucgcauauauguggccaaaggaacaacuccauguuuucuaaaaggccuagagaacauauaucgggugccucuccucuuucccuuuguguucgucauuuuggcgaauuacuggaagauggc

SEQ ID NO: 15394 - RNA, 555 nt, Homo sapiens
gccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaa

SEQ ID NO: 15395 - RNA, 10413 nt, Homo sapiens
ccuggggucuggcuacaaauuuuauuccguuacaaauagcaccgagcccuuggggcugccccuguggagagggaucccccuccuggacccccaccuccuccccugagcuacccagguagugucugggagcuggcacacggcccagggucccucuggaagcugggccaggccaagggguuaggcccaggcccuucguggggugggcccagggccagcuguggcagaugugcagguaggugagcggcagccucucagaugagcacacuggccacgggcacgcggguggagcggccccgcuggggcaccacaauccggucgucuguggacccugcuucgugcagcaggccugaggggggagggucagagccagggugagcuggauggacagacagacaaagccagagaagggcaaacaggcagcgggaaauggauggggcagccacagagccaccccagggguggaugcagacagacuggaggccaaacaaggggagggcuguggacugagcugccaggugcacaggagugggcagacagauggacagacagacaggcagaucaagaagcugggccgggcacagcuccuaacugacccugcacgugcagcugugcccgccggcggucggccucaaugaagauggcggugcccaggaaggcugcgccgcccagugccccaacaaacgcgcagagcaugagcgagaacugcagagcccggaacucggacaagaaggaggggggccaguuccggcgcaggcggucagagaucugcagggagaggagacaggaaagccaggggagucagccucauggaugaaccagggagggcacgccccugagcuccagggagaaagacaaguggagcccaggaaagggaaggagguuugagcuagaugcaguggcucaugccuaucaucccagcuacucaggaggcugaggugggaggaucgcuugagcccaggaggucgaggcugcagugagccaugaucgugccacuacacugcagccugggcaacagagugaggucuugucucaggaagaaaagaaaagagaaaagaaaggaggaguuuggaccaccagggugaggucccuggccuuacugguagaaauauucaaagacaaaaucuuucuccuccaguugacaauggaaggugagaagugcccagcacgcaggacacagacacuucacuagggccaggccuucugauccagcccaggcucaggacaccagccaccccaugccagccaagaaauaaugcucaccaggccaaugagguaggggcucccagcaucacccagcaggugggacagcacgaucuggaaggccucggcgguggagcgucggguagggaucaccacguacuguggaggaguugguggagcucaguggaugcucugggcuccagggggcaggaggcagggggccaggagaccaccaaggauccgccuaggccggggucagaggugugccugggguugaggucgcagggcaggccgggggucugcuacagauguuauuuauugcagaagguagguugaggcugggcuuugagggguagaggcaacacuccugaccccaacucugcucucaucagccucugcgcugacccuggagcugcccagcaacucaccagcagaaugucggccacgauggcccaguucauggacaggagggucucuccaaugaagaugaaaaucugggggaagagagggucggggguucaugacaguaagggcuaacacauggaaaguugaccauguucccagcucaucuauuaacuaauuuaauccucaucacaccccagugagacaggugcuacuaauauccccauuuuacacaugaugaaacugagcacagagagguuaagucacuuguccaaugucacacagcugggaagagccagagcugugauucaaaaccaggcauuccaccucgaguggccauuacgcugacugcuccuccacccuggacccacgccaucccccuugacaccugcuggcuacucacauaaguggccacgaugcuaccacgggcgcaggcaagggacaggaagaggaagggugcagagcccaggaggccaguggcacagaccaggggaucagcccggggguuggaguggcggagccggcggcugaucuccacacccaggcccacacccaggacuccggucaggcaggugaugaguccaaagaugagacuaggggugagggaagggaaugggggguuugucccugugccugccaaggccccuacgcuguccauccuagccacccucacaaccaaggucccuacagacacagcaccccaugguuggcacagcccugaguggcagacaucaucccaucacuuauuucccagaccaggaaacggagauuccaggagagcaggcagcuugugaagucaggagucaaacucccugccugggucugagccacagaugcucuucacuccagcccugccacccgcaggccccccagcauagccccaucugggcaccugucagaggaagagcaggagucuccgggaaggcaggguggggucuccccaaggaccacgcgggaacgcagcaggaaugccggagcccacagagccagggagcccgugacaaaggccacagcagugaagcccagggaagacaggacgaaacuaggacugcagauaguugggagggagagaguaagaccccacggaggugucgaggcaggaggggaccucucuucucccuuccuggcuuauuuuaguaaggucacaacaccgugcagaggugguucuggcucccaggaucugggccuguaauucaagcagcugccacaaggggacaguaucgaccgaauuacuggccuugggguguggccaggaacaggaacauccccacuuaaaccucaaaccagacgccagggggccucagaugguggucuagggugggaauaaacucacuuucuugccagagcccucagaucugcccaccacgaggugggguucagggguggcaaaucugaguggcgcuccacggcuccccuuggcggcucccgcacuaccaggaacagcagcagaacggccaccacuccuagacccggugucaccugggagacagagggcuucaggauaggcacagggagagacacacucaagcccugggcuggaggagagugugggguacagauaacuccagccugagaccuaaaauacccaguuaagugccugcuccaagaagccgaaccugcaaucugggggaagggggcugccacuaggggccacccuauuuuugcaagccuagcuuugucuccucuuugguaauuuucuuuugggaaaccaguaccccuacuucucucaauccacuugguuuaaauaggaucccaggcuuggccaacaagaggacuguuaaccaccccagccucggugacggauuccgcagagggcacgugaugcauguucaucuagucagacgcuauccuggaaacacggccccaggguccaaggugccaauguugcuaaauggaaagguaaucaucuggaguucucacguccuuaagaaugauguuaacacaaaggaaaguaaagcucagaagagaagggcagugugggagcccuggauccagcuuuaccugacugaagcucaccugggacuuucaggaagaaagccaagacagccccuuuagggggcuuacgguuuguuuguuuguuuguuuguuuguuuucgagacagagucucacucugucacccaggcuggagugcaguggugcgaucucggcucacugcaaccuccgccuacuggguucacgccauucuccugccucggccuccugaguagcugggacuacaggcaccugccaccacgcccagcuaauuuuuuuuuguauuuuuaguagagacgggauuucacuguguuagccaggguggucucaaucuccugaccuugugauccacccaccuuggccucccaaagugcuggaauuacaggugugagccaccgcacccggccucuagggggcuuacaguuuuacaaugggcuucugucaccugcacgcaagaauucugucuagcacauggcuuccaggugagggcagccagucuccugcaggcucagcagaaugagagcugccccaaaaaagggguauuuggagccaggcgcauggcucacacccguaagcccagcacuuuaggaggccaaggcaagaggauugcuugaggccaggaguucaaaaccaaccugggcaacauacaaagaccccaucucuacaaaaaaaaaaaauuuugugugugcaauggcacgaucucugcucacugcaaccucugccucccggguucaagcgauucuccugccucagccucccgaguagcugagauuacaggcaugcgucaccaugccuggcuaauuauguauuuuuaguagagacaggguuucaccauguuggucaagcuggccuagaacuccugaccucaggugauccgcccaccucagccucccaaagugcugggauuauaggcgugagccaucaugccuggcaaaauuuuuuuuuuuuuuuuuugagaaggagucucgcacugucgcccaggcuagagugcaguggcacaaucucagcuugcugcaaccuccgccuccuggguucaagugauucuccuaccucagccccccgaguagcugggauuacaggcaugcaccaccacgcccagcuaauuuuuguauuuuuaguagagacaggguuucaccauguuggccaggcuggucuugaauuccugaccucaagugauccaccugccucagccucccaaaaugcugggauacagguguuagccaccacacccagccuacaaaaagaaaaaguuuuuuuaauuagccaggcaugguggcgggcaccuauagucccagcuacuugggaggcugaggugggaggaucacuugagcucaggcguuccaggcuacagugagcuaugacugcaccacugcacugcagccugggugacacaacaagacccugucucuuaaaagaaaaaugggcggugggaagggguccaaagguaggaaacagggaucagugagaacgucgcugaccuacccccaggccaagaccagacucacccucagagcccagugccagucuccagccauauccuucacuuuggagccugcaauguagcccagaccacugugggagggagagaggggaaaaaggggggacagccagucaguccagucccccacaccaggcccuucugccuucccccaggccccaggcccacucaccugcccaccggaauggcaaaguagaagaugcugagcauccggcuccgcuggucggccacaaagaggucggcaaugagagugggcgcgaugguggaauaacuggccuccccgacccccaccaggccccgggucaggaggagcagccagaaaugcuggggagagagaccggggagagguggcaccccagccugcaaccagccuccgggcuaccucaccagcccgcucccaagaggcagcagggauggcgggagaugccuggguuuuagaaucacacagaccugagcuugcauccuggcuccaccacuuacuagcugcgauuuggggaaaauaacuuaaccucucugagccucaguuuccucaucugcaaaaggaggauaacaacaacuuuucacagagcuauugcaaggacuagacaauaaaaggucuaaauaagacaaccccugcuugccugguaggggaaaguuuuuuaauuuuuuuuuuuuaaugaauaagugaccuuagaugggaguuuaugugucuaccaaaggcaccugaagcuaaggacggguacagucacccaaggaaaguacguagguccuggggcugaggacagaguucugggguggagugagaacagacagaggaggcuucaaaggaacaaagaagcaacagccagggaggcaggaggaaagccagaagaguguggcaucgcaaagguaggagagaguuucaggaaggaagagugggucaacagugccagaggcuccuagcaugaacaggaccaggaaguuggagcuguguuuagcaacuaggaggccacuguuaacuuuggcaagagcaggguccguggaguggugggagcagaagucaguggcagcgcucgaggggugagcaggcgugaggaagugcaggcagagugauggcaucuccccggcugcucuuuuacccacacuggcaccacgcucuaggggcccuucaggaagucugaucaggaaugagaggagggagagagggcaggccagguaggguuuggaguguuuagguauggaguagaaggagucaguggucaggggaagaggggauaauggacagagaaugcucuggaagaaaaggggaggaugggguggggcagguuaacucaggcaaggagggguauaaaauggcauggaccagggaaacugcaggagucccugaggcccagucugccauagcuccaaggagcagcagcagagacugacagggagggggugugggcagaaacaggagccagcuuggggccucaccucuccggggaugaaggaugaccccagugucaccagggaccagaaggcaaugcccccgcacaugagauacuuccgauuguaccugucacccagguagccaaacacaggugccaacaccauguaacuggagaugaacacuagggggaagcagagagucacagcucagcccagguaccccuaccucccacucccaccccagcuggaaccacuaaagcacaggagaugccugccuucuccuuacagaauucacaacacccccacaucccagccugaagcccaucagagcuuccugucaggcggaugguccagcuccaucuugaacaccuuuccagauuucccauuguauaauggauggucccacuacuugucaauuccuuccaccuagccaaaacaagcuccaaacuccaugcauaccauggcucacaaugccccuguccaaucuaggcccugccuaccucuccacacucauggccagccuuuuucccuuccucugucugcaucccaauggcccaauugucaaggccaauaccacuagggguuuaggcaccuacugccuccucuaucaaggacauucucuccucucccccugaaacuucacagagcauaguuccuucagguuccagcucagauacuugcccagggccaagggugaagcaugcugcccaggugagcacacauccaguaccugacucucacauuuacuuuuuucucuuuuuuuuuuuuuuuuuuuuuaaacgaagucucgcucuguugucagguuggagugcuguggcgcgaucucagcucacugcaaccuccgccucccagguucaagcaauucugccucagccucccaagcagcugggacuacaggggcgugccaccacgcccagcuaauuuuuguauuuuuaguagagaugggguuucaccauguuagccaggauggucucaaucuccugaucucgugauccacccgccucggccucccaaagugcugggauuacaggugugagccacagcgccuggacuguuuucuguuacauaacacuuaucccuaugggaaaacugucccacuuuaguuuagcguuuuacuggcuguugcugccucaugcauagcguacuaucagcucccaaggcaagguccuugccuguauuggccaugacuguguuucuuucacuuacuuaacacacagccuagugcaaaacaggugcucaauaagcaugugaagagagugaauaaauccggcugccuagaaagagcugcugcucuaacucaacaacucuucagagguuugaagaccuugcccuaugaucccauucucauugcuccagacuucaccucaaauaccuccaguuccucauuggccuggaguagagaaaagaacacugcaagaccugguuucaaauuccuguuccgccuccaacugguggugugacccugggcaagucuuaacucuucuccaagccucaguuucuuuauaagcuguagauaucacuaccuacuuccucuauaaaauaggaacaguaacaccuauuuuugacugauagaaggauuagaagacaaggggcauaaaaguucuucgcaaaguccuacagguguaaucaucacuuccuccaggccuggcacacaaugaguacucagaaaugguugagaaaugaaugaaggauggaaggaagaaaaagggcuuggcucuagcuuugccucucccacaagucccaaaguugugaacaaguaaaacacaccucuccccauuccagacacccucuccugccuuuacuuauuuauuuauuuaugagauggagucucgcucugucacccaggcuggagugcaguggugcgaucucggcucacugcaaccucugccucccggguucaaguaacucucaugccucagccucccaaguaccugggauuacaggcgcucgcuaccaugccuggcuaauuuuuguauuuuuaguacagaugggguuucgucauguugaccaggcuggucuugaacuccuaacuucaagugauccacucaucuuggccucccaaagugcugggacuacaggcgugagucaccacacccaacccuccugccauuauuuacugggugucuaccaugugccaaacacugcacuaggcccuucacagacaaucuuuuaguuaaucuucacaucaguccuaagagaugauucguguuauuacuuguuccaucuuauagacaaggaaaaugaggcuuagagagguugagugccuugccuaccaucacacaauaaguggaagagcugagauuuaaacccaggucugucuucaccugggugaaguuauacuuaguuauacuaaacugacucccucuuuaaauguggugucccgcugacccccgagcaacaucagggccaucaccuccccuaacuggccacaaaaccuccauuaaugagccccuagacaggccagcgcguggccccacuugagacagaacagaaggaggagcggcugugugaccaggagugguccccacucaccggucuggaugagcccagagcuacuguccccgauguugaagaacugcucgaugucgggaaggacgccugaggagaaaauucaggaugguccggcaaagcagcgccacccucgggacccuggcuccccucuccuagacuaucuuccucccagaagugagucccuaccagccacggugaagcgguccauguaguucaggagauugauguagcacagcaccgccacuaugagagccgaacggccgggagacaggccggugaugcgcugcagccccuccugguccgggaccucgggcuccucggacuucggguuccccguggacccuggcaaccccggggugccaggcacuggcccgucguccgggucauccgccuggcugaggaagggcgcggugucggacccggccauggucccggggggccgcgcccgcccgcgcuccggucccaccgacgaucccaccugcgaggggaggaggcuggagaaaggaggauggaccgaacacaggcgagggaagugcgcccggagacggggagcuugcccugaagcacagagcaccacugagaagggacccgggcccugucacgccuccccgucucaguagacacacagcgcggaggggacgugcggaauacacgugaugucggggacaggagcgggcugaagagggcacgaucccacgcggaggccaccccucacccgggguaggagcccgcugcacuugcugucgcucagcccgggcgcugcaccacggcagccgccauguugcuuaaagccggucaugugacgcgggagccaggguggaagggguccccgcgggcaagccuucgacacgugaccugccacccgacuacggaagccucuugggcguuccgcccgggcucacaugucaugugacggccggccggucgccggaguaaccaggaacuuucccagacccugcggucccuggagcgucaaaaagagcguccccgugacuagguggagucgccugcccuuccgaaucucagcugucuuaucuggaacccccacguggcagacuccaucuucaucaaacgggauaauggggucucaaaagguuuuggaaguaguagauaccucuaaaagccaaggagcagcccuaguucucgggaaccauccugucuuccucccagggucugguuggcggcuuuuuacucucaauaaaggauggauggauggauggauaaauggauggauggagcuugagcagcgcgauggauggaggauuggagggacggagggauggacggacggacggauggagcuugagcaacgccccgcccuuuguugagauuccccaacccugcuagccuuguaaacuccugagccuucaccguggacacuuaaauaccuauuaaaggaagcgucuccacccgccgcuccuggagcauauuuuuccucacu

SEQ ID NO: 15396 - RNA, 1644 nt, Homo sapiens
gaggacuacauuucccaggaugcccugcgacuaaccaagccggaagacgguugucuugguugggcggguccgggagaggcucgucuguggagagguggcccagccaaugggugaggccgacugaaucgaaagcuacggugauugugccgaggugauuggaaucuuuggcgccuugguuucagaggugggcgcaugaugagcggguacagagaccaaugaaaaggcgggaaggcggaucccgcgcguggggcgcgaagaguugcugacgagcaggcuguuuguccaaugcaaggcgaaagucgcugaagggggcggggcgaggcgagaggaggcgggcguguguuguggaggaaagugugccauggcggagccuguggggaagcggggccgcugguccggagguagcggugccggccgagggggucggggcggcuggggcggucggggccggcguccucgggcccagcggucuccaucccggggcacgcuggacguagugucuguggacuuggucaccgacagcgaugaggaaauucuggaggucgccaccgcucgcggugccgcggacgagguugagguggagcccccggagcccccggggccggucgcgucccgggauaacagcaacagugacagcgaaggggaggacaggcggcccgcaggacccccgcgggagccggucaggcggcggcggcggcuggugcuggauccgggggaggcgccgcugguuccgguguacucggggaaggugcgcccggucccggggaggggaccggcggaagggccaagggcuuggccuccagggaggggccggcguucggggaggguagggcuauagggguguugaggcuggcguucuggggcugguccucgggcguuaggguguuggaggcagggagaggcagggcuccgggacuuucugcagacugggguggugaaggagggugggaugcguuggaaguuuaggauuccuaggagcuagagucuugggggcacagggaggcugaagagcugggauuccugagauuuuggagagggacugggaggaccuggggccguuggauuuugagguugggguccauggcaaaugaagccagggagcugcaguauuggggguugggguccaugcggguucagagaggacugggcggcuccagaggcuggggucccccgauggucgugugagcaaugggcugagagucccuaagagucagggguagaggggcggcuaguaaccuaguuaaaaagggcaaggaagcauacauuucagagugucuuaggcagauggaggaaagggugaaggguacuuccauucugaauccuggggaagcuggacuucuagguugccaggagagggccaagguguccacgaucuuagggaggauuugggagcugggugucagggaagaauuacccccaauuuuuucuuucgguaggggaaggacuugggccugaccccucucccuucuuugucuuugcagguuaaaagcagccuucgccuuaucccagaugaucuaucccuccugaaacucuacccuccaggggaugaggaagguaagggagggccuccagggagaggcacgcagccgcuggcuucucuuaagagaauuccugggguuuauauuccugcagucaguugucucc

SEQ ID NO: 15397 - RNA, 8012 nt, Homo sapiens
cuaacuagacugcuaauuccugggcuguuucuccacugggcacccagcauguaacugcugaauuaaugauaauuggguagcuggauggugggagggggcugaucgugacggaucugugggcagcgggcaaaagagggcaguaggugaaggcuaggccauggaaggggaaaggcccuuuguuuuauuuuuauuuuuauuuuuuguugagacgaagucucgcucugucgcccaggcugaaguguaauggcaccaucuccacucacugcaaccucugccucccagguucaagugauucuccaaccucagccucccaaguagcugggacuacaggcucgccaccacacccagcuaauuuuuguauuuuuaguagagacgggguuucaccagguugaccaggcuggucucgaacuccugaccucaaaugauccaccugcuuggccuccuaaagugcugagauuacaagugugggccaccgcaccgggaaaaggcccuuuguaugcagaaggcagcccucccucuuccaugggauucaagacgccuuuccuucccuuccuuuccuucccuucccuuuccuuccuuuccuuuccuucccuuccuucccacacaauggcacuacuucauaggauuggaagagcucauugaguuuauuuaaggaauacaaaggggacuggaagugucacuggcauguauacacacacacacacacacacacacuuacacacaugcacacauccuaagcaacauugcuccagagguuggcaucaucugcucgaggucuucagauuucagagucaggugugaaucuuggggacuugaggagauccaggcuaugcagaagaaacggugauggggagggguccagcaguccucccccugcccaccaggcccuaggaacccuguucccucucccucccugaaagccagcagccacugccauccgugccuaucucccucccuccccgcuuucccuaggggcagucccagcucaccuggccaccugaggaucaccuggugcuccaggugcccaugcggcccccuccuccccaggcugggucuggcccaucgggauuauccauguucucauaagagucugcaucuggauaggaccagggaggaggagaacauggguggcacuggaaguaggcuggaaggcaaagucagcccaggggacagcaggggacagcggcagaagcacccaccuuccucaugauuggguccaggcuggccccgaauggagcggagcuggggggcugcauacaggauuccucucauauccucauaggacugggacccugcuugggcgggggauggagaauuggaggcuagggcaugggaaguacagccuacgguaaggaggaagacugaggggcagaggaaggugaggagcauuacccaugcugugcugggaaggggugauuugguuagcauugaguuuggggccccaguuagcuguagggucaggguuagauauggguuagauuauggcuaaggaaggggucaagaacagaacugggcugggcgugguggcucaugccuguaaucccagcacuuugggaagccaaggcgggcagaucacuagaggccaggaguuggagaccagucuggccaacauggcgaaacccugucucuacugaaaauacaaaaauuagccaggugugguggcaaacgucuauaaucccagcuacucaggaggcugaggcaugagaaucgcuugaaccuaggaggcagagguggcaacugcacuccagccugggcaacagagggagacuccgucucaaaaaaaagaaaaagaaaaagaagaaacuggagggagucggagucagagucaugaagaagcugcagaguaagcugggguccaaguugaggucugcacuggggcugaggugagguggagaucaaguccaggcugauacugcauugggaucgguguugauauucacaguuagggaggggguaaauauugggggucaggaugggggauggggcucaggaugggggauggggcucaguguugaggugagaggagucacaggauuggguucggguuuggggucagggucaggucaaaguuggaucuggugucagagcugaggccaggucacccaagcugggcaaggcagucugauugaaagcaucucucacccagggagguugcuucccggcuggggucccaggcugacccaugagggcucaggaagucuggaaagggaagagggagguuacuauuccuccuggccuccagguguccuccgccuccccccuggacuguugccauccucacacacacccauuguccuggcgaccggcugggucagcucuucauccucguucucauaagacucagcuguggcagaagagagagaacuccagggaccccuucuaggagugucacagcgcugcaauuacaccuaagucucugaggucccacaaaggccccaaguuaccguuggagaaggagucuucauccucaggacccaggggcucauccucaggguucucguagccgcugccaucugguggagaaggagggguguccaugggaguccacaggccaccgcagagguggggggccacgggggagggcagccuuacccugggagagcugguccugcccaagguuggagucguucucauagaacucggaguccuccucacugucagguuccucauagcccuccccuuccucuucuucugggccuggggguuuggggauggggauggggaaccgagucaugcccccucuccuccagggcccaguccacuauucgggccacagaccgcuccaacccccuccauguggggaacgacccuucccucucccagucauucacccacucccggcgggcuccgggaccccaaggcuccauccgccuggacgucgcugcucggguuuccauaagacggggcagugccccccaggccugcggcccaacgcugggcgcguccuggugagaggggcauuguaagacggggucagaagagaugggggcggucaaggcuaaggguccgcgcggcggggcacgggaagaggauguuuugggcucugcgaauggacucugggucuaggaacccggccuugaacccuggggcggaaucuaaaucuagggccgaggccuucaguucuggggcgaaguucugcucuugauuacgacuucaggcucuggguccugggggcguggcucugagcccuggaggcggggucugguucuagaggcggggcucauagcugggcgggacuccccgccccgggggcggaguuccgagcuccagaaggcuuggcgcacagcggauuggagggaugaggagaguggggguggagccccggaucuggggcggagcuauaggcuggaggggcggugccucuuaccgaggccugagguggguguggggagagacagcacguucccguacugguucuggggcccgcuuccugggggaggcgucacuuugaagaaucuggcgggagaagaggaagugcacggugagggccgacuuggaauggaauggcggacccacucaagauucuguccaggccuucagaaguuaaacgugaucacuugugcugggacagccaauagaggagucugagaugaucauuuccaaggaguucuucacagaggagguagcuuuggagcugggcuuugagguugggcaguauuugaaacaguagagacggagcaaagaaccccugggcagaggaaacaguaagugcaaggcauaaagugaagguggaggguguuaccgcggggugcacugguugcauuaccuccugguggggucagucauucgcuuucuuuuccuccucaggaccagggcuggugggaguuaaagggcgugaucagaggaggggcugcuuggcagggugaggauuuguggggccaggugcuggggaggucacuugguucaacaaaggagacaggaguucaaauugcgaggcggacgggcgcgguggcucgugccuguaaucccagcacuuugggaggccgaggugggcggaucauuugaggucaagaguucgagaccagucuggccaacauggugaaaccucgucucuacuaaaaauauaaaaaauuggccgggugugguggcauacacuuguagucccagguacucgggaggcugaagcacaagaaucacuuaagccugggaggcagagguuacagugagcucagauugugccacugcacuccagcuggggugacagaaugagacccugucucaaaaaaaaaaaaaaaauugcaagaggcuugggaaguuugagggaggcuagaggaagacuggggagaacaggauucuggggucuugaagggagggaugggaggaaagaaagaugguugucagacuggccagagccggcuuauccuggggaagauggaguaggguuuggacagacccacuggggacaugacucaccucuuugaagaugaagaaugcccacaagggaacacaggcagaagaucagauaagccaaagucacagcugagaccuuccagccaccaguccucagcagccagugccauaguacuagggggaaggggcuaugagacgaggaccccaggcuggcaucuuacgucccaauccugagaucucaaggaaccgcaagucugaggcacagaggcaagacacagacucggccgggcgcggugguugacgccuguaaucccagcacuuugggaggcaaaggcggguggaucaccugaggucaggaguucgagaccagccuggccaacauggugaaaccccaucucuacuaaaaauacaaaaaaauuagcugggcaugguggugggugccuguaaucccagcuacuugggaggcugaggcaggagaaucguuugaacccgggaggcggagguuucagugagccgagaucacugcacuccagccugggcaaccacagcaaaacuccgucucaagaaaaaaaaaaagacacagacucaaagucccaagcugugagaaaggcucuccucucucuaaggagccaugucccaggaggucagggauugucacagacccuggcacaggacauggggcagugucuuugagcaaaucguggacaaaccauggcuguacucagaggcaauguguggauugaggggagcauaaugaucaguuuccugcugcaauuaaggauagucacggucaaagugaagggcagaguugaguuugcaagguuacaguugggauccagcacauugcuuggaucaaguuuggagugaaaguugggguuggguuugugaauugcaguuaggauagcaugauaggauugcauggagagagaauuggcagaacacugugaccaguuuguuggacggggugaggaaaaagaaggaugcccagguucuuagccugggcgagggagcaggugguggugcccucugcuuacacugggccaccaagaagacuauacuuggggaagacauugaguuugauuuuguaucuguugagccugagguguccaugggauaucaaauggcacaggagauggcugaguauggagccuggaauagagucaccaaggcauggugacccaagaagccauugagagucaaguucaaauaggaaagugugcagacagggauaagaagagggcccagggcuccaagagugaggaguuggggaggaaggaagacuccacccaagcuggugggcaggcgcaagcaaugguaggugaagacccagaaaaguagugucuuggaagcgagggaagaaagacuugaagucuaggccaggugcgguggcuuaugccuguaaucccaguacuuugggaggccaaggcaggcagaucaccugaagucaggaguucaagaccagccugguccaacagggagaaaccccaucucuacuaaaaauacaaaauuaggcuuggcccggcccuguggcucaugucuguaaucccagcacuuugggaggccgaggcggguggaucacgaggucaggaguuugagaccagccuggccaacauaaugaaaccccaucucuacuaaaaauacaaaaaaaauuagccaggcuuuaaucccagcuacucgggaggcugaggcaggagaaucacuugaaccuggaagguggagguugcagugagcugagaucgugccacugcacuccagccugggugacagugcaagacuccgucucaaaaaaaaaaaaaaaauuagccaggcgugguggugggcaccuguaaucccagcuacucaggaggcugaggcaggggaaucacuugaaccugggaggcggagguugcagugagccaagacaagauggcaccacugcacuccagccuaggcaacagagcgagacucugucaaaaaaaagaaagacuuggagucaguguucuguguggaaguugggguuuggggugaggcugggaguagcccucggguugggggaaucuaagauugacuggcuuccacuucuucccaguacccccacacagaugccucccaguugagagaaacucuaccuggccgagcagugaucuccagguggaaugacauggucagguugccacggugacaauaauacuuuccagcgucuugagcuguggcccggggcaacaacagacccgucuccauuacccacauaucucuggccgggcgaucguccuucagcucuaggcucagcaaugacuuaggccccuuggggugcacauggguccaggagagggggccccuggacacagagucaggggguaccccacaggacagccagaguguggagccaggggccauggugaggucugggacagggagagauaagacaaggaaagccugauccucaggguuucaccucuucaguuuccccuccccucugucucuggacccccgcuucccggcaucuccccagucaucaccauacccuggcugaggcucugguucaggcugucccucggugggagacacggaggcucucccucccagaucucagggcggucuuuggcccacacauacagcuuggggcucaugagcuucccggaaggggagcuggggcccucugaggaccuguucuucaggccacagcccaggccaccuagguccgaaacauuccaccggaacagcuccccugggaagagacccagaaccaaaugcagagacacccaggagagggagagagauagagacucaaagacagagauaaauagagacaaagacccgcagagagagagaagacagugagagguagagggacaggaagcagcucauacugaagccacgaagccccaggagucugcccaccuagcuccgaguuucgcccucaaucccuccagccccucucuccagcuccauuguggccgcggaccucuucuguccaugguggccucccuucucuccuccugccccugccccagcccggcccucaccgcugcccuccacauugacuguccagccaggcugccaggccuucucagaggggggccccggcuggcacagguagaagccccccaucuguugagagacguugaagaugaaaagccagauggccaggggccucauguggauucccaggccuggcagccccaggcugaguuuuaagaaggguuuaagcggggacucccgagaccaggucagcugcugaguggggccaucugagguccccuugaggcacugcagcacagcguuaucucccucuguggagagagagggagagaggugugggcaugggugggggggaccuccaagccccccgacuccucacaccagguuauagagcagaggacuccaaaagcugggaguggaggagccggcagaguccuuccaacccuuuccugaauuuuacaaauaagaaaauggaggcucagagaggguaaguuacucagccaaggacacccagccacaacucaaguuuccagccucaaucccuucccuuucugcccuuuggacauaccuuccaccuucaccacuagagguuccucgggccugacuuccaugggggugaggaagaggaggaagaagaggaggcgaggagguggcaugguggucagacucuccggggcacccagcuucgcgcaggggaugcu

SEQ ID NO: 15398 - RNA, 668 nt, Homo sapiens
cagguuccuggcguguccuuuacagagggaaaaaagguuugagggaaggggaaccaaggcucuggacauaaaucugaauugccugucaccguccggguggaggucacagauaaagagccugaucuagacacaggcggagaggagaggagggauuugagggcguugggaggaggaaaggggggccagcaggaagcggugacuggcugaguaacaaaauggggguggggacgugcaaguuucagacuccgacuaacuacgcggggacuccgaggcgcucagaaaaaugaagccgacccggcccugccccgagggacgcuccaagagggcggaggugcagggagggccccgccacaauucgcgguaacgcaagccaggcucgggcggaagggcggccggagccgaucaaaggcuggcuccgggcaggggcagcgagggagcgagggggagcucuccgcaggccggugucccggaggaggcauaauuggagcagggcuuccaaggucacggagagacgccgggcaagaccucuuaaggauccucuuccgggcuugaaaggcaggcguccucccgaaccgcgcgacccagccaagaagagccggggcggggccggggccggggccgggggccgacucgggaaucuucggccgaggcucggcaauccccccauc

SEQ ID NO: 15399 - RNA, 3570 nt, Homo sapiens
cggaagugccuuccagccgcaggcgcccuucuucuucugugcgcucgggcuccuggucccggcuccccgguuaccggggcgcgaguaugaccacaauggcggccgccacccugcugcgcgcgacgccccacuucagcggugaguggucagggagggcgauggcggcccaggaacacuuugggggagugguagguggcuggguucggucugaccccuucccugccugacuccaagcuucggucccggcaggucucgccgccggccggaccuuccugcugcagggucuguugcggcugcugaaagccccggcauugccucucuugugccgcggccuggccguggaggccaagaagacuuacgugcgcgacaagccacaugugaauguggguaccaucggccauguggaccacgggaagaccacgcugacugcagccaucacgaagagugagugggguuggggcguccagcagcgcccuaucuacugaugggaccuggagccagggaggcaaggccagcagagugucugcuggaggaguuuacuguggccccaagagcccgaauuugugcgacagguggauugggagaugcaagagacaaauuucuccugaacaggaagaacuuugugauccaccaauggcuuggggaucacaaagucguggggaaugcucugcaagcagaggcuguacccuaaagaagucacagggcagacccuuaaggcccucuaacauuucuuucugacccacaguucucucugcuggaagaguuagagauuggaggagguuauguauuuaggugggaggguucaggggcguggucuaagcucugccucuagcacuggaacuuuagcugagagguguguucuuuuccuccuuuaguucuagcugagggagguggggcuaaguucaagaaguacgaggagauugacaaugccccggaggagcgagcucgggguaucaccaucaaugcggcucauguggaguauagcacugccgcccgccacuacgcccacacagacugcccgggucaugcagauuauguuaaggugaggguugcugggacacuggagacagggccagaagcugccucuugucaggauaaauguuaggcuuguggggaggagauuaagauauucaguguuuggguaugagauggcagguuuguggucuuggccacgcagaauggguggugaggagaugguagagaaaggugggccugaguuucuaacugcuacacuuggcuauauggaugugaacugaagagcucguugaacuuggcuguuuccuuuccuucuccucuccagaauaugaucacaggcacugcaccccucgacggcugcauccuggugguagcagccaaugacggccccaugccccagacccgagagcacuuauuacuggccagacagguacucagagccuggguaaggaugcaaaagggaagaguggggaguugggccccucuguauauugucccugucucucuggcaucuacagauugggguggagcauguggugguguaugugaacaaggcugacgcuguccaggacucugagaugguggaacugguggaacuggagauccgggagcugcucaccgaguuuggcuauaaaggggaggagaccccagucaucguaggcucugcucucugugcccuugaggugaacgcggggucaggcagggcagcugcugcagaggguggggcuggaugggcacccagagcucugcuuugugucugggaaguggcucuugauaaucgagggaaguagaauggggauuucagaguccuggcacuuccccucaacagggucgggacccugaguuaggccugaagucugugcagaagcuacuggaugcuguggacacuuacaucccagugcccgcccgggaccuggagaagccuuuccugcugccuguggaggcgguguacuccgucccuggugaggacucugucuguucccacgcacucucucuagcagaagccuagcucggggucccugauauccugucuuauucccucccaggccguggcaccguggugacagguacacuagagcguggcauuuuaaagaagggagacgagugugagcuccuaggacauagcaagaacauccgcacuguggugacagguuugggaagccagucuggagagcagggccuggcugaaggguggccuuaccccggcagaucccuugugccuucccucugucucacauucgccuuccuucucccugcuccuuuucccuuuccguccuaggcauugagauguuccacaagagccuggagagggccgaggccggagauaaccucggggcccugguccgaggcuugaagcgggaggacuugcggcggggccuggucauggucaagccagguuccaucaagccccaccagaagguggaggcccaggugagggcuccaggugacggugggcaggguugagccaagcucuccccagccuccagccaagcccagcucaccgucauugcuugcucuccuccagguuuacauccucagcaaggaggaagguggccgccacaagcccuuugugucccacuucaugccugucauguucucccugacuugggacauggccugucggauuauccugcccccagagaagguacggugggugggaggaauguaggguggaggggggacuuuuuauauuaccuuugcuucacucauaguuccaaagauacacugugacaacccgaguggcuuuauuuccuuagguggaaaggggcugcuugccgcugcuagccaacagaaggggcauggcccauggacuuaggggcgggaguccucauccagugugcccuaagcugaagcagguuaaaaguuuagcucugccagcauguacccacagaaagauuuccuagaaaaggucucuucuuuuugagcguuucauuauauaugaaggcuuaagaaguucugugaccaagaaaccugcauaacccacaacuuccuagacauuuuuuucucaagaacauaccuuaggaacacucaucacuggucucuuuuauguuuuccugucucaauaugcuguuugcaucugccugacagccugggauggaugaagcuguccccaggcagaaccauuccccugcugcauucucccaugacucuuaaccuccgagguagccaaaaaagacuuaaggaaugaaggcacccuggaggccacgcaugauccuucucuuccuacucuaggagcuugccaugcccggggaggaccugaaguucaaccuaaucuugcggcagccaaugaucuuagagaaaggccagcguuucacccugcgagauggcaaccggacuauuggcaccggucuagucaccaacacgcuggccaugacugaggaggagaagaauaucaaaugggguugagugugcagaucucugcucagcuucccuugcguuuaaggccugcccuagccagggcucccuccugcuuccaguacccucucauggcauaggcugcaacccagcagagggcagcuagauggacauuuccccugcucggaaggguuggccugccuggcuggggaggucaguaaacuuugaauaguaagccag

SEQ ID NO: 15400 - RNA, 3570 nt, Homo sapiens
cuggcuuacuauucaaaguuuacugaccuccccagccaggcaggccaacccuuccgagcaggggaaauguccaucuagcugcccucugcuggguugcagccuaugccaugagaggguacuggaagcaggagggagcccuggcuagggcaggccuuaaacgcaagggaagcugagcagagaucugcacacucaaccccauuugauauucuucuccuccucagucauggccagcguguuggugacuagaccggugccaauaguccgguugccaucucgcagggugaaacgcuggccuuucucuaagaucauuggcugccgcaagauuagguugaacuucagguccuccccgggcauggcaagcuccuagaguaggaagagaaggaucaugcguggccuccagggugccuucauuccuuaagucuuuuuuggcuaccucggagguuaagagucaugggagaaugcagcaggggaaugguucugccuggggacagcuucauccaucccaggcugucaggcagaugcaaacagcauauugagacaggaaaacauaaaagagaccagugaugaguguuccuaagguauguucuugagaaaaaaaugucuaggaaguuguggguuaugcagguuucuuggucacagaacuucuuaagccuucauauauaaugaaacgcucaaaaagaagagaccuuuucuaggaaaucuuucuguggguacaugcuggcagagcuaaacuuuuaaccugcuucagcuuagggcacacuggaugaggacucccgccccuaaguccaugggccaugccccuucuguuggcuagcagcggcaagcagccccuuuccaccuaaggaaauaaagccacucggguugucacaguguaucuuuggaacuaugagugaagcaaagguaauauaaaaaguccccccuccacccuacauuccucccacccaccguaccuucucugggggcaggauaauccgacaggccaugucccaagucagggagaacaugacaggcaugaagugggacacaaagggcuuguggcggccaccuuccuccuugcugaggauguaaaccuggaggagagcaagcaaugacggugagcugggcuuggcuggaggcuggggagagcuuggcucaacccugcccaccgucaccuggagcccucaccugggccuccaccuucugguggggcuugauggaaccuggcuugaccaugaccaggccccgccgcaaguccucccgcuucaagccucggaccagggccccgagguuaucuccggccucggcccucuccaggcucuuguggaacaucucaaugccuaggacggaaagggaaaaggagcagggagaaggaaggcgaaugugagacagagggaaggcacaagggaucugccgggguaaggccacccuucagccaggcccugcucuccagacuggcuucccaaaccugucaccacagugcggauguucuugcuauguccuaggagcucacacucgucucccuucuuuaaaaugccacgcucuaguguaccugucaccacggugccacggccugggagggaauaagacaggauaucagggaccccgagcuaggcuucugcuagagagagugcgugggaacagacagaguccucaccagggacggaguacaccgccuccacaggcagcaggaaaggcuucuccaggucccgggcgggcacugggauguaaguguccacagcauccaguagcuucugcacagacuucaggccuaacucagggucccgacccuguugaggggaagugccaggacucugaaauccccauucuacuucccucgauuaucaagagccacuucccagacacaaagcagagcucugggugcccauccagccccacccucugcagcagcugcccugccugaccccgcguucaccucaagggcacagagagcagagccuacgaugacuggggucuccuccccuuuauagccaaacucggugagcagcucccggaucuccaguuccaccaguuccaccaucucagaguccuggacagcgucagccuuguucacauacaccaccacaugcuccaccccaaucuguagaugccagagagacagggacaauauacagaggggcccaacuccccacucuucccuuuugcauccuuacccaggcucugaguaccugucuggccaguaauaagugcucucgggucuggggcauggggccgucauuggcugcuaccaccaggaugcagccgucgaggggugcagugccugugaucauauucuggagaggagaaggaaaggaaacagccaaguucaacgagcucuucaguucacauccauauagccaaguguagcaguuagaaacucaggcccaccuuucucuaccaucuccucaccacccauucugcguggccaagaccacaaaccugccaucucauacccaaacacugaauaucuuaaucuccuccccacaagccuaacauuuauccugacaagaggcagcuucuggcccugucuccagugucccagcaacccucaccuuaacauaaucugcaugacccgggcagucugugugggcguaguggcgggcggcagugcuauacuccacaugagccgcauugauggugauaccccgagcucgcuccuccggggcauugucaaucuccucguacuucuugaacuuagccccaccucccucagcuagaacuaaaggaggaaaagaacacaccucucagcuaaaguuccagugcuagaggcagagcuuagaccacgccccugaacccucccaccuaaauacauaaccuccuccaaucucuaacucuuccagcagagagaacugugggucagaaagaaauguuagagggccuuaagggucugcccugugacuucuuuaggguacagccucugcuugcagagcauuccccacgacuuugugauccccaagccauugguggaucacaaaguucuuccuguucaggagaaauuugucucuugcaucucccaauccaccugucgcacaaauucgggcucuuggggccacaguaaacuccuccagcagacacucugcuggccuugccucccuggcuccaggucccaucaguagauagggcgcugcuggacgccccaaccccacucacucuucgugauggcugcagucagcguggucuucccgugguccacauggccgaugguacccacauucacauguggcuugucgcgcacguaagucuucuuggccuccacggccaggccgcggcacaagagaggcaaugccggggcuuucagcagccgcaacagacccugcagcaggaagguccggccggcggcgagaccugccgggaccgaagcuuggagucaggcagggaaggggucagaccgaacccagccaccuaccacucccccaaaguguuccugggccgccaucgcccucccugaccacucaccgcugaaguggggcgucgcgcgcagcaggguggcggccgccauuguggucauacucgcgccccgguaaccggggagccgggaccaggagcccgagcgcacagaagaagaagggcgccugcggcuggaaggcacuuccg

SEQ ID NO: 15401 - RNA, 652 nt, Homo sapiens
gcuugggaaaccucugugauucuaucccuugugccugguggguggcuaccggcuaucacagcccucuaaggcugucucucuccaacaccgcuccgauccugcaaacucuggucauuguccaaacccacucuccccgcccucaccuccauccccucccaugugcacugcguuccacagccugccuaaccccgcacucccagaauggucacagccacagcccccgcaacucacuguuugccauaguugccuccgacagguuuggugacgagcuccuccccggacaaggacgacucggacucgcuguccgaaccgguggugaaaaaccgcgacauggcgacggcgcggaggugcuacggccggaccugcgggggagccaaggcgucaccggccacgcgaagaggcccgagccaacaccucccgacgcccaaccccucaccggccccacccggaccucgaccugggucucccaccacgaagcacgaggcccaaaaaauaccaaccagcugagcccgcgagucacaccgcagggcccugacagcggaaacgccgagagagaaggcggguccucgcgucacuuccgggaagcgccgacuaacuacacugggagacuacaacucccaguggccuucgcgccauaagggggcggggacaa

SEQ ID NO: 15402 - RNA, 3936 nt, Homo sapiens
ucccgccgcagcggcggcagcagcugggcucgguguaaacaaguccaggcgccugcgaacccgggcccgggggggacggcgcccgccaggagcgccccccacucccaggccagcccaccccggcggaccgggccccgcgcgcccaggcgaggugaggcccgcgccgucagggcugcgugucgccccgcgccccugcccagcccgcgaggacugcccccucccccggcgcccgcccccacccccgcgccccaggugagccccggaguccagguaaggcuccgcguugcagguaagagccccugagcguagaggaggccuuggcgcccgcaggugagagccccuccccuccuaggugacccucaaccuucacggcgaggccuccuaccuccuccaggugggggacccucuccccgaugaacccccuaaaccaccagugaaccccacugcucuccagaugaggucgcaaggaccaaccagugccuacccgcccaugcucccccgaaacugggaacugacagcccagccccuccaaagccccuuccuccagcuucagcugccaggucagcaagggugaggccggaagcaggcgggugacucacccugggcaccuccgagccucaguuuccccauggaugcaaccugaggccuccucacugagucaaaaccgagacgccucugguccccggagaggcugcuggcucuggggaaaggagagagcagcccagugugacagagcgaguccccacggcucugggagugccucgcauguguguggcccagguccugacagcccaccuacucccuccccggcaggcacugggcucccucugcuccccgugggccgcuccccgcguggggccacugcccccggcccccgccauggugcggauuucaaagcccaagacguuucaggccuacuuggaugauugucaccggagguauagcugugcccacugccgcgcucaccuggccaaccacgacgaccucaucuccaagguaaccaaccaggccacaguggggcuggaaccuauaggggcugccuggcagcuccccaccggcagcccugacccccuccucucuucccacccucucacccuuuaguccuuccagggcagucaggggcgugccuaccucuucaacucagugugaguaucuggccucccuucuugcuuucccugaccucuguugugaccugugaccccuggcauccugcugagacucccagaguuccccggugcaggcaggaaauugugagcaucauuucuuggaugcugaggacagacacagugcuugagggggugggcccugugauggcaggacccucccugggacuaccccauguccccacagggugaacgugggcugcgggccagccgaggagcgggugcugcugaccggccuccaugcugucgccgacauccacugcgagaacugcaagaccacuuugggcuggaaauaugugagucacccaccucugaccccaggcuagccuuugaccugaccuuccaacaccuccuccugacaagcugucacccuauagccuuucagauugcauaggccgagcucacacaagucagcaucccugaccacauucucuuuaucuugcaccuugcaagggguguagaacuuuucucuuaacccaucccuucucucccaggcacuuggauccccauuagagaguuaggauauaaucagagucaccauuuauggaauguuuaugugccuugcacuguugugugccuggcgucuauuaucucauucaaucauugcagugauccucuagguagaagcuauuauuaucucuacagaagaagacagggaggcccagagauguuagguaacuugcccaagaucacccaacugguaaguaacagaauagggaccagaaucugaguugguugguugguuuuuuuuuuucacuccaaacccuuggucaccagcuuauauugucauuuagaguaucagaaaaauugccccagacucugcaacaacauggagcuuggguucaccagccucccuuuccauaguccucauugccacugcugcuguccagggucugauuucacuacccugagucucauuuccuuaucucucaguggaagauaaagccacugccuagcacccaggauuguuacagggaucagauuagaugcucaggaagaugcucuugggacacugcaagggacaggauucuucaggcgucgcuuggaacuguggugccucugugagguggaugucccaggcagagccagccagccagcccugaccugagcucgcugcugacccugccacagauuggcugugugucucuggacagguggcuuggccacucuggaccucuaccaaauaaagagcuggccggccaggcacaguggcucacaccuguaaucccagcacuuugggaggccgaggcggguggaucacaaggucaggagauugagaccauccuggcuaacacggugaaaccccaucucuaccaaaaauacaaaaaaaaaaaaaaaaaaucagcugggugugguggcgggcgccucuagucccagcuacucaugagguugaggcaggagaauugcgugaacccaggaggcagagccuugcagugagcggagacagagcgagacuccguuucaaaaauaauaauaauuaauaaagagcuggccuaaacaagaggucaaaaacucaagugccaggcugggugugguggcucacgccuguaaucccagcacuuuugggagucugaggcagguggaucaccugaggucaggaguucgagaacagccugacuaacauggugaaaccccaucucuacuaaaaauacaaaaauuagcucggcgugguggugggcgccuguaaucccagcuacucggggccaaggcagcagaaucacuugaacccgggaagcggagguugcagugagccgauaucgcgccguugcacuuccagccugggcgacagagcaagacucccucucaaaaccaaacaaacaaaaaaaccucaagugccugcaaggccaagcagauacuguagauguguaaaggguagcauagauuggcaggguugggaguugggggcaggcugggcaaacuggagugagcaaggccuacuuauauuuuaauacuuuaaaguuauuuuuauuaaacugucugcuguccaaacauaauacauguuguaggccaaaauggccaugaagcuaccaguuugcaaacccugaacugugaaaucuuuuagccacuucccuaucuucucuguuggagccaucauuaguacuuaaaaaaguaccuuugagucagggaguucuauucuacucuguguuugugagaaauacggcccugccccucugggccacaguuuccucauauguaaaauggggccacucauguccacuucccaaccccagugccuuguggugagacuguugcuccggggaugacggucccgccccuccuuucaggaacaggccuuugagagcagccagaaguacaaagaggggaaguacaucauugaacucaaccacaugaucaaagacaacggcugggacugacccccgcucccccgacgcauguggcuccagcccggccuggccgccagggagcgccacuggcuucccgccacccgaagggagcucuggacccucagagccccugcagaggacggaucuagcuccuguauauauauuuuauugcaugcacugugaccuuggggggagaacagaagggggacgacgcccccgcaccuccugcgaucuggcuggcuuggaucucguuuuuaacccguuccugccccaccugcccuauaguuauggccuguguucugcucuccuggucccagugcaccgucugcucugugaacuccucccaccaggcccuucuuaccccacgcgugucugucccccucguucuguagcguuuguacauaauaaaacaauggaguggagacagc

SEQ ID NO: 15403 - RNA, 5427 nt, Homo sapiens
guuuccugagcauggauggcuuuugaguuuuauuaacaaaaauacucuggucccagaacaacagacugguguggccugcaccaguguguguggggggguggggauugagccccuccagagcccauggggaggccugguaaguggggaugcuggucuguggccccauuuggccaggcagagccccuuccauucacacggaggugagagccgggaaggggaagccggccccagcuggacucccagcagccuugguuaggcuuugaagccagaggggggugggagugaaaucaaggugugaaguugagggggugggugggcaggcccaaggcggccauuuggugugggggauggggccgguggaggugagggggcuccagggcugggggaagggagcgggagguuugugauggaggcagaggggcccagcagugguucaguacauggguuuggagcccacauccagauagcccccaggcgcgguguaugguagagggaaggggcccccuuggagaaagugcggggcaaaggguaccgccgguggagccgcuggguacccggagcccccugacccgugcggcagcuccagaaaugcagccgaguagggggcugagcgcccggagucuggagccuccgggaagcuggggcuccugacauggagagagggaugucagagcagggcagagggacccgcagccccgccugguccccugucccacucaccuggugggaaggugacugggggccccauggaaagccgcagggugcaggagguaggccucagcacuggggccaccacacagaggugccggggcagcgguggcuuccccgggggcuggggccuguucuggaucugauucacgaaugucuccacccaggguggagucgcagggaccaccuggugugucuggggagagggaagggagagguugggcuagggaggaucccugucucaggccuggccccaucgccaucgggacuacacucaccuccgcucccauaggccucuguggcugcuggcucugggccccgcaguuuccucuucacacgggcgucucgcucccuggggaacagugguggugaugaugaugaugauggugauggccauggugaugguaacaguacuuacccggugccaggcauuucacccucccagggacccugucagguaggggccaucauuauacccauuuuauagaugaagaaacugaaggccagaaaauuaaauaacuagaaaguggcagagcuggaauuuugucccugcucaaauuuguccaugcuuuccuauuguguuuaguaucaguggaaacuccuucccaguggcaaggccagggcacagucucaccuagcucaucuuucugccccaucuccacucucagccucucucuggaauccucuucuguccccucuucacgggcugaaccuguccuuuuucuuuucauuuuuaaaauuugagauggggucuugcuauguugcccaggcuggagugcaguggcacagucacaggucacagcucacugcagccuccaacuccugggcucaagugaucuuuccaucucagccuccgaaagugcugggacuacaggcaugagccaccaaaccuauccuugccucacugcaagcgcaaguuccucaaggaaguccucccugaccuccgagagcacacaccccucccucauaacauccgucacaguucugcuuuugcauuugauggagugacuccuugguucaugucugucucuucugacaaacuggaagcuacuugagggcaggggccagcucugaggugcugcacuuggaacaguucccacggccuuacggaaccuuuacuguccgacauaaccuggcuuccccuccccugccugacucuuagucacuccacugcagccacgccacaggcacagccccaccucagggccuuugcacgugcuguucccacucccuagugugcuuugccagaugcccaccuggcucccucccguacuuccuucagcucuuucucaagugucuucuucccacugaggccuuuccaggccucuuaucuaauaccucaccccaguccuuccuaucuuuuccugguuuauuucucuucuccuuuuucuuuuuuuucuuuuuuuuuuuuuuuuugagacagaguuuucuuuucuuucuuuuuuuuuuuuuuuuugagaggaaguuuugcucguguugccuaggcuggaaugcaauggcaugaucucgacucacugcaaccuccaccuccuggguucaagagauucuccugccucagccucccaaguaguugggauuacaggcguuugccaccaugccuggcuaauuuuuguauuuuuagcagagacaggguuucaccauguuggcaggcuggucucgaacuccuggccucaggugaucugcccgccucagccucccagagugcugggauuacaugcgugagccaccacaccuggucucucuucucuuuagaauggcuuccuaacagaugacauuuuauuuauuucucuugucugcuugucuacucuccccacuagaaaucagcugcaugagggccggggcuuugguuugcuuuguuuguuuuaucuccagugccuggaacugucccuggcacauagcagguacuauauaaguauuugcugagucagugaaugaauguuuucacuuaccacugcauuucugauguccagcacggugccuggcacacagugagugauuaauaaacauuuguugaaugcaugaacaaaugaaugaacaacucccaccucuuacaguuucugccguucucccggaagccuuuggcaaagggauuggcugcaaucuucaguugugugaucuggggacacacaugcagggucaaagcaacugcggucugggcagggggccaccacccccucaagcagggucacucaccuguggguucugguaggcugucacggagaugaauguggucucggggaagcggaaggaggccaugcccccccagugcuggcugcagagcugggcugcccgaacuagguguaugcgggguugguacuugugcauggagugcaggaucagcugggagggaggaaaugggagugauucccugcccugcgccucacccuuggccucccuuccagcaccccccaacccuauccuggagucccagccugggccucacguggccguggggguccagcgugcuguuggugagcuugacacgauggaaagacacaggcugccgcauccaaugugcaccaguggcaggagagucggggugaauguagacacggucaggcaggcggggcucugccuugccgcugggcucccagcgccggcccugccagcgguagcgagccccauccaccggaaucacauccagaagaaacaaguagcgggccucgggguccaggccagugacugacacucggcaggcagggaacaugcgccugugcaagggaggggacaggagaggccuggagcuacccacuggccaggggugggcccagcaccaguaacgggacauaacaacgggcuccccagagcugucagagaaacaucaaaggagguggaauuagaacccagagggcaggcuggaggcuguggcucacaccucuaaucccuauacuuugggaggccaaggugggaggaucucuugagucaggaauucaagaccagccugggcaacauagaaagaccccaucucuacaaaaaaauuaaaaaauuagccaggcaugguggugcacacugauagucccaguuacuacagaggcugaggcgggagggucacuugagccugggaagucaagacuacagugagccacaauugcaccacugcacuccagccugggcaacagggcaagacacugucucugaaaaaugaaaaagggccaggcgcaguggcucaugccuguaaucucagcacuuuaggaagccgagguggaaggaucaugaggucagaaguuugagaccagccuggccaauauggugaaacaccgucucuacuaaaacuacaaaaauuagccgggugugguggugugugccuauagucccagcuacucgggaggcugaggcaggagaaucgcuugaauccaggaagcagagguugcggugagcugacgagaucgugccacuacacucuagccugggcaacagagcgagacuccaucucaaaaaaaaaaaaaaaaaaaaaaagaagccagagggcggaaucuuagagcuggaagguuuucuugucucauuuuacauuuggggaaacaggacagacggguuaagugaucugucacacagcagguuaggaacagagccaugacuccuaccccucaaagccuauuugcagaagcaggggugacuaacuuucuugcuaggagcuuccuguccccacccuccucuccuccccugaucuccagcaccagaaucugcagcucuuagaugaauuugcuuuagaaaaaauauacccugccugcaguagggccgaggacuuuccaugcuagggcuugaguuccugccccagcuaaagaccucaucuaaggucaaacacugaccgugucccugccucuagggugacccuggaccuagucauauacugacuccuauucgaguugcauacugaucccgaauccuggccagauuucccugaugcuggucaaugggcuggcccuugacccccuguccuugucuggaugcuggucuaagccacacacuaaccuauaacccagagggacuuccugacccugccccagacugacccaugacccuugccauagauuggucccuaaacucagccacagacuccacagacuggcccuuaacccuugucacagagugacuccugauuccugccacagaguaacccuugccccaggccauagucagauucuaggccuaggcagagcucuagccccucgggaaccacccaguccuagcccccuccccagggacucugccuuucccaagagacccccaccagaaacacggacccuggccagccccucaccucccagcuuuggugaugaucauuucuguucccacagagcugaacuccuuccauagcucccgguucuccaggcucaggcugacccccgggagggaauggagggccucuggagcugauggggccggcucagugcccauggcagggggcagaaggggcagaggugggugcgcggccagggugcggggagcagccuccaucccggagaggaagcaauccaguuuagggguguccaguucuggaagccggggaagaaugaggagccagccgagggccacagccccccuauucuccuacccaggagcuggucccaacgcucaccgggguagcgguagcccuccgcuagggcgggugggaagcuggagucggccccagguugggcgggccccaggcgguagccggcccccagggacggguacaauucucguggaugguacauguuguaguuccgucuggccucaggu

SEQ ID NO: 15404 - RNA, 981 nt, Homo sapiens
aagcagggaacuuuugcucaucaacaggagaggaggugggugugggugcucagguugaguccagagcccuuguccggcucuuuaggccccuuucuggaaguuucuguggggcauggagaucagaggggagaggucacagccugccccgcuagaacuggggucuucagccgcucccaaggaaggugguggugggugggguuggagaaagggggcaggccuuacaugugggugcagaacuggaaaaggagaaagaagaacgccaccaccagcaagcccaccaggaugugauggaagagcccggggcuggaaccugcuagacaaacaggacccuuaacuccccucugauggcccaaugaagggucuggggcugcucuccuccagacccuggcggggagggaggucccuucucaagcugguucauaccugaguuaaugaacacgauggguuucucuccaauaaacugggccacagccagcagccuggcuuggucugaguccggauaaucgaagaagucaggucugucuaagaagcgcggagacucuguccccagggcugacgccguggcacgcuugggucugggugcuaggacccaagcaaacucugugacaacagccaagcugaccccugccuuuaucucucgaggcggaagcugacuugggacccugugagaccacccagccuuauugcagaggcuguggagggucuugauuucccucagggucagcugggugcaccacgacaaggcucgcgguuguugggggguaggugggaccagcaggaugggagagaagaguggagagaaaaugagagggugcaggguuggcuuccgagucccuaagugggcaucacacuuuaugcucccagagcugccugccuuccugcugcucccaagacagcuucuuaccaguuucuauggccccuagugcagccagccacacccacaccagcacccauggccacagccucaugacuccuaucaug

SEQ ID NO: 15405 - RNA, 981 nt, Homo sapiens
caugauaggagucaugaggcuguggccaugggugcugguguggguguggcuggcugcacuaggggccauagaaacugguaagaagcugucuugggagcagcaggaaggcaggcagcucugggagcauaaagugugaugcccacuuagggacucggaagccaacccugcacccucucauuuucucuccacucuucucucccauccugcuggucccaccuaccccccaacaaccgcgagccuugucguggugcacccagcugacccugagggaaaucaagacccuccacagccucugcaauaaggcuggguggucucacagggucccaagucagcuuccgccucgagagauaaaggcaggggucagcuuggcuguugucacagaguuugcuuggguccuagcacccagacccaagcgugccacggcgucagcccuggggacagagucuccgcgcuucuuagacagaccugacuucuucgauuauccggacucagaccaagccaggcugcuggcuguggcccaguuuauuggagagaaacccaucguguucauuaacucagguaugaaccagcuugagaagggaccucccuccccgccagggucuggaggagagcagccccagacccuucauugggccaucagaggggaguuaaggguccuguuugucuagcagguuccagccccgggcucuuccaucacauccuggugggcuugcuggugguggcguucuucuuucuccuuuuccaguucugcacccacauguaaggccugcccccuuucuccaaccccacccaccaccaccuuccuugggagcggcugaagaccccaguucuagcggggcaggcugugaccucuccccucugaucuccaugccccacagaaacuuccagaaaggggccuaaagagccggacaagggcucuggacucaaccugagcacccacacccaccuccucuccuguugaugagcaaaaguucccugcuu

SEQ ID NO: 15406 - RNA, 6502 nt, Homo sapiens
cucccucagaucgugaggcuccccagccuggcucgggagaccccgagauccccggccggugacagcaggcgacccccugcuccugucaaccugugggucccuacggacguggggaagggaggagggaggccccagcucccugcgggggaggggcgugaagacgcgcggggguggggggagaugagccggcgucgccaugacaacgaggccggugguccggccuuggggacccgggagggagggaggcgccguggccgcgcgcgcgggcgggggcggggggccaggucucccaggaguaguuggggaacacccggcgauucuggcggcugcuuccugguggcgcagggagcccgcguguuugcgagugcgugugugugcgaaguucuccggguaagugugccagcgcgcgccugggugugugcaagggugugagcgugcacacgugggcacgggcgugugcgcgcgggggugcccgguuggaugugugcacacgagugugugccgguccgcgugccccugcgugagugugcgcgcgcgagcacacgugugugugcgcgcucgcgugcgcucccgagcgggccccgggugggaguccgagaucccgcccccuccccagccccagcgccccuccccgucccccgccgccgcgccggcugcauccucgccuccaccucgcucacccccuccuccccgcacuuucucggcgcucccucccucucggcucgcacagcucgacuccgcgcucuccucgccggccgccgccgcccagccugcgcccgccguccccccagugccugggcaccuguuggaggcagaggcaggugcagggggcugggcaggccgggggcgugagggugcggggaagcgugccagccugugugcgcuacggggguguucggcucuccugcggcugcaauuucuggcuccccugaggagccagagguggcaucugaggcuggggucuccaccgugggcuguggugagcgagcgggggaaccaggcaggcagacagguccuggggcugaaugaggggacagugggcaguuggagccuagaggggugggugacacccugacuagaccagcgccuggugcagaggaggacagagccuccgagaaacagaggcggggcccugcagggccccuugggggacaggcaggcucaggagcagaggggagccccggaggagaggaaggagcuggcaagaugauacagggacaaccuagaagugggugggugaggacgggguggugcaaccucgacuucugcaaggaguggguuggcagcccagccccuguggagucagcuuggggucugcagggcccaggccucccaccugccaccggcuggcacacaccacccucucccucgacaccuaggaagggaggccagugagggccccacagaccgaggaggccgucgccuggcccucagccaggauggcuagguaugaugggcucacuggcucacacgcccucuccuagccaggggugcugcaugaggggccgcaggggcgaucgcaugaccaucaacauccaggagcacauggccaucaacgugugccccgggcccauccggcccauccgccagaucucugacuacuucccccggggaccaggaccugaagggggcggcgggggcggcggggaggcccccgcccaucuggucccccuggcucuggcccccccugcagcccuccuuggggccaccacgccugaggauggugcggagguggacagcuaugacucggaugaugccagugagucugggggcuuggaggccccaugugcuggugggggucuccaggcuugccgugguggggggagagggggaugggcccugcuggcugugcauguagguaggggaggagggcaguggggggguggcagggacggccaccacagcugcagucagcguggagauuacagcuucagcaaggcucaauauucaguauuucugcugagacacuccaccacccacacagccccaguugcggccgagccagggacccagacgcacacacgcaugggcccacucagccucuugcacucacacucgcgggcuggcaagagagagagacacacagagccagugcccaccugcuggccucucgcacacaccugucuccauaccgacccaugcugccuuuccucucucuccagccgcccuaggcacgcuggaguuugaccuucucuacgaccgggccuccugcacucugcacuguagcauccucagggccaaggugggcacucccugccacccaagcccgggcccgguuugcgugcagcccccagagggggcccauuccuccuucccuucccaggccugcuccuucguccugcccuugcccccuccuucugggcuccuccaggguccagcucuacaagagggauggagagaggugccgggagccucuagcccucuccccugcccuccucuccagggccucaagcccauggauuucaauggccucgccgaccccuacgucaagcugcacuugcugccuggagccuguaagguaacagccuccucucgccccgcccggcccagcccaugacuccagccuguggggcuggaggacagguauugagaaccuuucauccccacaucccaggccaauaagcuaaaaacgaagacucagaggaacacacugaaucccguguggaaugaggaccugacuuacagcgggaucacagaugacgacaucacgcacaaggugcucaggugagggccccccuccccaccacccagcagcagcucggggacagcugacauuguaaccgcugguugguugaucuaugucccauuaagcccguaccucucugaugcucaagaaccaucagcggcucccuagccccuuuggcagcaggccaaaauucuucccugccauuccugccccucaauaucuccugccugccaggugugguggcucacaccuguaaucccagcacuuugggaggccgaggugggcggaucacuugaggucaggaguucaagaccagccuggccaacuuggugaaacccccgucucuacuaaaaauacaaaaauuagccgggcgugguggcauguaccuguaaaucccagcuacucgagaggcugaggcaggaggaucacuugaacccgggaggcagagguugcagugagccgagaucgcaccacugcacuccagccugggugauggagacuccaucucaaaaacaaaacaaaaguaucuucugccccucaaacagaggacucccuucuuccaacuggccaguuccacaacuccugaacuuuuccuguuguuuucuaucuggaaagcuccuuccugccagccuaaauuccgcucaucugagguucaguccaagcucugcccccucccaaaaacguuccuggguugccgagaccccuucucagagcccuuggcuuaagccagaccucugcagcuuuggucugccccuuccgugccuugaguuccccuaaaaucucuuaaggagugaagucuucagggacagggaacuugcuccgucauccuaggagauggagauguagggagaguacucccucaagucagguggcgggcagcgaaacccaggcucuggagagaccucugccuuugugcuuggauuugcagcugggaccuucccugauggucagggcugugcagcagagaggccaccuugguuucagcuauucggguggaauggaggggaggccagaggccaaaaccagaaugagaccaaaaaaugagcgcucaccagggcccagcccaggcuuagcauuuucacauuucuuucuuucccuugacuaucuccauuuacagaugggaauugaggcauagggugaucaagugacuugcccaaggucacacagguggcucagaaguggcagggcugggaucugcccauccuccaugccacagaugcccagccugguagugggucacugcggaggcagggcagggacugcaggaggacagguggcuggaaagcaaucauuucuuagugagucccugcggggcuggcucucugcugcaugcaggaaaaggacggggguucccgaggaggcgugggguacuggucuggcugcccaaggcuccaaggcccuucuagcucucacggccugugucuauggccacauccaccgugguguucggcuccugcccccaggcccugaauggaggcagugagcagcgugcuccaagauuucugagggcuucccacaauggcugagcauguccugauggaccagggacagccggguggcugcagagggagggacagaggaaugggcaaaucugcuuguccuucucaagugccagccugucuuccagaugagacguaguguuuagggcagagcugggcugguccaaggcccuuccuacaccccggaacggggcucagguaccccaggggcccugacacugcaguucccgaccaggaucgccgucugugaugaggacaagcugagucacaaugaguuuauuggggagauccgcgugccccuccgccgccucaagccuucgcagaagaagcauuuuaacaucugccucgagcgccaggucccggucugugugggggcugcaggggcgccaggggagggggcccuggggaggccaggcuuccagaaccuucucuuugcccccucagcuggcgucccccucuuccaugucagcggcgcugaggggcaucuccuguuaucugaaggaggugaggcaccucauggggauggggaugcaugugggugggaggcugcaggggcccaggcugacccugagucugugccccgcaguuggagcaggcggagcaggggcaggggcugcuggaggagcguggccgcauccugcugagucucagcuacagcucgcggcgccggggacugcugguaggcaucuugcgcugcgcccaucuggcugccauggacgucaacgguuacucggaccccuacgucaagacgugagcccuugcucugacccucuccuccccagggagccugcccuggccugaguugggccuggccugucccucaccccucaguucgucucccuccaccccacccccagguaccugaggcccgauguggacaagaaauccaagcauaagacgugugugaagaagaagacucucaacccagaauuuaacgagguacccaggaggggacgggacauggagggaggccagggaggggcuggggagcuggcucacgaacggguggccggccuugucccuaggaguuuuucuacgagauagagcucuccacucuggccaccaagacccuggaagucaccgucugggacuaugacauuggcaaauccaaugacuucauuggugagggaggagcuggcugcggguguugagggcgggcaaguggcagggagguggcccugacccugcccaccugcuccccagguggcgugucccuggggccaggugcccgaggcgaggcucggaagcacuggagugacugccugcagcagccggacgcagcccuggagcgcuggcacacccugaccagugagcugcccccugcggccggggcucuguccucagccugaguggacagcagugucccggcacaggcccaucgagccggguccaguacccaaccuucgcacgaguguguugcacguuuacacagggugggcugcccccacccugcacuaccuauuuuugugagucuccgugacccgggucugucugcucaugaggggcugcggaguucuauauucacauaugcaaaccuccugccugacucgcuagucccugcaaauaugcaaaccccccaucaucugcacacccgggcagugcucagagcccggccccaggcccccgcgcuccucacuccugccucuccacgcugccccgucccucucccccaacagggaggaggucggauuaggggagguucagaggaggagaaugucucaaaaaaaaaggacaaaaaacaaacccagagccacuccuuuaauacagaaacuucauugaaaaaaccuagcccuguacagcugcccuuuuaaagagguggccauugcagggucucugccuccccagcagguggcagaugcucccggccacucguuuaaauaacuguccccuggagggggccgggguuugaaggcagggccccugccacccuccugggggacacccgugcauguuuacgccuuuucugguugugucaguggccggagcauggcagcugggcaucaauaaacaccuccgaggaagcuggacucgugugugcuggcacggggagggcgccgggcggggccguggugggcauggcgugaugucacggucacuccgggaugucgaucaccaggucaucgucuccauccaaggcaucguccccgcuaccugcaucgcugaacaucugccgagggaccgugcucaggaucgugggggggggcaucuuagggggugggaggggggucaggguugucccgaccccagccccagaaccccggccagggaaggucagcggcccucccacagggcagucggggggucccaccgccaucug

SEQ ID NO: 15407 - RNA, 5862 nt, Homo sapiens
gggcuccgggaaggagugacgucagggugagugggagcccaggaaggagcgaguaggagagagggagcgagagccaggcaggaccgcagggucggggcuagugaggagcgagggcaaggagagagcagugaggccggagagaaagaagcugccgcggaggaagacaggcugcggguucccgggacugcagguccaggcaggguaggaaccgcugcccaggggagcuaggaggaagcggggagagagagcgagcgaaaagcggggguggggaggaaagggggagauugaggugggagagagaagcagagcgagagagaggaggcugcuggaaggagaaagaagagggugaggaggcgacagagggagaggaggaagaagagguagaaggagagagaaaggggagagaaaggagagaggaggguuggaggugcaugaaggaggggagagggagcuucagcguggagagaggaccgcggaaggagagagagacagcccagaguggaauguggaagggaaacaguccagcggggagccagggggcagccauggaagggacagguggggagcuggggggacaggggaacugggguccggaggacgccccaggccucuuggccagggccucccugaucaugcucccguggccacuaccccuggccuccucggcccucaccuugcucuucggggcccucacuucccuguuccucugguacugcuaccgccugggcucccaagacaugcaggcccuaggggcugggagccgagcuggggguguucguggugggccugugggaugcucggaggccggcgggccaagcccaggggguccuggggaucccggggaaggaccuaggacggaaggccuagugagccggcggcuucgggccuacgcaaggcgcuacuccugggcugggauggguagagugaggcgggcagcucaggguggcccaggcccugggagagggccagggguccuagguauucagcgcccaggccugcuuuuccuaccagaccugccuucagcccccuuugugccgcgggacgcccagcggcacgacguggagcuccuggagagcagcuucccugccauuuugcgggacuucggggcugugagcugggacuucucagggacuaccccuccgccucggggcugguccccaccucuggcccccgggugcuaccagcuccugcuguaccaagcaggccggugccaacccagcaacugccgccggugcccgggggccuaucgggcacugagggggcuucgaagcuuuaugagugccaacaccuucggcaaugccggcuuuuccguucuccugccuggggcccggcucgagggccgcugugggcccaccaaugcccgggucagaugccaucuggguaaguagcugccgccuacugacaaccuccuugccucgaugauuucccccccagacccuucucuccgccagagccgucugcugucugguucucauugugccucucuucuuccauggcucccuguugccacccacagcagcauuuccucagccucgguuaucugcacaccaccuucauaagcuuugccguggucauucccaucuguacugcguuucuucaccuuggcucuccccccgaccuuuuguucuacguauuuaaaagaaauauuuauagcacuaucaguauuacuugcccuaaauaguacucauaaaaagccuggacaacacagugagaccuugucucuacaaauaauaaaacaauuagccgggcgcgguggcccaugccuauggucccagcuacuggagagggugaggugggagguucacuggagcucagcaguuugaggcugcagugagcugagauugugcuacugcacuccagccugggugacaagaaaguacucauaaacacaagcugaaauuuaaaaaagaaagcuuucaacagucuagaacauucuaguuaagugcucuagucucucugauccugaagccuacacuuuuuucuuuuuugaggagucucgcucugucgcccaggcgagagugcaguggcacgaucuuggcucacugcaagcuccaccucccggguucauaccauucuccugccucagccucccgaguaucugggacuacaggcaccugccacuacaccuggcuaauuuuuuuuuauuuuguauuuuuagugaagacaggguuucaccauguuagccaggauggucuccaucuccugaccucgugaucaauccgccucggccucccaaagugcugggauuacaggcaugagccaccgugccuagcccuacaccuucuuuuuuaaaaggguugguggggugucaaaguuacaguagcaccaaacugagauuuuuucuuuuucuuuuuuuuuuuuuuuugagacagggucucacucugucacccaggcuggagugcaguggcacaaacauggcucacuacagccuuaaccuccugagaucaaaggauccucucaccucagccuccugaguagcugggaccacaggugcccaccaccaugcuuggcugauuuuuuaaaaauuuacguaggccaggcgcgguggcucacgccuguaaucccagcacuuugggaggcugaggcaggcggaucaccugaggcugggaguucgagaccagcugaccaacauggagaaauccugucucuacuaaaauuacagaaaauuagcuggguguggugucgcaugccuguaaucccagcuacucgggaggccgaggcaggagaaucacuugaacucgggaggcggagguugcagugagccgagaucacaacauugcacuccagccugggcaacaagagcgaaacuucaucucaaaaacaagaaaaaaaaauuguguaaagacaggcuggaccugaacuccugaacucaagugauccuccugccuuggccucccaaagugcugagauuacaggcgugagccaccgcaccuggcacuuuuugaugucuuaaagacuggaagaaaauggaaaaggaaauaauuuucuguuauuccaugccaugaccuuguuuugcccccaaucaucuccugugcugccagcuggauguguccuacacuucagggcacacuagccucaggaucaguucccaauccuuccucucuucccucucucugugcucuaaaucaugaaaaccuucuggccaauccugacagaugccacaugugcuguucuuuucaaccuagaauccccuucccccguaccaccuccugaaaaacuccuacucagccuucaguacucaaguuuucaagugccacacuuccucuggguuggcuuccuguucccccaucaguugaguuggcugcucacuuuccucacagcacucagccaugugguccuugggccaggaacgucuuuaaucuuauaccucucagugagacagcgccuaucacacaguaagcucuugagucaaacugucgaaagcccaggaggaaaagccauuuccuccaggaagccuucucuuuucucgaaaugagagguugcugccaggugccguggcucaucccugaaauaccagcacuuugggaggccaaagcaggaggauugcuugaggccaggaguucaagaccagcacugucuguauaagaauaaaauaaaauaaaauaaaauaaaauaacgggucuggccaggugcaguggcucacaccuguaaucccagcauuuugggaggcugagguaggcagaucacuugagcucagggguucgagaccagccuggccaacauggcgaaaccccaucucuacuaaaaauacaaaaauuagccaggcgugguggcaggcagcuguaauccuagcuacucgggaggcugaggcaggagaauugcuugaaccugggaggcggagguugcagugagccaagaucaugccacugcacuccaaccuggcgacagagcaagacuacaucucaaaaaaaaaaacaaaacaaaaaauuaacccugcauuguagcacaugccuguaaucccagcagcuacucaggaggcugagacacgagaaucacuugaaccugggaagcagagugagcugagaucacaccacuccacuccagccugggugagagagugagacuuugucucaaaaaaaaaaaaaaaaaaaagaugggucacacuacccacagcagcguuucccuaaucuccuagcacuucccuccuccaggacuguauuguaauuauacuguggccacuuucuggaaagaaaggaggaugaccacaaaaccuggcauuuaagacacuuagagcuaguugcuaauugacuggccaggaugggccccugggauggaggcaggagugcuggaugcccgcgucucuucuuacaggccuaaagaucccuccuggcugugagcugguggucggcggugagccccagugcugggcugaggggcacugucuacugguggacgacucuuuucuacacacaguggcucacaaugguaacggggugcccauucugcaggggggaugagggacucaggagcaaaggagcguugacuagaaggcagcagaaucaggcccaacggacuuccuguccuaccaccaccaucuuccagcugcaugaccuugaacaagccgcauaacuucuccaaugcccuaggaccaccaccuucuucaucaaguaacugcaaggauuaaaugagauaauauuacguacacagaaaagcgguuaccagcacaggacucuggguuccuguccuaccucuugcacuugggcaaaggacuuaaccuccuuaugccucuguugcuuuguauaaaauagggauaauuaugguaauaccacaguuuguuuugaugauuaagaguugauacauaucggccgggcaugguggcucacgccuguaaucccagcacuuugggaggcugaggugggcggaucaccugaggccaggaguucgagaccagccuggccaacauggugaaaccccgucucuauuaaacauacaaagaaauuacccagguguggugaugagcaccugaaaucccagcuacuagggagacugaggcaggagaauugcuugaaccugggaggccaagguugcagugagccgaaauugcgccacugcacuccagccuggugacagagcaagacuccaucucaggaaaaaaaaaaaaaaaaaaaaaaaagauuugauacauuuaaaggguuagaacaaggccugccacuuauuuacuguuugcuuuuaugguguuuggugagugcucuggugugcaaguaccuaaugucaguggcucugcuguuccugucccaugugcccuaggcucccccgaagaugggccucgaguggucuucaucguggaccucuggcaccccaacguggcaggggcugagcgccaggcccucgacuuugucuucgccccagacccuugaaggaaggugcucccuucacacacccaggcuggagagacacugcgcucagggacggcuugaugguagccaggaccuccucucuacugcgggggugggcgggggcggaggaugggaacuggcuagugagcacugaaauauaaauucugaauccucuccuaacucccgacuacuuccuucgcagggagaggcuggggcagggccuuaugucuucuccuaguacaaccaaacagguaccuccuuuuuuuucuuucuuuuuuuuuuuuuuuuguagagucagggucuugcuuuguugcccaggcuggucuugaacuccugggcucaagugauccuucugccucaaccuccugaguaguugggauuacacgugugagccaccacgcccggccagauaccuccuaacacaggcaucuccccgucccucuccccaggagccagcaccaguuucucaacuuaacuuuauuucaauaauuuaauagaaaauuaaaauaauaaauaauaugaaaca

SEQ ID NO: 15408 - RNA, 20508 nt, Homo sapiens
agggcaauucauucaauccagagccagaaacaggauuuuauuuaaaauuuauuguaaugggguccgcgcaaaaggaagggguggagggugggguacaugcaggggacacaggaacacgaugacauggccagggccacaacuucuucugucguggggaagagggaugaaaagacaagaccagggcuggagcugggguggaagaggggagggggacacuggcugcauucccccgcccccaggaagcaccucuaggcccuggaccccucgcucacccuggccccuaagacuccaucucuucucugccucuggcccuccuggcucuuccuccugcuccccuugacuuuuuccccugacagauucucaaguaggacgauguucagggccugaccccaaccccccauaccaccuuaugaagguacaaccuuugccggcccugcuucugccccuccucaaaccucaccgcuuucccucuuugggacagcucugaucccccuccuuccucuccucccucccccuggaaaaaaaaaaaaaaggaaaagaaagcaccaacuccccggggaggggcugcagacagcagggggagaggacuggaaggagagaagaggaccgucgagggaagaggcucacaagucccugggaagacagggcaugggcuuacagagaggagaggggguacgggcaguggcugcucguguccucugccaccccugcccacuguccaggggacuucaacacaaccgaggggacagguuuguguggggucaggucugacagaagaggagcaggagaaacaaaucguuaaaaccuagcgaauuccccuaagaaaacauuucuuccuccuuuccuucuggaggcuccuugguugguagggaaauaggaguuggugggaaaagaggggggagaggagcuuguaccaagggacucuacuccauucuccccucucccccgcaaccaacuuggagcucaccaggguugggagggaaguggcugagagcucacaggcacccccuccgcccccgagagggagcccacagcugugggaggggcugcuacugcugccgcugcugccgcugccgccgcugccgcugccgccgccauuggacaaaccucaccaguaccugcacaggagaaacaccacggaucacagcgcgaucugaauggcaagagccuugcccucaccccacaccuucccagccugcuuccccugggacacagccguugcucacuuccuaucuggaccccagaggccucagccugcauccucacccagacagagcaguucucaaggauccucccugugcccagaagucucccuagccugagugguacaugggcaucccucgccuuccugagauccccuauugggcccuuugagccccguugucccccacaccccccaucccgccccccagccaugccccacgccuugccuggugggugcgggggucccccucagcaggugggcuguggcuggggggcgucucccgggacagggggggcggccccccccagaugggucugcauguggccggccagcugggcaggggucuugcagugcacgcugcacagcuugcacaggaugcggucagcccgcggggccuggagcccgugguccuucaccgcguggaugcgcagguaugcugccguggugaagccuauugggggguggauugggauggggcgggggucagccaggcggagaccccagagacggggcugaucuccuaggcgggggaugcccuccucagauggcccuguccuccucccacgguauccuugguagccuggggccaacugcucuguuggggcugguagacacagccccucccugagccuggggccuggcuuguguggugcccgcuucucagccuugguaccuacagaacucauucuccauggccgggagaccucucccaggaugacgagacacugacuccuagccacuugcaggguugacccucagcagagacggcuguguccccuucccuccagugccccgcggucucaacccaguuaaccggugagucugacugaaggcagcuuucucugcuacccgugcagggugcgugcugguaaagcccggcccguguacuccaccugccccaggagcuggagacaagaccuuguggcugcgcagcggaaaccuugccuugugaccccuggaacuggcuuucuugacuacuccuuccccagagcagccaaguuccacucccgcuuuccccacacauuaccaggagguucaaccucucuggcagaucaucucuuccaaccaggacuucuuagagucuaaugauguucauucagguguccccccgcugcucccuugaccucuuguaggaaucuagacgccacgagcucuuggcuacagcacccuuaacccguauccguggcaaggcgucuggccaggcgcccacccucugccccuggcccucccggcagcccucggcauguaccuuuguugcagagcucacagacauggugaggacccuggcugugcaccuucaugugguccgaaauauaagccgagcucagcaucuugccacacacgugacauggcacuuucuccucgugucguacugugugcgcccgcagccgauccuucguggcgaaagcugccucacauuucugaggaggggggaggggcguggggggugucacaggagaguuaaagcuuggugggcuggggaggggggagcaagagauuaaaggaaucagagccuuggggaucuuugaucuguaggaaaugggagugacaugaugaggccuugaagaagggaugagaaaauggagcaaaaaggcaaaaagaagagagagaaaaagggggucugagagacugacucagacagcuaccaugaggaucaaaaucaugaaaaccaagacaggaggaggcgggcuuccuaccucacauuugaagggccguucuguugagugcacuugucugacgugacuguugaggugauccggccuggggacacguugggguugggguuagggcggagguggugcgccccaaauccaccaaaccgcaccacaggccuuuccgaggaucccugcgccuccucccggagcccaggccgucacagcgacacuuaagcaggaaaucccuccccuggagcccagcagccgcugccgccgccgccgccuccucccacgcgaagcuuccgucaaccccaaggcccaccuccucgacaaaggaccaccccuugcucccugguaaccgggagaggcuuccucccuccgcccugggaguggcuccccuuccccagccucagcagccgccucccuccccgccagccacggccaggccaccuccgucgcgucccucccuccccacggccuagcgggcggccgaggccccgugcacaccgggagaagcucuugccacagugggagcaguuguagggcuugugcacagcgccgucaugugagcgcacgugguagcucaugcgguccuugcgcuugaagcgcugcuggcacaccgggcacugguagggcuucucguccgagugcgacagcuugugucgguucaggugguagacgucgcggaaggccuugccacacaucucgcaggcaugguucuuccggaugcgcuuccccgaggcggucguggucaccacgccaccggcggccacugcggcagcgccgccgccggcacccgccucucccccucccccgccggcuccgcucagcuggggcacgcucaggaggcucaggggcaccauggucggcaucuucauagcacccgaggggacccggccggccuuggcucccguguggauggcuucgugccuccggagauuguagccguucuugaacuccuuggcgcacagagcgcagauguagggccccuugcucuuugucuucuucuccaaggcagacgcgaccggggccacggcgaccgucgagguuggggcuacgacggcgguggccgccgccgcggcgauaguggcggcggaggcggggggcgcggccucggccgcgggcgccgacacuggcggggguggcggagggggcgccggaggcugcuucagggccgcuguguccaccguagaggcggcggcaggggccgggggcgcggcagcgacggcggcagcagcggcggcagcggccgcagcagccgcggcggacuccugggcggcggcgagcaccgggagcaaguccaccuggaggggcucggccgccggggccuggggcgugggcgggggcgccggcgcggccugcggagacaaggcgccgagugggccgcgggugcgggcgggcguccccccccagcccgggccgccgcggccggcccuacucaccuggaauggacucugggcgcagcccugggaggcaaagaagcgggacuggagcucagccccgaccugcaggggguucugggcgugacccugagguggcgggaaggaguucaugaggccgcccaccccccgggaguccaggcccagcacggggaaggggggggccagcagcgugcaaggaaacaccgggaacauggccucggccgcagcggggcccccggggcucagcgggggccgggggcgcgggccgcgcggggcccgggcucggggcgccgcccccggccggccgggcugggccgcgccgaacgcauggcccgcgggccgccccgccgcccgcgcaccccggccggcgggagggaggaaaagagggcgccuugcgggccgcggagcgccgcggcgacggcggcggcgacgcccccugggugggggcgggaggccccgcggggccggggccgggggcgggggcccgggcggcggcggcggcggcggcggcgguuggagccuggcggggcgggguggggggagcgagggagcagccucggcccccgccgcgcgcgcgcccagccggcgccucggggagggcgggggagggcgcgagggagggagggggacagcugcgcgcgcaccgggcgcgcggagggggggugggacgggagggagggcgggcaggagggggugugggcaggggggugggggcggggggagggaguuguuaccuggaagaugaagcugcuccaguugcugggauccauggcggagggagggagggagguggcucgcgcucacccuggggcgggaggaggaggcggcggcggugggggagggggaacccgggaggaggcgcgcggggcgggcaggaggggggagguggagggugggggaagcggagcacacuacgcgcggggagggcgggcggggggcgcgaggacacacaagaggcuggagcgggcgcgagcgcuagcgcgagcgcgcgcguggccagcgggaggggcaggcgcgagagggacucuggcgggaggagggacgggggagccacccagcagcccgagucgccccgagcgcgagaccccugagacggcugcugauuggcugacgauggcgcagguggugggcgcgcgggagacagggcggcuucucuccucuuccccccgccaacgauuccacucccccucccuccgccagcggccguuauuucgcgcgcacgcgcacaaggccgccgucguugccgagcgggagaaugggggagcgcgcgcgccgggggcacggacggggcggggcuaaucccugagcgcgcgcccgccuaacggucgcaggccucaugcuucggcuuccgcuuuuugcguccugcaggccaccguccuccccgccccaccccagcgguguauuuacaauccugcgcugagucguuccccgaagauggcgcccaguggagucgccugccuugcucgcggcccaccccgaggcggucacaccccggucccgcccccgcagccccaaaaaucaggcggaagcaccggagcaaaaacuguauuuacacaacacgggguuauacaaaaauuugaaaaggcggagugaggagacgacggucaggaggcgccacagcgcuggccggcggcgagacccaggauguuugccugcaacacaggagggagggagacagcgacguuagagaggggcgcggggcgcaggacaggcagaggaggggcagggccgugacuucaccuucaggaaggacuccaucuguuuccccguuaugcccuccacgcguuccagguccuccaccuggcgggacaggaucgauaggggacagggucucggggguacccggucucccccgcccccgcccucccccaguccagugggcugcuaccuggcugaaggggccguggagcucccgccagcccacgauuagcugggccuucuucgggccaaugcgcugaagacugcggagaucucgggcugagccuucguucagcagauccaguauuuuuuggcgcccaugagccaguagcuccgggcugaucuguagcucccagcaguccucagccuucuccucaggcucuagggcauccagggacuccagcugggaggcaaagggagaugagugacacgcagggcagccaagugcuuugggcuccucugccaagacuaggagcccagcaccagcuaccuccugcgcuccagccucuuccucucuugucaaguguguccaaaaucccgcccucaggucacucucuggguuaauucuuauuaugcaacuagugaaagagagguacuacucaguacccagugguaauauuagcacccuucucauggaguugcuguggagaucaagugaguuaaugaauguaaagcacaaaauaagcucuuaaaucuggucccucaucucuaaaagggaaagaauaagcugucuuucaaaaaguacaugggagaaaguaauaugaauaaaugauaccucccccaaccaucucaguuuuuggguaguucuagugguguucgauucuggguaugugcauaugugugguuucuugcuugacugcuuaggucauaguucccuaaguuuucccucuuaagcuuguagaggguagaagccaggcuacacaguggaacauccgcucugcgagguacauccacaucacugccuuccacccuaaaugcccugcaaggaaccauccaucaccacauuccagggguaagcaaguugaggucuguuaguagcuggcggccaucauccaguucguuuaaccccaaggccaacgcuccucccccuagagccuacucccccuuacuucugggcuccagguguagccuaagcccccagcuacuuucaccuuucucuuccggccuuuauucuucaggauguggaucucggcauuuggggaugcugccugcuccugaacugaaaguaggaaucgagaauuggagucagggcaaaggguacuuuucacccucccugguagcccuucgauucuuccauuucugauuccccagcuccccuccauccagaguuaaccuguuguguuuccacaugaccuuuuuuauacccgcauuuaaaggaauuucagucagucuugcauuaucuucaauccucuacucguuuguccaucccacuguccuaaacacccgagggcagagcacccccagcacugccucagagccuccucaccccucccugggacugguauguggugggagaauaugaaugacauggagacagcugcuccuaacacuuccucccuuauaggaucucagcugccuuggccccccagccccuggagucaaacuuacuuagcuguaggggcaucaccacagccuuuuucaggggcuuugccccugugacugugcgaugugaaaggggccggagcauugugggacaaugguucuccuuuuccucagccuucugggccaacaucuuggccuccaguucuuuuugcuucgucuuaagccucuguuggaaaggaucagggagaugugauccagacccaacuccagggcagccugaagggaguggguuaccagggugaguaugcaaggcucugagcccccagagggcagggcuaggaccagugggagguuaccaggagacagguggagccuaacauaauuaagggcuuucugugauuagggggcuacccagagguggaacaagccucugcaaauauugaagggaaaggcuuuucaagcacaguccucaauuaauugagcugggcuuuaggaaauguaauguuuaacauuuguugcuuuuacuuugaacuuuuucuucucacccucacaucuggucucaauugucugucaaaguucagccauguuaaggacauucaagcagaagcuggagaacuuccgguauugggagaaaacuggacucuaguccagccugaguguccuucccugucugaagauccaaggauugcuucucaaggccaauaggaauccagcucccacaucccuaaaacacguaccucaaucucuagguccuucucuuccacugucuucauuagcaccauccgcucucgcuuugggguacucaacagaggggcccccuggcuccccugggaggcaagcagacgguccaagcugaggaggcgcuccagcauggccggguccaugcugcuuagcuucuguagggggcugagcagaaaaagaaguugcuccccaccuaccuccucccucaucaccaccuacagcagcaggacuccccucaccacaccuuaacuugguauauccuguagcuccagaaccuaauguuaacuugcuaggcauccaguuucucugggugcagugucuucaucaggugaagugacugcucggggaugccaggaaaucaggcgaacacuugagugccagguaugagagaccuaagacacugcccugcccuggaggcacugucuacugaggaaaucaagagaccauaauaaggugacagccaggacagugccuauccauuuggaggagcaguugcggaaaacaucacagaggaugccaucuuuagcagggcuuugaaauccaccgaagaccucagcugccaagcuucccugcugugggcagcugggaaggccuguucaagcaguccugacugacucugagcacgguaaggcuuaacauucuuuuuuuuuuuuuuuuuuuuuuuuugagacagggucuugcucugucacccaggcuggagugcaguguugagaucacagcucacuauagccuuggccuccugaggcuuaagcaaucccccugucucagccuccugaguagcuggguccacaggugcaugccaccaugcccagcuaauuuuuuuauuuuuuguagagauggggucuuacuauguugcccaggcuggucuugaacuccugggcucaagugauccacccaccuuggccucccaaagugcugggauuacaggugugagccacugcgcccagucagcaacgucuaacauucauuuauuuugccuggaaucuugccccacaccuccucacaucuguaucaauaaucuuuccaggucaguuugaugccaccuuucccaugacgccaagcuuaacaaugcaucucccuuccuaugcugugaacuggcuccuggaggacagggacacuccugugcuuuccaugcuagugccuuggaaaaacaggaucagaacauacgugggcaaacacuagaagucaucucuuccuuccugacucucacagcagcagcagcuacuccuuccugauucugaauucuccaccugguaucauauacugauguucccaucugacuugcucuccugugaggcccccaagcucugggucugcuggguuugaugugcccaacucugagcuuccccuuacucagagugccugucugacagcuuaccugugcacauuucugggugcacacagcaguggggagugcugacagaugguuugggaaagacaagacugagagauggggucaugagugcacaagcaucuucuuguguguggcaucuuccuuaacuacaguagcccccugggacagagugggcacuaacccuuggccaccucaggucaccucuguuuaguaguucacaggcuuuauuugggcuagggguagaaacagggcaaaguuaaaacugcaacuggcuccugggggguggagggaauagcgcaagggcuaaguggccagacacagaaagcaagaccccugaacagagaugaccugaggauuaguacauacugggccaugagguggggugauuggaguuggggcaggaggugacacaaaggacuuaguuuagaggcuuuaucuggauugaggguagacgcaguuaggacagcagcuggcuccccggagagucauggagaagcugggcacugacacacagaccagauggucucagcaggacagcucuuccaagucuccuuugcuuugcucucauggaucugaaagaucugauccagaucacuccuugaaccagaagcaaaaaugcucauccuugaaacagcugucccaaagugagaaguuuugcugaaggcuaaagggguuggaaaauggaaaggauccccaggaggaggccuccuuagguccccaaggcagcagcacugaggagagauuaaucuuagacuuuagugauucaauggaguagaauuuggggggaauuuauuuauuuacuuauuuauuuauugagaugcagucuugcucugucaccuaggcuggagugcaguggcaugaucuuggcucacugcaacuuucaccucccagauucaagcaauucuuccugccucagccuccugaguagcugggauuacaggugcccacuaccaugccuggcuaauuuuuguauuuuuaguagagaugggguuucaccauguuggccaggcuggucuugaacuccugaccucaggugauccacccgucuuggccucccaaagugcugggauuacaggcgugagccaccgugccuagccaggguugaauucacuuauuuacuuugagacggagucuugcugugucgcccaggcuggagugcaauggccacaaucucagcucacugcaaccucugcuuccuggguucaagggauucuccugccucagccucccaaguagcugggauuacaggcacaugccaccacauccggcuacuuuuuguauuuuuuaguagagaugagguuucaccauguuggccaggcuggucucgaacuccugaccucaggugauccacccaaccucagucucccaaagugcugggguuacaggagugagccaccgcauccggccuagggugaauuuaaugggagaggaacaagaucacagcucucugcucaaggaucugacgggcauugcagcucugcugcuaagccauacaucaggaaggggauacacccaaggccccacugcucaccugaguuucugggaggcagaggcuggagcugccaugggcucagggcucccgaucuccucuuccucagggccucgggcucucuuugccucugguggaccaagcaauucuuucugagacagcuuaacaggucccaaggcuagaugauuggaggaugggguggagagagggauuggggguggucagccucugugcugaugcuuggugguuucaacaaacucccuaauuuccagacccagcguuuccacuccugccucccccaguucucaccaugaggcugcaggcucucauugguaaaaggccgauugaucaccuccuuggaccuggcagcaaaguugagugcggagacugugucuagguagaagcgucucucaggggcaauguuggcaauaaggauacugugggcugagccacccagagaguccugagggugagaccaggcagugggugggucagaagcccagccuuccuaugccucaacugcuauuccccaccccacagcaggccugagaaccuccuucugcagccccuucuucccugagacaggugggccugaccugcaauaggcgagugagcuugcugucccgauaagguacacgagggaggcccugauucagcgcaucuaccacuuugcccaggacaaacagggagguguugauggcuccacucucuuuuagccgaaggcccuuguugccugugcgccgguuguccucugacccagccaagucaaucagguagaguuuucccucucgcuggcgaaauggggccaaacguucccgcugguccaccuggggguaagaacaaaggucucgugcuuagcucaggcuccugggcuucccagguccucgccccugucugcggccucaccuugaccaggagcacagcaugacugcgggaggagcgcugguugagccggguggcuccuacaguccgauuucgacuggcuggcaggaagugccgcucaaaaucagcaaagcuacugaugggcuucugggagagacccggaaucaggauauucccccggcagucuucucggauuaccaggucucccgaagcaggguccaggaggucuaauaccuguguaagcagugaaggggaagggcaauucuccauagagaggcuguuucuuccuggggaucaguuuccuuucucuguucuauucucggaguuguaccaucugcuaccccagucucugucuuucuaggucucaccuuaccucccugcuacagcagagcuucauguucuagaaccaggucuuacuuugacccuuuguugcuccucucccaaccagcacggggccucaccuucuccugguagaucucuagguaagacauggugacagaaagggcccauggccggcccucggcacccuccucccuugugagcugcaggagguccaugagagcccgcgggaucaccccagguugcucugggcugcccagcauugugugcgucuucccugggaagagaguggagaaaacugugagguuuuccucuccguuuccccagcccuuucugacccauagcuguuucuuuucuggcucccucaccagcuccuguggguccauaggcaagcacacuggcauucugcccuuccagcaagugccuuaggaugggcugcacugaaccugcauagauguccugcugaguacuccucuccccauagaaggcaucaaaccugcaggaagaaagaaagaaauuagcguguguguguguguguguguguguguguguguguaagggguggagugggguggggguggguaagggauucuacucucaucuggaccuuggauuuaagagaacgucucuauccccuuucuuguacaaagaccuuaaaaagcauccaccuaacaccuacuccauccucaucucucuauugguguuaggaauacagagauagaucugauaucccugcucuuggaguuuuucagucugguaggauagauauccacacuuugcugugauuuaggaaacgaagauaagaacacacucucaaaggaguaacugauucugcucaaggaaggaagauuuugaccaaagaaagaaauucugagaaucaagaauagcaaaaaagcaaggcuucccagucuuuuucaaauggcuacauguguagaacauuguauuuuacaccauaauggggaaaauagaggaugcugcuuaugacugaacuagacucuacauaccaaucaccuauccacugcguucugguggagaagugcagcuuaggccacagcagggaguuuaauauauauugagggaaugaggcuggaaagaaacugaagcccaaauuguuaacggccuaguaugggagcuagcaaacuucuguaaaaaggcagauuguacauauuuuaggcuuugugggccauguguuccuuuuacaacuacucaacucugccacuguagucagaaagcagcuauagacaauauguaaauaaacgauaaaauuuuauuuacugaaaaucuuacuccugaucagauuugaccugcaggccaugguuugccagcccccgccuagaaaaacaggccaaggaguuugaacuuuaaauccccaguaggauuauaaaguagcugcccuucugaguucuguccccaaaucuggguggucuucucugacacuacccagcugcagcuuggguaggcuggcuggcaggucuguguuccgccaacccuccugauaugucccccagccucuacuuggggcucaccugcucacccucauugcuccucccucucugugcacaguaauguauguuugauucaaccucucaucucucccuacaguaucccagagagggcccaucaugggggcaccugucaacauuuccuaagugaacagugaaggcucagggaacaaagcggugcuaaggagggagcaaggauccuggggaggcaggggaacgugggcaggccuaggagagggaggugauggcaugagggaagaggaguggccugaaccuuacugguauuugagagucuccuggugguuccuccaguuagcaaucucuagagagcagcuguccaugccccgcacacaggggggaucacuugcucccgcuguuccauccacaaauggccgcagucgcacagccacccuuacgcgagcuggagguggacgacgaguagcuccaaucuugcuuagccgacagcgaccagcuccuggaggagagaagaucacuuuuagacaugaaguauggugguagcagaagaagcagggaccaacuuugcugggcgggcugggggccacagcucauguuggagaagcucauucugcccuggucauguuguggacaccccuaagcuuggccucagugccuucccugcucuacaagcaagugcagcagguguauagcaggcuucucagacuguaauguauacacaaauaaccuggaggaucuugugaaaauguggauuuggucuccgucucccuggggugaugcccgagauuuugcauuucuaacaagcucccaggugaugcugggcacuuaaaaaaaaaaaagagagagagagggauggagucucacuagguuacccaggcuugucuucaacuccugggcuccagcgauccuccuaccucagccucccaaagugcuggaauuauaggcaggagccaccaugccuggcccaggacauguuuugaauugccaagggugaaguagaccagcaccucacaggguuguucuaaggauuaaaaggguugacaucugaccgaaaccuaaaccagagagcgaacugccagaauuuucuguguguguguguguguguguuuuuuuuuuuuuuuuugagacagucuugcucugucacccaggcuggagugcaguggcaugaucucagcucacugcaaccuccaccucccagguucaagcgauccucccaccucagccucucgaguagcugggauuacagguccccaacaccacuccuggcuaguuuuuguaucuucaguagaaacaggguuucaccauguuggccaggcuggucucaaauuccugaccucaagugaucugccugccuuggccucccaaagugcuaggauuauaggugugagccacccugcccagccuguaccuccauuucuuaacugggguuucuaauauguauugagacguauguauacucacagacccacccaccccugcaaacuguuaaugaugaucuucucuugauggggaauuauguggguucugcaaaaaccaccgacaugcaauucuucucucauguaaacuuaacccugaauuugcuucagaugauuaaguuuuuuuuguuuuguuuuguuuuagaauuggcaacugaauuauuuuuaucaucagaaaacacaaugaagauaaaacuuaaaaaaagaaaagcccucuauuuuuguggggguuaaaugagcugaaaauaucuaaggagaguauuacucuauuuuacguuggaggauaacauacuguagcucauaguggaauucaaaccuagaucucuuccccucuaaaaaucugcuuuuaauaggaugcuguauugcuuccuuauuauguaccaacugggaaagcuccuggcagcucuuucccuuccuugcuggugguagcagcugguugcuaggagccauaggccucgcagaaggcaaaaggcuggcugguauacguagccaacacagaaacagcaagacgaaaaggcagacagaugaccccuacaaagaaucuuacaccuaaguaaggcaugcccauaagcagacgggcuguuucaaaaacugaaccuccauuccaucaucugauaaauggggcuacuaauaccauuucucacguuaugguagcaaagcgcuuggacaucuaguucucauuuguuccucauggcaauccugaaagucaggagcaagcagguaaaaaccugcagaugcaugugugcagauagaaaacugaggugcacugacuugucaaaaauaugugcaggaccuuccucugccugcuuucacaggauguuuugggagaacagaaagauggcagauguagaagcacuuaaggaagcgcagugaucaaucuaaggggaaggggaagucaguaaugagguagaguguagacucuggucagacagaaguggacuucaauuccagcucugacauuuauuagcuugugaccuuggaccuugguuuccuugucuguaaaauaagguugggggugggccuugggcuuuuugagaauuuggccgggcgcagugguucaugccuguaaucccagcgcuuugggaggccaaggugggcagaucaccugaggucaggaguucgagaccagcgugguggugaaacccugccucuacuaaaaauacaaaaauuagucagguauggugguggacgccuguaaucccagcuacuugggaggcugaggcacaagaauugcuugaaugcgggaaguggagguugcagugagcagagauugcgccacugcacuccagccugggugacagagcaagacugugucucagaaaaaaaaaagauaauugaaauaagugccagauaaaguggcagcacagugacuagcacauaguagguagguucaucauucaagguaaaauggccuggguugaaaucccagcucugccauuuacagcuagcuaaguaaccuagggaaauuauuuuccaucccagugccucaauuuccuuaccugcaaaaugggaauaaaaauaccucuuuguuagguuguuaggagaguaauuaaggugauucauguaaaagugcuuagaacauuaucugguauuuggugaaaggccaguaagugcuuuuuaauguccgucucccauuuuccagaugaggaaaccucaguauagagggguuagcugacugacccagggucaacagcuagugacugacagcuucaaaugaagaucuaacuccaaagugcuuuauaugaacccuccucagccuccuuagccccuucaucuuugcaucucauaagaaugugaggauucaaaguaauaauguacauacaauguuuagcacagugccuggcagcaacugcucaguccuuagcuguuauuauuacacccuuucucuugcuacccacuccuccaucccugcaacuugcuucugcccucacuauucagcagggucacccaugacuucccuagugcuagauccaguaggcauacucagccucaauccuguuggaccucccagaaguaugcgacacucuugggaaacacacuuuucccuucauuuccaugccccccaccuuccugguugucuuaccuaguuuucuguucacuccucauccuaggauccgucuauccuuucucuagaccagcauuucucaacuucagcacuacugacauuucgggcuggcuaauuccguuguggggcuguccugugcauuuagacuguuagcauaugcuuacuagaugccaguagcauucuccacccucacccucaaguuguaacaacuaaaaaucucuccagacaucuccaaauguccugugagggacaaaguugccccgagcugagaccacucagauucauuucauaggcaggucacccgcccucuuggcuucaguaacaucuuacagcugauaaguccuauugcacguucugcacaagagcucucaacugcagcccacguucugaacggcugcccugacggcuccuuuuuuuugagacagaaucucacugucgccaggcuggagugcaguggcgcucuuggcucacugcaaucuccgccucccgguucaagcgauucuccugccucagccucccgaauagcugggacuacaggugcacgccaccacgcccagcuaauuuuugauuaauuuuagagacaggguuucaccauguuggccaagauggucucgaucucuugaccucgugauccacccaccuuggucucccaaaaugcugggauuacaggcgugagcccagccgacggcuccucuuaaacuccaccuguccuaaacugaacccuccuuccccaucucucugcagccuccuccuuugaucucugauguaaaugaauggcaccaaccccaaaagugggagucuuuaacuccaacgucucuuaccucccacaucaguucaucauuaacaucugucaagucuaucucuuuaaaucucucuugaacaaguccacuucucuccacucccacugcacuaccucugcccaaggucauggucuuuacagccuuccuugcuggugguagcaaggugucucccugcccucuagucauucccucuguuuccuuccuugcaguguaaguuaccagucaugaugaauuuccuucacuuccuacaaaacuccaaguucucuugcaccuuuggauuuuuguccacguuaaucucucucccuagaauaucugcauugcuccccaccccacccuggagugacuaagguaaacacauuuuaacuccucuuaaaaaacaaaaccaaaaacccuuuccugguagacacuaaggcuuuaucaggugcaaccacagcucauguuagccccuccauaagcauuugucacaccccacuauugcguguuugucacuuucuccaccugacugccaacugugagaacaaguuuuauccugcucaccuuucuaaccccaacaccuggcgcagaguaggcccucaagaaguauuugcugaaaaaaauuaagauuuagugaauaaacuacuaaucacuggcuuguucauuuccaucaugaaaauggcucacggccauuccugccccagggcucacaguccaggguaggagggaagaggggagggccacauguaaacaauuauuuacugcacaagagucuagcccuuucaugauaaaagcaaccuugagcuuggaccaggcuagcaauuauuaauuuucccuucuuucacaauuccuaaauuucauucacucuucucccuuuuauugaugaggaaauugagcuaagagagcaucuuacaucauaaauaagaaaacacuugcuguucuugucuucuuagucaaggccuggcaaacuccuauccaaccuuugaaacccaucucaaguaucauucacucccuuaaugaaguccucccagaauacucaagggcuuacuucagauuccacacccucaguuuauacacaucucucauuguguuucguauuacaucuacguaugugacacucuauugaaacagacuguaaauuccucgaggaagggacauuauucauucaggcauuuucauaucuaccaugcaccggacacagugcaucuucgaaggguaaggggagacugugcucagccagcagggauaacauguacuugggcauaaugguuaagagcagagguucuacacucagacuccuugagagcgaauucaagccccaauauuuacuaguuguguuaacucugaacaaacuaaccucaguuuccuguguaaaacaaagacaguaauaguaacaaccugauagcauuguguggacaauaaaugguucaccaccauaaaaugccuacaacugugccuggcacauagcaagagcucuacauguguuaggcauucuccuaaaugucuguuuccccacgaggcuaacgagggcuccagugaauuacuauggcgcucaccaucaucacuaacgaggauuaagucuccggguuagagaggcacauguaaacaaauacucacauacaagauuuuggguguccuaacagccuuuccaacccuaaaauagcauucacuuccaugcuagagugaaaggaaauuuuagucuuuuauuucguuuuccuguaaucgcagagcaucuuacgcugccaacucaaacccagcagcagccgggucuguuccucagcccguccucuugcaucucucagggaugucucugcacccaaacaccaugucccacacagaacccuucccaauacacgccuccggcucccuucuucucguccucguggcuagagcguccgccacucuucucuugcuuauucaggugaucuccagggaugaggccaugacccccguuucacagacgaagaaaccgaagcucacaaagaaaaagugcgcgggguucaagccaagagccuggaccggagacccgagucuacugacccaaggggagagcaggaaacagggagaaggcaggagccaggcggggcgaccggcucgcgaccccacacucucaccgucccccucuccccgccccugcgccauggccgccucuccgcgacaacccgcagagccuggaccacacuccgacacauaacucccacuaaacuccagacgucgguacccgccuugcccaggccgggcucaaguaccugagaucgccgccgcugaagcugccgccaucucgcgucgccucugcugcgucgagccgcccgcggccauuccacucccuccuugggcccgccucucccauucgaauuccccggugccccgcccccucucccagguuccacca

SEQ ID NO: 15409 - RNA, 3538 nt, Homo sapiens
cuuccgccuucauccgaggccgggccucuacgucugagaggcggaccgcccugcacccuccaagccugcaccucuuaguccagcaccaggaagaguggcucuaggagggagaggagcccagggacugacccaaggugaguugaggggugcaggaggcccccugcagauggaggaugugggggacagagaggugugcagagacaaacgagagauagagacaggccagagccugggcaaagcuggggagcccaggaggggugcagaggcgccuccggaggccuggcccggcccggcccggcagcagauuccguggagccuaugagagcaagaucaaguccgaggagaauggugaggggcgaaggagccucaaggggccagcggaggugcuggcggcaggcggugggggagacacacgcaggggagccagugggaggggagguucucauuucuucacccaccacuuccucucuaggucugagcaagacuugagggggccgaguggggaggaaagaagcccuugagaccuuucuugucugaggcacccuggggucugggagggaaauggggauucuggaaaggccuggagagccaggcaggagggccuggcugugccccgagguaggcugccuguccucccaccccaccuggcucacgcuuacccuuucuggucccucuugcuucucugucucuccagaauguucuuuuucauuuuugagaaagggucuugcucuauugcccaggcuggaggacaguggugcaaucuggggucacugcagcuucaaacuccugggcucaaguaauccucccaccucagcuuccuguguagcugggacuacaggugugagccaccacacccagcuaguuuuuaaauuauuuuuagagaugagguuucacuguguguccaggcuggucuugaacuccugggcucaagugauccucccgccucgaccucucaaagugcugggauuccaggcaugagcccccaugcccagcccuucucccaggcuuuccuggacaccugcugccucucucucaucuugguugugcccccucugccucauuuacuuccucuucucaccccugugucucucagaugccguugacuccagagccgcccucugggcgcguggaggggccccccgcaugggaagcagccccauggcccucacugcccugugggcccugcauccccaucaugcugguccuggccacccuggcugcgcucuucauccucaccaccgcuguguuggcugaacgccuguuccgccgugcucuccgcccagaccccagccaccgugcacccacccugguguggcgcccaggaggagagcuguggauugagcccaugggcaccgcccgagagcgcucugaggacugguauggcucugcggucccccugcugacagaucgggccccugagccucccacccaggugggcacuuuggaggcccgagcaacagccccaccugcccccucagccccaaauucugcucccagcaacuugggcccccagaccguacuggaggucccagcccggagcaccuucugggggccccagcccugggaggggaggccccccgccacaggccuggugagcugggcugaacccgagcagaggccagaggccagcguccaguuugggagcccccaggccaggaggcagcggccagggagcccggauccugaguggggccuccagccacgggucaccuuggagcagaucucagcuuucuggaagcgugaaggccggaccagugugggguucugaauccccaggguuccccagagauccccgaggcaggccuugccucagugggaccggggaccccaggauccagcauuaggauugagacugccccagcgaagaugcccuucccaggcuccuuccaccuggagucccccuccccgggucugggugguggccaggcuauguggacuaggggaagcccagcagugccucugcucagcuaccugggcuguggcucagagaccuggggguggagccaaugccaggccagaagccuucaagaucgcauccagaugaagaacccaagguacuagauagucaggaaauggcaucgaccagccaccuccaccuucuuucaguguuuaccgaagccaccaauaccaaagagaacggguccugcggugcugaacagccucgguguggcgaugacagcuggcaggagaugacaggaauccaguuucccagagccacaaauccuguucuccuuggccacucacccacugugagguccucuaggaaaauacacaaagagaggaccagaccaggcagaggaacauuuuguuucauaugaacuguggcuuugacccccaaacugcaaggaggaacuugcugggccaagcugcagcggcgcugucuugcuggaguggggaccuagagucagagaaaacccacaggcuccucugcccauucuccuccaucugcacacgucucagccucggacccucaccacuccauggugaggaaggccauggccaggggaaacugaguuucauccaauguggagaggagcguuguccuagagcagggcaacucccaaacugugaccucugaucaucgucccuuccagcuugcuggaguguccagagagacagauuugccacaagcuaggcuuacuuauaaugcuccacccuacagaaaugggaccccaaguacccaaucuucccuuuaggagaggcaggcaggugggugagcagcagauguaguuuccauuucccuggggguuuaauuuuccaaacuuugucuuuuuuuuuuuuuuuuuuuuuuuuuugagacagaaucucaacucugucacccagacuggagugcaguggcacaaucucaacucacuacagccucgaacuccuaggcucaagcgauccucccaccucaaccucuagaauagcugggacugcaggugcauaccaccacgcccagcuaauuuuuguauuuuuuuuguagagacacggucucaccauacugccugggcagguuuccaacuccugggcucaagugauccagcagccuuagccucccaaaaugcugggauuacagguaugagcacugcacccggccacuuuuuuuuguuuuugaaacagggucucacucuguugcccaggcuggacuacaguggcacaaucucagcucacugcggccuugaacuccugggcuuaagugauccucccaccucagucucccuaguagguggaacuacaggcauguaccaccacaccuggcuauuuuuuuuuuuuagagacagggucuugcuauguugcccaggcuggucuuuaauuccugggcucgagagagccacucauccccaucucucagaguguugggauuacagccaugagccaccaugcccggccaaacuucagccuugaauauuagugauuuugccauauuaguuuaccaucuguacaauuauuugcuuuauauuuuucuuuaaauuggcucauuauucacuuaaugaaauuauugcaacaggaaucuuuuguaucacuucuguaaauggaaaaccagucucauuugcca

SEQ ID NO: 15410 - RNA, 3538 nt, Homo sapiens
uggcaaaugagacugguuuuccauuuacagaagugauacaaaagauuccuguugcaauaauuucauuaagugaauaaugagccaauuuaaagaaaaauauaaagcaaauaauuguacagaugguaaacuaauauggcaaaaucacuaauauucaaggcugaaguuuggccgggcaugguggcucauggcuguaaucccaacacucugagagauggggaugaguggcucucucgagcccaggaauuaaagaccagccugggcaacauagcaagacccugucucuaaaaaaaaaaaauagccagguguggugguacaugccuguaguuccaccuacuagggagacugaggugggaggaucacuuaagcccaggaguucaaggccgcagugagcugagauugugccacuguaguccagccugggcaacagagugagacccuguuucaaaaacaaaaaaaaguggccgggugcagugcucauaccuguaaucccagcauuuugggaggcuaaggcugcuggaucacuugagcccaggaguuggaaaccugcccaggcaguauggugagaccgugucucuacaaaaaaaauacaaaaauuagcugggcguggugguaugcaccugcagucccagcuauucuagagguugaggugggaggaucgcuugagccuaggaguucgaggcuguagugaguugagauugugccacugcacuccagucugggugacagaguugagauucugucucaaaaaaaaaaaaaaaaaaaaaaaaaagacaaaguuuggaaaauuaaacccccagggaaauggaaacuacaucugcugcucacccaccugccugccucuccuaaagggaagauuggguacuuggggucccauuucuguaggguggagcauuauaaguaagccuagcuuguggcaaaucugucucucuggacacuccagcaagcuggaagggacgaugaucagaggucacaguuugggaguugcccugcucuaggacaacgcuccucuccacauuggaugaaacucaguuuccccuggccauggccuuccucaccauggaguggugaggguccgaggcugagacgugugcagauggaggagaaugggcagaggagccuguggguuuucucugacucuagguccccacuccagcaagacagcgccgcugcagcuuggcccagcaaguuccuccuugcaguuugggggucaaagccacaguucauaugaaacaaaauguuccucugccuggucugguccucucuuuguguauuuuccuagaggaccucacagugggugaguggccaaggagaacaggauuuguggcucugggaaacuggauuccugucaucuccugccagcugucaucgccacaccgaggcuguucagcaccgcaggacccguucucuuugguauugguggcuucgguaaacacugaaagaagguggagguggcuggucgaugccauuuccugacuaucuaguaccuuggguucuucaucuggaugcgaucuugaaggcuucuggccuggcauuggcuccacccccaggucucugagccacagcccagguagcugagcagaggcacugcugggcuuccccuaguccacauagccuggccaccacccagacccggggagggggacuccagguggaaggagccugggaagggcaucuucgcuggggcagucucaauccuaaugcuggauccugggguccccggucccacugaggcaaggccugccucggggaucucuggggaacccuggggauucagaaccccacacugguccggccuucacgcuuccagaaagcugagaucugcuccaaggugacccguggcuggaggccccacucaggauccgggcucccuggccgcugccuccuggccugggggcucccaaacuggacgcuggccucuggccucugcucggguucagcccagcucaccaggccuguggcggggggccuccccucccagggcuggggcccccagaaggugcuccgggcugggaccuccaguacggucugggggcccaaguugcugggagcagaauuuggggcugagggggcagguggggcuguugcucgggccuccaaagugcccaccugggugggaggcucaggggcccgaucugucagcagggggaccgcagagccauaccaguccucagagcgcucucgggcggugcccaugggcucaauccacagcucuccuccugggcgccacaccagggugggugcacgguggcuggggucugggcggagagcacggcggaacaggcguucagccaacacagcgguggugaggaugaagagcgcagccaggguggccaggaccagcaugauggggaugcagggcccacagggcagugagggccauggggcugcuucccaugcggggggccccuccacgcgcccagagggcggcucuggagucaacggcaucugagagacacaggggugagaagaggaaguaaaugaggcagagggggcacaaccaagaugagagagaggcagcagguguccaggaaagccugggagaagggcugggcaugggggcucaugccuggaaucccagcacuuugagaggucgaggcgggaggaucacuugagcccaggaguucaagaccagccuggacacacagugaaaccucaucucuaaaaauaauuuaaaaacuagcugggugugguggcucacaccuguagucccagcuacacaggaagcugaggugggaggauuacuugagcccaggaguuugaagcugcagugaccccagauugcaccacuguccuccagccugggcaauagagcaagacccuuucucaaaaaugaaaaagaacauucuggagagacagagaagcaagagggaccagaaaggguaagcgugagccagguggggugggaggacaggcagccuaccucggggcacagccaggcccuccugccuggcucuccaggccuuuccagaauccccauuucccucccagaccccagggugccucagacaagaaaggucucaagggcuucuuuccuccccacucggcccccucaagucuugcucagaccuagagaggaaguggugggugaagaaaugagaaccuccccucccacuggcuccccugcgugugucucccccaccgccugccgccagcaccuccgcuggccccuugaggcuccuucgccccucaccauucuccucggacuugaucuugcucucauaggcuccacggaaucugcugccgggccgggccgggccaggccuccggaggcgccucugcaccccuccugggcuccccagcuuugcccaggcucuggccugucucuaucucucguuugucucugcacaccucucugucccccacauccuccaucugcagggggccuccugcaccccucaacucaccuugggucagucccugggcuccucucccuccuagagccacucuuccuggugcuggacuaagaggugcaggcuuggagggugcagggcgguccgccucucagacguagaggcccggccucggaugaaggcggaag

SEQ ID NO: 15411 - RNA, 4234 nt, Homo sapiens
uuugauauuuucuggauugugaaagcccuguugggugccuuccuuacccguacuaccucuuuuuuucaggauucgcccaggaccugacuaaaaccaguccuggcuuagaaaacaaccauaucugucaaaggaaagggagguggagcugaggacagcgacguucguucggugacaguauuuucuaaaccugauaugggggcucuuauuuuaacaacucuaagacaacagugucucuaagggauuuuggacauggccucugucauucugcagcugcagugaguccaaauagcaaucagaaaaggccaccagaugcagcccagugggugcccagccuggcugguagaagcugguuccauccgagcucagcucuucccacccacuaagcaagccccuucccgcucccucccuccgucuccucucccacugcacgagcccaucccccaccugacccuuucccccaucuccugcccaggccacagagcagggcugucacacucacaugccuccccugucuuuuuuugcaggucaaccugucugcucucagccaccgcaagcucuaacucaacaacuuccucuuugaaaauuuccucuuuguccucgggaaauaccaacugcccuggcccaugugugcuccugggcuguagccugggcuggucucaaaggcagcaccauugaguucuccccucuccacccaggccccacaggggaagucccuggcuccaggccccuccuucacucacucucacugguuccucuuggaggauggaaggggcucagccccugggauggaagaggagacacagacaaacuaaaccuggaaacgugcaguggggaagcgccagccagaccaguccccgagaccagggcaaaccccucucccccugccucuguucgcaggagagcgcgcgcgcgcgcgcgugugugugugugugugugugugugugugagagagagagagagagagagagcgcacaugcauguguacugcagaaauggagacuucaaggaagggauuaccauggcugagcugaagaacucauauuugggucacacauacgaucuuuccaugaagccuggcuuucuuuuucuuuucuuuuuugagacaggggcucacucuguugcccaggcugaagugcaguggugcaaucacagcucacuucagacucgaacuccugggcucaagcgauccuccugccucaacuuuccaaagugcugggauuaaaggcaccagccacugugcucacccuggcauucuguauggggcuacagacagaguuagauuuucugcuauguccaccccaucagagcaaagaugacacgcacguucucagcagucccugugucccccaugcccagguugacccucuucagucucugcaccacuucccacccccacaccgucuguacccacaacuaccccucccaagcaucgccaaauccucagcucuugcacacaaaccacacccacgaguggacacacgcaggcacugggguuucugagaacuacacccagccagaaacucggaggagaaaccgugaggccucuggcugccucuguccauggcuggggagagugugguggugugggccagggccagccuacaguccaugugcccugggaaagaucacaggcccgccugagagcaugggcugguggccccacccagccaugcuccaggcuggccuggggggcccagagcuaaaggugguugcgggcugcccagguuccacagcccuugcagcuacagggcaagggugcuuuacaaaguuaauccuaggagggaguuugccggguucucuuguccuucuucccagacucuggucaacccaggguggguucugggggaaaaggagaauugucaaagaaaucacagggcagauaaguuuggccgauggagacucagcagccguuuccaggaacaagaaagagggggaaauggugauggagauaaauagggguggaugaggaggguuuauucauucaguccacagacguugagaggugccagcccugcccugcccaggcgcuaguugugggugcugggugaggauggcagcaggaaauccagggcugagaagccucaugaggauucagagugaagaggugggugaggaggcaaggcgcggaggcucaugucuguaaucucagcacuuugggaggcugaggcagguagaucaccugaggucaggaguuugagaccagccuagccaacauggugaaaccccaucucuaccaaaaauacaaaaaagcagcugggcaugguggugggugccuguaaucucaguuacucgggaagcugaggcaggagaaucgccugaacuuaggaggcagagguugcagugaacugagaucgugcauugcacuccagccugggcgacaaagcgaaacucugucucaaaagaaaaaaaaaaaggagauucgggugaggaucagggugccggguggaaacaugggagcgagggggcagugggauggugagagggaaggugcuggaggcuggcugagauuccggccuccagccucacuauucaccgacacuuaaggggcagccccgucucccccuucgggcucaucaggagcuggggcguccacagccccauccucacuggccaccaguggcuccuccuccccuuugaggcuggggccugacccagacuucagcuccuccaucgccagggagcccuggcgagacuuccgucugccaaagaaaguggugagcgugggccgacggcuagaccccuccccaucggggaacccagagcccuugucgcccccggacccucccacggucacugucacggcccccuccucagggaccugggcuggcccagcccaggcguccaccaccccguuacgcuugccgccucugcucagcacgagggccccaguccgccgcuucugccgccggcgccacagcaggagcagagccacgaggacuaugaccgccagcagggccacaagcacagccacuggcagcaugccucgugaguucucaucuggguuccggaagggcacagugcuugcguugguggaggucguuggagacaucauuguagauaguuuuacgcuagagaccugggguccacuggccccgcuggagggcuccagagagccaguugucaugguaacaggggguccaguggucccaguggaggucuccagagagucaguugccaugguaacaggggguccagaggugccuuuggaagucuccagagagacaguugccaugguaagaggggguccagaggugccucuggaggucuccagagagcuagcugccgugguaacaggggcuccacugguccuacuggagguuucuggagaguucguuguuaugguuccaccugucacggugugggauccuagagaguuugcuguuaugggaacagcaggaugacugguugcaugagggguuuccuggggcacugaugacaucuugauggaaacuuccugguagguuguuggcucagguaaaggggaaccagugcuggcaccaauggaaguccaaagaggggaucccucauugauggaaguugagggagguagggcugaggucugguccccagugcugucggccuuagggucacuuguuauugaagugguguacaucuuugagcucaggggcucgcuaguagagaccaaaggcucuccggaggugggugucugcacugcuguugugcuccccagagcgucugggcuuaccaccagcaccccaaggagaaggagaagcguggccauuuccaggcaaacaggcaggagcaagagcugggaccugcaggugggcagccggagaagcagaacacgcgggaguugccggaggaccuggccgggccuccccucugcccacuucccugccaacggccaggcccaaccugcgguuuaacgguuuuuuccaugcuggcuuuuacuguuaucagaaaugacagaggaacagaugcuggcagcucccccaucagccccauccugaggcucccuccagccucagcagcuuagauuccagcagugaccagccccuccuggccuucccugacccugugcagcccaauggcucccaaucucuucccaucauaaccugucagagucuuuucaagccacaggcacauucccaggcccacugaggccccuaccccaccaagucucacccucuuaccggcucggcugauaaggacgcagcacuggggccaggucacuccaccaccucccgaggcuggggcaagacugggaaggaca

SEQ ID NO: 15412 - RNA, 7277 nt, Homo sapiens
ggcgccgcccauaagaaacaaagaucaguuaaauuuuauugggagccgggguggaggucgggccgaacagaagcgucgggcagcggaggcccgcgggugccccuacuccugguccuuggcgucgccgugcgugaugacguagcagauguuuuuguagucgacguugccgcccacgucgggggggaaggccgcccacauguucuugaucuggggaaagacguaggggcgucucgcacaggcccuuagucuccccggccccagccccuuugcugcuccggccccgccccgguccccacucaccuccuccugggagaagcggucacacugcguggucagcagcuccuccaggcuggagagaggugacacaaggggaguugcgauuggguuccugguuccuuuccacucccucgcaccucauccccgaugccagccccagccuccccugaaaacccaggucacucuacuuccuucauuggccucccagacacucgcuuuugcccucuccgcccacauuugcugugaaaaugcaaucuuaccgcccauuaccacaaucuuaacuacucccuuaccucuggcagugccuaacccuucguaggaauuuuuggguuuuuguuuguuuugagacagggucucacccugucgcccaggcuggaaugcagugguuugaucacggcucacugcaaccuggaacucuugggcucaagggaucuuccugccucagccuccggaguagcugggacuauagguguuugccaccacucccgcgaauuuuuuuuuuucuuuuuuuuggagacggaguuuugcuauugucgcccagguuggagggcaguggcgugaucuuggcucacugcaaccuccgacuccaggguucaagcgauucucaugucccagucucccuaguagcugggacuacaggcgcccgccaccacgcccagcuaauuuuuguauuuuuaguagagacgggguuucaccguguuggccaggcuguucuuggacuccugaccucacaugauccgcccgccuuggccucccaaagugcugggauuacaggcaugagccacugugcccggccagcccacgaauuuuuuaguuaaguuuuuagaaacagggucaugcuguguuauccaggcugaucucaaacuccuguccucaaguaaauccuccugccucugccucccaaagcacugggauuauaggccugagccacagggcccagccuugguagaaauuuaaggaggcugucagugugggagcagcugguggagugggggaagggucggaagggugggggagccgaugcuuacaacuucuucuugauggugcccuuucccucaggguccaagaccuugaaggcuccggugaucacauccucagggucggcaccugugggggucagagggcacaugaagcugaugggucccugaagggucugggaaaaggcagccggggccuuggacccaggacacuccacucacccuugagcuucuccccgaacauggucaggaagacggugaaguugaugggaccgcuggcuuccuucaucauggcauccaacuccucauucuucacauugaggcggccuggaggggguugggggaagcaugggcuggagcaggcuccuggggccgggccugcgcuucccacuaauucagcugaucccauucauuuuucagcuggguagacugaggcccaagguggagcugacagggcuggaacccaaggccacugaauuuccuagacucugcagccuugaauauucccaccuggggguagggggcucacccauggcugcgaaggugucccgaagguccuccuugucuauaauaccaucacgguucuggucgaucacagugaaggccuggggagggccgugguggggaggguuaggucccccauggcccagccucagcaucccuaccccaggaggaucagaugcuggcucucagccaacuguccucuuccaccccaagcagagaggggaggaaggaauucuaaaccuuuccccuccuucaagcaggugcacauuccagggagagggccagcagggcugcuuuuggucagccuuccaguuuccccguccccucacccaccucuuugaacuccuggaucugagucuggucgaacauggagaagacgcuggagcuuccgcccucuacuguccuucucuuggcccucuugggugccuggagggugaggguugaacaaaggggcccauggaccagucccuccaccucucugggggcaauggauuaagagucagaauucuucgagucccuguuccuaaagcagcccuuuggccugagucuccccuuccuugggaccucuuugcugagggggcuugcuuugauugcauuccccaaauucccgucuguggcuccugggucuccaacucuccaucccccacaauggguggaagcuuccuuaucuucucaguguccugagccuagcuccucugagccucagacuugcugugugaccccagccacucauuugcccuguuugagccucuacuuuucuuuucuuuuuuuuuuuuuuuuugagacagagucuugcucugucacccaggcuggagugcggugcugcgaucucggcuuaccgcaaccucugccucccggguucaagcgauucuuaugccccagccuccguaguagcugggauuacaggcaugcaccaccacgcccaguuaauuuuuguauuuuuaguagagacgggguuucgccuguuggccaggcuggucucgaacuccuggcuucaagugauccaaccaccuuggccucccaaagugcugggauuacaggcgugaaccacagcaccuggccugagccucuacuuucucauuuguaaaaugggaugggaguuauugccuggcuggugccagagggccuuaggaagauggaguacaggaaugaauggaucaggcuuugagagggacugggccccugugaguugaaugucugggcggauuaucauugauuggauccuuuaggccaucacacagucuguuuuccaucagugaugccgagaaagagaugagcauccuuuuaacuuuuuguuggacugggaaccagcuacuuucuuucaaagggugaggcugcccugaggucuaagggaucugggcagggguuggaggauucucacucaccaugucuucagucuccggggggcaaggcagcggcuccggcuggaaagaagcaaggagucagcauggggcagucccucugggguuauauaguccugccccagggagcccuuaacauaccaagguaaccuuagcccugcgggugcccaccccagauaccaaaauagcccaacucagggccucuccuuucuuggagggcuggcagcagcuggagcccagcggggaggaaggggggagcaugucuugcgaugcaugucucacuagggccugggcaagaagagauguucuuucucccaaagaggggcuggaaugugccagaguuuagaggggacgcaacccaaggcaucauucugggagauaaaugaaccagauccuguaccccugaguggggugggcucagauuuaaacccaguaaacgucugggugcagugguucacaccuguaaucccagcacuuugggaagcugaggcaggaggauugcuugaggccaggaguucaggaccagccugggcaacauagugagaccccugucucccuuuuuuuuuuuuuuagacagucucgcucugucucccaggcuagagugccaguagugugaucucgguucacugcaaccuccaccuccccuguucaagugauucuccuaucuuggccucccgaguagcugggauuauaggugugccacgaagccaggcuaauuuuuuuuuucuguauuuuuaguagagacaggguuucaccgugucggccagaguggucucaaucuucugaccuggugauccauccaccuaggccucccaaagugcugggauuacaggugugagccacugcgccuggcccccgucucuauuuuaaauuaauaaaauaaacccaguaaacauguauugaacacacacagugugccacgugcuaggcugggcuuuguggauguacuuuggcagacacaaucccuccacccccacaugguggaguucauagucaaguguguguaagugugaggguggugagaaagagccaucuguggaagcugagggaucaggugggucuccuaccucccuucaaggagaggggaauuuuuuuuucuuuucuuucuuuuuuuuuuuuuuugagauggagucuugcucuugucacccaggugggagugcaauggugcgaucucggcuuacugcaaccuccgccuucuggguucaagcgauacuucugccucagccuccugaguagcugggauuccaggcacccgccaccaugcccagcuacuuuuuuuuuuuuuuuuugagaugaagucucguuuuguuauccgggcuggagugcaguggcgugaucuuggcucacuguaaccuccgccucccggguucaagugauucuccugcuucagccucccgaguagcugggacuacaggcgcgugucaccacgcccgccuaauuuuuuuguauuuuuaguagagacgggguuuccccgcguuagccaggaugaucucgaucuccugaccuugugaucugccugccucggccucccaaagugcugggauuacaggcgugagccaccgugcccggcaucuaauuuuuuguauuuuuaguagagauggcguuucaccauguuggccaggcuggucuugaauuccgacuucagaugauccacccgucucgaccucccaaagugcucaaagugcugggauuacaggcaugagccaccgcgccgagccaagagggauuuuuugaggcaagaugcuuuguggucucagguuuugugcugggccuugguuuccccucuguaaaagggagauguaguucccaucccacagaacuugccuuauaacuaauagagacaggaaugaaugcagaaacugacauaccagagcuggucaggagcccagaaguggagggcgcagcagcccugucuaggaguaugggaguggcuucacgagggccagggagucaggugcagguggaggagcagaugugcugggcggagggcauggccugagcaaaggccuggagagcggaagaucagaaguguucagguggccagaauugugauggggcuggugaccagccccugaggggccuuugccaggcacaggacggagacccuggggaaccuuggaaagguuucaugcagaagaaggaugugaucuaguaugagucuagaauauuuucucuggguacugguguggaggcuggaacucaagaggggaggaaaagacccuaaaaggacagccagcuggucacuuucugugaggugccuugauagccaguggcagcucacuuuauucuggccaagagccagcuuggcugauugugugacuuugauguacccucucuucucccucugggccucagugacccaguccccuccaugcagcagaagucuggaaaaauaguggcugaggaagccccaaguuggcaaggacaaccaucuccuucuccucccgcucccucuaggacccgauguccugaggaagaugccucccccugcccuguccccccuccuccaggcccaugccgauaccucuaagacauuuucuuuucugggcacugaggccccagccaccuguugucucuaagaagagagaaggagccacccuaaacuuagcagcugcccuuagccucccacaccagccccucccugccucagacagcagcugccucgccuuauaggguuaccacggggguccaggccagggaggagcccacuuauuacuggguucugggagaggaggaggacuccaaaaaggggaaugggaggagagcucaggaagcuugggucaaacgggagaugggaaaggugaggagaaggagaucagacacugagugggaauugacaggacauggggcugaguugggagugagggaccuuagaggacucagaaaccaaggaggagcugagaagucgggagcuaggucucacuggaauuccaggaugguggaugcuauauggaaaucagaauaugggggucagagaaagaagagggcguuuagaaguuggaagguuggagcucauaacgucaggucuuuaugcuugugaucuaaggacaaccuggagcgcucaugagauugaggucgggauucucaguggaacaugaggagcacagagggauguggcagugaggggagagggguugacgggacuggggccuuggauccccaaaagaauaguaacacacauauggggaguucaugguauuagggauucauggauuugggguuugagauccccacuagaagaaauggaggggguacucagagggauaaggucugaggaacuggagccuggguucuggggaggagcucagauagaugggaacugaggagagggacuuggagguugggauucccgcaggaaaugggugaagcagagauauggguugcuuauaggaucugggggcucuggcuauugccaccugggccuggaguguugggguuaguugggggccgagaucggagaauuauagaguaaaggaugagaguacugggucagggcacuggaucugugguggggcucagggucccacagaccaccagaguguggggcucaggagcugaacgaagaauaggggaccggaaaggacucgagagggggcagcgcggcacucauugguugagggcugcacuaaugcccccgccccuucuccgugcuguccccagcugucacccucccauaaggcuugucuccgguugucaccgacuaucccugggcuggcaccgccugcuggcagcaucuuugcccuuuggaugcucccauuggcugagacagcuaucuauuuuccuguccuguggccaaagugggagaacacgaucauuggcugacggggcgaauuaaucucuagcuugccccgccuccucccagcugucauuccuuacugaccauuuugggagaccuaaagaauucuucagcucuuccuauugacugcggaugcugucugucaccgccuaaauagacaucacugccugucaauuugaccuccaccugcuccccuuuucauuggcucccuuuuuaccauuccuauugguuaagaagccuccaggccccaccucuuacucgcacagcccugccuccuccuccgcccuuccgcggucauucacccuucagucauauucauuggccaggagguucagaccccugcguuucuauugguuauuucuu

SEQ ID NO: 15413 - RNA, 659 nt, Homo sapiens
auugugguaaugggcgguaagauugcauuuucacagcaaaugugggcggagagggcaaaagcgagugucugggaggccaaugaaggaaguagagugaccuggguuuucaggggaggcuggggcuggcaucggggaugaggugcgagggaguggaaaggaaccaggaacccaaucgcaacuccccuugugucaccucucuccagccuggaggagcugcugaccacgcagugugaccgcuucucccaggaggaggugaguggggaccggggcggggccggagcagcaaaggggcuggggccggggagacuaagggccugugcgagacgccccuacgucuuuccccagaucaagaacaugugggcggccuucccccccgacgugggcggcaacgucgacuacaaaaacaucugcuacgucaucacgcacggcgacgccaaggaccaggaguaggggcacccgcgggccuccgcugcccgacgcuucuguucggcccgaccuccaccccggcucccaauaaaauuuaacugaucuuuguuucuuaugggcggcgccuucagagugucugcgcgagggccucaggugggagcgccccacaaaugaauggaugcggccuggaggccugcgggggucggccccacaaucuacgcccgccgccuuuu

SEQ ID NO: 15414 - RNA, 659 nt, Homo sapiens
aaaaggcggcgggcguagauuguggggccgacccccgcaggccuccaggccgcauccauucauuuguggggcgcucccaccugaggcccucgcgcagacacucugaaggcgccgcccauaagaaacaaagaucaguuaaauuuuauugggagccgggguggaggucgggccgaacagaagcgucgggcagcggaggcccgcgggugccccuacuccugguccuuggcgucgccgugcgugaugacguagcagauguuuuuguagucgacguugccgcccacgucgggggggaaggccgcccacauguucuugaucuggggaaagacguaggggcgucucgcacaggcccuuagucuccccggccccagccccuuugcugcuccggccccgccccgguccccacucaccuccuccugggagaagcggucacacugcguggucagcagcuccuccaggcuggagagaggugacacaaggggaguugcgauuggguuccugguuccuuuccacucccucgcaccucauccccgaugccagccccagccuccccugaaaacccaggucacucuacuuccuucauuggccucccagacacucgcuuuugcccucuccgcccacauuugcugugaaaaugcaaucuuaccgcccauuaccacaau

SEQ ID NO: 15415 - RNA, 11617 nt, Homo sapiens
guuuacauccccauuugguuccuugacaacucacuuggcaccugagccuggagaaccccaacuuucuuccucucccacccaccucacucacaggcacggguggggugaggauauaauacuuuauucacuaacacgggccgagggaauguagugauguggggugggcacuguuuccagggaccccggcaggggauucucccugucucccaguuccagggcagccgggccugccguccccucaauuucccagacccggaggccggggcgaggaggagccuggguuagugcagccaggucgaagccccagcgcgccccuccgcagcccugcgggacucagcugcccucacacuccgggcaacgcucgguggcaguggcggccguggcgccagggggcagcuugaagucccugccgcagccggcgcaaauauacaggcggcgccgcaugugcgcgcgucgguggcgaaugaagugcgagcuuaggcggaagcggcggccgcacucggcgcagggguagggccgcucgccugugugcgugcgcgcgugcuccgccagguuggagcgguggccgaagcgacggccacacacagcgcagcggugcggcuucucgcccgugugcacgcgccggugcuuggccagcgccgagcucugagcgaagcgcgugccgcagucggcgcaagcguagggccgcucgcccgugugcgugcgucgguggcgcgccaggcacgagcugccgccaaaggcgcguccgcaguccgggcacgcguacggcuucucgcccgugugcacgcgcaggugcugugcguaguuggagcucugcgcgaagcggcggccgcagugcgcgcaugcguacggcuucucgcccgugugccgccgccggugcugccgcagguucgaggcggccgagaagcguuugucgcacucggggcacucguagggccgcucgcccgugugcgugcggccguguuuggucagcgccgacuucugugagaagcgccgcccgcacucggugcacccgaagggccguucgcccgugugcgugcgcgcgugcuucgccagcguggagcggcgcgcgaaggcgcggccgcagucggggcacgcguggggacgcgccgggucggcggacggcgcgggcgccucgcccgggaccugcggggagagggggauaggucagcccuuagcggcaggccccggagccagagaccugggucuccacaggcugcucccucugugagccucaguuccccaucuaugaaauaggaaaggccacggugcugccucccaggauggcugugcgcauccagugagauaaugcgcguaacgcacacaucacaaagcccaguggcguucuagcuauuuuuauuaauucaaccaauauuuacugagggcaugcaguguccuagacuguucuaggcacggggauuccgcauuaaauaaaaagcauuaaaaaauuccugcuuucagaaauaauggauaaggaaugcugguauuggggaugcuacagauuuaaacaggguugucaagacacuuuaccgauaugauaacaugagcaaagacuuaaaggaggugacagagcaggcuacguggauagcccucugaggagcacugcagagggaacggcagggcgcagaggcgggaguugccugcuguuccagaaauggcaagaaaaauugguuaaagcagaaugcaugauggggggagucacggauguagugguggagaucucuuggcauauagggccuuguauuuguuauauuuggcuuuuuuuuuuuuuuuuuuuuuuaagagacagggucuugccguggcccaggcuuggucccgaaccuccuggcucaagcagucccuccugacucagccuucugaguagcuggaguuacaggcacauaccacugugccuggcucuggcuuuuauuauaaaggagacagggaccuguaagaggagaugucagagggcuuugagcagggaagugaccauauccuacacauuuaaaaaggcuccccucaggcuacugggguugaaaaccaaaugaaggaguuggagagagcagaagcagaagcccagugaggaggccacuacagccaccuggcaagagaagauaguggcucauacccaggugacagaaguggacgguggaugguggagguggugagaagugauuggcuucuggaucuauuugcagugugagacaauagauuuaauaagagauuagauaugaggugugaagaaaaagagaucaaaaugacuucaagguuuuugagcuuagcaacugcaaagguggaguugccauuuacagagaugaggacggugggaggagcaaguugagaggggagaucuguuuuggauggugucacggcuucuugacauaucuggagcucagaagcgaggccuagacuggagauguuaauugagaagcugucaaccuauagaugguuuauaaagccuugagaaugaguggaugagaucauccaggggaugggcagacagaaccuagggcagcaagauggggagaagccagggagggaggagagcaggagaggggcauccuggaagccaggccaggaccaaguccaggcucuuaaucagcuuugaauagcaaacaccuaucauuuuuuaagcagugaagaaaaaggcaaggguaaaagccaaauguuauucugaggucugaaaugaaacaaucugaaaaugagccaguuucacaagcucuggccuuuuagagauaaaaaucagaaaaaggaaagaaaugccuucuaagaggcacaugaagggaaaacauucuggacuaacagugaagaguauugagggcauauugcucccuuccuagaaaagagaacgcucaaaaccccagcaaaacugaugucgcguaucuacuguggccaagcaauuaauucaugaccaaaugaagugccuggggcauauuaaggacaagacagugucagcuucucccauauucgaucuccacgagguaauuaucaucaucccuauuuuacagauggggagacaggugaagagagagggacagcaaggccaggugcaguggcucacgccuguaauaccagcacuuugggaggccgaggcagguggaucacgaggucaggaguucaagcccagccuagccaagauguugaaaccccgucucuacuacaaauacaaaaauuagcugggcgugguggcggacgccuguaaucccagcuacucgggaggcugaggcagggaacugcuugaacccgggagguggagguugcagugagccaagauugcaccacugccuccagccuaggugacggcaagacuccgucucaaaaaaaaaaaaaaaaaaaaaagggugacagcagaaaauaguagggccuucuguuucugaagcugcaggagggcaacuucaaggccuucaagauaguuugucaaaagguaguggcuuugugguaaccaacucagaaauuagaaaauaagccaggcguggugguucacaccuguaaucccaguacuuugggagaucgaggugggcggaucacuugaggucaggaguucaagaccagccuggccaacauggugaaacccugucucuacuaaaaauacaaaaaucagcuggaugugguggcucaugccuguaaucccaccuacucaggaggcugaggcaggagaaucacuugaacccgggaggcagagguugcagugagcugagaucaugccacugcacuccagccuggggaacagagugagauuccaucucaaaaaaaaaaaaaaaaaaaaaaaaaaaaagaggccgggcgcgguggcucacgccuguaaucccagcacuuugggaggcugaggugggcagaucacaaggucaggagaucgagaccauccuggcuaacauggugaaaccccaucucuacuaaaaaaauacaaaaaauuagccaggcgugguggcaggugccuguagucccagcuacgcgggaggcugaggcaggagaaugacaugaacccgggaggcggagcuugcagugagcggagaugcgccacugcacuccagccugggcaacagagcgagacuccguugaaaaaaaaaaauuagaaaacagggcaauuuagaaaauuagugaccaagagaaaucugguuuaaauaguaucuauacugauaacaauagcaacaaucaauaacaaaguauuaagcuuugacaacacuauguauguuauuguauuaaauccuccugucacccgccuugagcuggguguucucucuuuugauagcugagaaagcugaggcugagggcgaugaaauucacauggccagugggagccaggauggacucagggugcccaugagaccaugccgucauucaggcuacacuguucugaacucacgugaccaagaugugacagaggcuggauuccacgucccuggcacacuccaagagggauucaagguuaaaauacaacuugauacuuuaaauggagaaacuccccacaguauguuugguaccaucugaauucaaggucacauuuuccagucuugcccugguuuugaaaucuauugguuuauuucaauacaucagccacuguggagagaacuugucucaucagaucuacauuuuucuggcccguuuuuccuuggcacccucuuucaggugacuuuggacagccugagggcuuccucaugcugaguucacugacuucugaaaaagaaauucuccauacaagcacuguugaugucuccagcccaggagaaggggccuuggaugcccgaggaaaaaucuugguaagaggagcugaauccagcucauuaagauccuccucugccccagugucccgagaaaggccagguaggcuaagugagaucaaauucccaguaugaggccaggugcagugacucacaccuguaaucuuagcacuucgggaggccaaggaaggaggauuacuugaggccaggaguuggacaccagccugggcaacacaguuagaccucgucucuacaaaaagugaaaaauuagccaggugugguggggugcacuuguagucccaacaacuugguaggccgaggaaggaggaucacuugagcccaagaguucaaggcugcagugagcuacaaucacgugccacugcacuccagccugggugacaaagcgagaucgugucucuaaaaaaagaaaaaaaaacccaaaauuucccagcaugagguauaaggugguaugugggcaaacuuuaaaaaagucucauaauuguuacacauuuauuuucacgaauauuuaaaaaacaagauaucacaugaaacccacaauuucaucaguacuauuguuuagaugaagguacauuuauuuaacaaaacaaugugaaucuauuugaagaaaaacauuaauaaauaaugugaguacaacauaugagcaauacacaugugacugaaacuuggcaaauaccagacuaggugaucauuaauggcccaagcaugucuuaaauucuacaacuauuagauuuaaaaauuagaauaaaugguauuugcacuauaacaggaggcuacugugaacauacaauguaguguaauaauauaauaauccagguauuagaaguuagugauuuuuguuuuccugcuuaaauguuuuuuaaccagagcaaacaucccaguuucuuccuuagccauuacuucucuaauuaauaaaauaacucccacuuguugggcacucaccaugugccaggaacugugcuaagugcuuuuuaccaguacugucuuucuaaauucucgccauggcuuucguuagguaccuuagcccuguuuuauauauaaggaaauaagacucagaaguuaagugacuacacaaggcaaggcuauucagcuaauaaauggcagagccaggguuugaacugaauuuacucauuuuccagaacaccuauucucuuaaccaugaugcaauucuuuuuuuauucucuuuuuuuuuuuugagaaaaggucucacugugucacccaggcuggaugcaguggcaugaucacggcucacugcagccuugacuucccgggcuaaagcaauccuccugacucaaccccccaaauagcuggcgcuacaggggugugccaccacacccggcuaauuuuuguauuucaguagagaugggguuuugccauguugcccaggcuggucucgaacuccugagcucaaucaauccuccugccucagccuccaaaagugcugggauuacaggcaagagccaucacgcccagccuccaugaugcaauucuaaucucacugacuagaguuugaggccacuuacacagcuugucucccuccccuggccccuuuuugcggucacagucuuccuucauuuuggcacaaacuauuaaacacaaccacugucuucuaguuccuugcuggaggaugugugguccacagaccagcaacaucaacaucacugggaacuuuuuacaaaugcagaaucucaaaucccacuccagauuuuacugaauuaaaauccucauuuuaacaagaccccugggugaucuguaugcauguuaaaaauuaagaaacugaucuagaugagaaaagagcuacuccuggagaaagcagggagcaaaggugaagagggcuuugcgggcugagaccacaaggggggaugggauaggugucgaggggaugaagccagaauggcaugaggucagaugguaaagagcuuugaaugccaaguuuaggagcugagaccucacccugagggaaacagaaaaccacucaaggguucaagccagggaaagauagguuuggaugugcauggagcccucagaaaaucuuucuaaaagauagauuggguuuugauggcagagggagaauacuccagccccugcaugcagcguaauuaaggcccuucuggacagugacuggccacaggacuggcaauagcuaggacucacugaaugucaccacuggaagguguuuucgaggucaccauuucauagauggagaaaugaggcucaggaaggcccacagcaagcuaacgaucgagcacccuucugggcacgaugcuaacaguucaugggauaugugugcauaauccucaauuccacccaucuccuccaaaucuagucaccuugaugacacuucucagacuggcauucaggggucuuacucuauuaccccauuuuacagaugagaaagccaaagaaaagcugguaaacgguggaguuacgaccgcuacaugauaccauucacaaucuggcccugugugccuuucaugacuagccaugucagaccuucaccgcacauaccccuuggcucuagccagguuccuaaauggccccuuuuccucaucauugcuguuacuaccuuagagcaggcccuaccuggccugggcucccuguagcagccaauaauucuucuaaacagaaaauccaaucaugucccuccucugauuuuuuuuuuuuuuugagauggaaucuugcucuguugcccaggcuggagugcagcggugcaaucucagcucacugcaaccuccgccucccagauucaagcgauucuccugccucagccucccaaguagcugggauugcaagcaggugccaccacacccggcuaauuuuuguauuuuuaguagagaugggguuucaccauguuggcaaggcuggucucgaacuccugaccucaagugauccgcccgccucagccucccaaagugcugggauuacaggcaugagccaccacgccuggccuguuuuuguuuuuugagacagggucucucucuguugcccaggcuggaguacaguggugcagucauggcucacugcagccuugaacuccugggaucauucagccuccagaguagcuaggacuacaggcaugccaccaugcccagcuaauuaaacuuuuuuuuuuuuuuuuuuuuuuuuuuuguagagaugaggucucccuauguugcccagggaggaaucgaacuccugggcucaagugauccucccaccuuggcuuuccaaagugcuaggauuacaggugugagccaccacgccuggcucuucccaugauuuaaggcuucuuauggugccacagaaccuaacacaguacguccugcccuagcuugcaaggccccucugucccccaacugccuuuccagucucauuuccucugagucuuuguuuuugcuguuuccuccuccuggaaugcccuuccuccuccuccaugugccaaaccccugcaaagccuucaaggcccaagucaaaaaucaucuccucugggaagccuuccccacugccuugagucguuugucuucaauccucugugcccccacauucacuucccugaucaaccccaguucucaugguucagcccaggccuuugauaaaaaugaguugagccaggcgugguggcucacgccuguaaucccaacacuuugggaggccgaggcgggcggaucaugaggucaggaguucgagaccagccugaccaauauggugaaaccccaccucuacuaaaaauacaaaaauuagcugggcaugguagugcgcaccuauaaucccagcuacucaggagacugaggcaggagaauggcaugaacccgguagguggaggugcggugaaccaagauugcgccacugcacuccagccugggcgacauagugagacuccgucucaaaaaaaaaaaaaaaaguugaaaaaucucaagaaggaugaccuugcccaagguccugagcuuuggggagaagaauaaauguaacagcaacuauuuccguguuuauuuugugccagacacaguucuaacucugugcauguguugacucauucauuccucacaacuccaagauguaggugcuguuauaauuucccuuuuacaaaugaggaaacugaggcguggagcgguuaggaaacuuggccaaggucacacagcggguaaaugauggagcuggaaguccacccuaagcucuggagccuguguuuguaacuuagaggccaaagguggagaucaggcaaucgcagggccagaagaggcaggcagagcuggauaaugggcgaagggggcccgcaacaaacacaaccagauaguuauuagacuauccagaggccuaaggagcuaguccccucccccagcacccagcaggcccacuagggggcagcagagcauucuuucccugggaacuggcuccugggcaggaagaaucagagucccggccccugcaagcugggucccuggggccaaagcccucugcugguacucagggcugcucaggcugggggcagacagaauccucugggguucugagaagcggaaacguaucugguggcaguuagggucuccagggggugaaauuuaacucauauucugaucucaaaaccuucaaauacccucagaauaaaagccagacucccuguguggccugccaaccacccccacucauccacacuacagcaugaccgaaccacccacccucacugcugcagugcacuacucacucgucugagccucuauaagggccauuucuggcuggauacgguggcucacaccuauaaucccagcacuuugggaggcugaggugggaggaucaccugaacucaggaguuugagaccagucuggccaacauggcaaaaccccaacucuacugaaaauacaaaaaauuagccgggcgugguggugcaugccuguaaucccagcuucuugggaggcugagguaggagaaccacuugaacccgggagguggaggcugcagugagccgagaucacgccacugcacuccagccugggcaacagagcgaaacucugucucaaaacaaaacaaaaaaaaauuagccagguguaguggugcaugccuguagucccagcuacuugggaggcugaggugggaggaucaccugagcccagggaagucaaggcugcagugagcuguacugcacuacagcuugggugacugaaugagacccugucucaaacaauaacaacaguaauaauaaaagagccauuuccucugacuggguccaucaccccacuucugaccccagacuccuacuagucucacauaagccauccuuuuacuuugagaccuguggccaguuaccaaacugcccugggccucagucuccucaucuguaaaauggaauaaaugcuaccgacaucauagaaucgaggugcuuagaacagugccuggcacauagaaaaugcuaggcaaggguuagcuauuguuacuguugcuguugaacuaaccugaccuuuccccaaccucuaaaucugaguuaaguucccacuucuaggcuucaucaucccccuguaccugcagccaucacacgggauucuaacugugugguuacccuucagucuaacaucaagcuccaugggggauccaaggacggaguuuaaucuccugcacccagcaggaagccugggacaguaggcgugacuuuuguaugauggaagcccaggcaguagggcagaaggaugggccaauccugagguuuuagauccgagauucugggaaaaguaggggcaagaucccuggcuucuaucugagggaggcugggccuggaccagguuuggggacagugugccccagggugugugugacacauaccuccuuguuguccauggggaucuugaguuucaccaccucauacuucuccucacccucauccuccucacccuucaccagcagcaccaucuccuccugcaucucuuccuccuccucuuccucugccugcuguucgccaggcaucuugguguccugaggcggggagcuggaucagaagcucaggacccgcccccccccacccccccccccgcccaccguggcccuggcccagcaaggcagugcagccguggcuucucccgcccugcccuggucuccgaaucugguccucucccguccaccccagcccggccccacgcucuggcacagccccgggaccagcuccgagggcucgcguucaccccacucaucccagcauucaaggccuugaacaguucgaaucuccagcccccgcaagucgccaccauccuugcgcugagucacuccccagggcccgggucggcgaccuggagcucuggggcacgggcuggaggcgggaucggggcggaaaccccggggagggggugcgcacucaccagccgaagguucggcacucgcggugccccaggccugggcgccgggcggcugggcacucagcgaggccgcggcuccgggggcggggagggggcgggaccgcagggacggccggucauugguccgaacauauagccccacccccuggggcggagcccgaaggacccaggcguccggcccaaacggcucggagagggcggcgagcucagacuuggcguccuccgcagucccccgacucccaagcaccuggagccgccccagcccggcguucaagguccuugccgccgaguuccaaccuaaccucgcggcccgucuccuggggccggcuuggaggucuccgcugcgcccagugccucugcuccgcccgaaauaggccacgugcgcucccgccccggccugggccucucccuggcgccccgccuggagggcggacccuguugccuccucacuucuuccauucccucuuuaucuccucugccgucuuuucuccaucuuucucggcuucgccuauuccgcuggccucugggauauccuugaauacauccuaaccaauucaacauccacccaagcuaccgcugucgcg

SEQ ID NO: 15416 - RNA, 2259 nt, Homo sapiens
guuuuucaacaagguuucuuuuauuuauuuagcaagaaauuacucuuuauugaucaaaucaccaggaaucugccgcaaaagacuuaacaucuuaaugaccacugaggccugggcucugaggcuugcucugccucucccaguccuuaaugggguuuagagggagagacgucauuaacagagaccaagucagaugguugcagguccuccuuucccagucaucagacaaguugcucaauucuuguccagagcaggaaagagccaguacuucaguaaaauugaauaaagaauuugauguugcauuauaagaucucucuuaacaauuuagauuuaucaacaauauugguccaaaacucauuugcuucuaauuuuuuucauuuugcaauuuacuuuguguguguguuacuuuaauaaucucacucccugugcagaaauuaaucaaccccgugcaaagaaaaaucccucaaccuggaauagcuucaucuuacuuuggcaagagaaaacagagguauuuuugcuccucuucuacccaagugaugaacaaauauccccccaaaguucaaaauguuacucuggccucggaaugcauauaaagacugcuuuagaugggcugauuccaaucaccuagaaagggcagccggaaccacuaugcaggcagccuucuuuggaaauuucuuacaaucaacucuugagaaccauccgugauuguggacaauggcucuaagguccaaacaacuucuguucuuucaucucacgagcuaggcucagaggaggcauuugaacugucaggagcaagaacagcagcuguggccccacgaggcaggacuucaauaacucgcggcuugucaaugauccgggccguucgguuucccuuuuccacaaugccaacgauccacgcuuggugacccucuccguacuuggaggauuugauuucagaacaaaagcgagccgccuguucucuuggcagacaaaucaguaaucccccagagguuucagcugagguuccuugaagaagcccaaaccguccacuggccuugcugacggcagccaucuuggcaauuauuggcagauuaugaauaacaaaggacacuucauuucuuuguuguuuugcaagguucugggaguguccuagaaugccaaagccugugauaucuguggccgcaugggcauuaaaugugugcauuaaaccugcagcaguucuguugaggguagccauauugaacauggcuuccugauaggccagcuccaccucuucucuggagaccaccaucuuuacuuuauuccaucuuucaggauuauccagccauuggugggcauugacagcaaccuggguuccuaacgguuugguuaacaccagcacguccccaacgacggcgcuguccggcauuaugaacucauuugguuggcauacuacaguggcaacuccaccgauuauaauccaaggguugaccaccguuugcccaccggucacugccgucccuccuuccucagccgcaucccgaaagccuuugaccaugaguggcguuaccuuuucgcguuccuccucacucauacucuggcugacgcugaguaacaucaacauguugucacacucaguaauccccauggcguagaggucacucagcacguuggcacaagcuaugcgccccaucauguagggaucuucuaccaagggguaaaagaaguccguggucugcaccagugacaggcccccgugccucagggggaugacgcaggaguccaucccgaugcccagggcuggaaagguggggcuggggcccgcuccugccggcaggccggcuuccugggacgccucuuccuggccacccaccaggccccggcccagcgggggccgcacguccggccgcgucagucccgccaggaguuugagcagcgccuccugcgggaccuugcagccucagcccuucaugccggagaagcccgucagccgccagcucgggcugaggcccaacgccuggggcucgaagggccgguaguucgagaagcuccggcccagagucaagcccgccgggcccgaggagccuuccgccgcugccaucgccucuccgcaggcgcccgucgccgaggcuuccgccauggcgccugcccggcagggaagcgagaggagaagagggcccuuuuauuuuccacucagauuaauaugaagcaaaagucaaauauuaccugcagggauucucccuagcgcuacucaagccgucagacccacggcaugcacaaucuuccugauagaggagccgccgg

SEQ ID NO: 15417 - RNA, 2801 nt, Homo sapiens
gggggugcugggcggccguuggacagugcagcccagcccggggccgggguccagaaggugggggcucgggcgggagcgggggccgggggccgccgggguagucgcgaagccccucauccccgaggccgcgacgcgcgggggccagugagggccacggggaggccgagaccuugggagggggcggggccgcgggcaggggaggggcccggcgcgcuggagaggcgcggggucaagacguccggccucgggggcccgggcugggccgccgaguccccugggcggcgcugagcgggcgggaggcgggggcccgcggcucggggcaaccgaggccgggucgcgggaucggccgccaucgccgccgccgcugcacugggagcccgcggggauggagcgggaggcguugccguggggccucgagccccaggaugugcagaguucugacgaaaugaggagccccgaaggguaccucagaggugaggagggagcgcccguccgaggaguggacuugcgcgcaggagaaggggcuguggcuccagggagggagcgagggcccggggcugggacaccugggacucgaaggaggggccggcggggacuggggugucuugggucagcugaggggggcgugggaauuucagcacuugucuaggggccagcgacccugcaugugaggugggaggugugugguugcuaauggaccaaaugaccuuccaggucucacacgaucuggauucucucauccugcaggcaacaugagugagaaugaggaagaggaaauuucucagcaagaaggcaguggggacuaugaagucgaagagauaccauuugggcuugaaccccagagcccuggguuugagccacaaagcccagaguuugaaccccaaagccccagauuugagccugaaagcccgggguuugagucccgaagcccugggcuugugcccccaagcccugaguuugcacccagaagcccugaaucagauucucagagcccugaguuugaaucccagagcccuagguaugaaccccaaagcccuggcuaugaaccucggagccccggguaugaaccccggagcccuggcuaugaaucugagagcucuagauaugaaucccagaacacugagcucaaaacccaaagcccagaauuugaagcucaaaguuccaaauuccaggaaggugcggagaugcuucugaaccccgaggaaaagaguccuuugaauaucuccguaggaguucacccccuggacuccuucacucagggguuuggggagcagcccacaggggaccugcccauagggccaccuuuugagaugcccacaggggcccugcugucuacaccgcaguuugagaugcuucagaauccccugggucucacaggagcccuucgagguccaggucggcgggguggccgggccaggggugggcagggcccucggccuaacaucuguggcaucugcgggaagagcuucgggcggggcuccacccugauccagcaccagcgcauccacaccggugagaagcccuacaaaugugaggucugcagcaaggccuucucccagagcucugaccucaucaaacaccagcgcacccacacuggcgagcggcccuacaaauguccccguugcggcaaggccuucgccgacagcucuuaccugcuucgccaccagcgcacucacucuggccagaagcccuacaagugcccacauuguggcaaggccuucggcgacagcuccuaccuccugcgacaccagcgcacccacagccacgagcggcccuacagcugcaccgagugcggcaagugcuauagccagaacucgucccugcgcagccaucagagggugcacaccggucagaggcccuucagcuguggcaucugcggcaagagcuucucccagcggucggcccuuaucccccaugcccgcagccacgcccgggagaagcccuucaagugcccugagugcggcaagcgcuuuggccagagcucggugcuggccauccacgcccgcacccaccugccaggccgcaccuacagcugccccgacugcggcaagaccuucaaucgcuccuccacucucauccagcaccagcgcucccacacgggcgagcggcccuacaggugcgccgugugcggcaagggcuucugccgcuccuccacgcuucugcagcaucaccggguccacaguggcgagcggccuuacaagugcgaugacugcggaaaggccuucucccagagcuccgaccucauccgccaccagcggacccacgcggcgggccggcgcugaccuggggccccagcaggggugggaggugugggcagaagauaaggggccagggagcuagaggaaccuuuagggaggauaguggagaagccgcaggagaauggaggagcugaggaugcuggaagaagagaaccaggguggaggaagugacaugcccuggagacuugugggaaguggguuggagggaggccaggccggcagcgggaggcccugggagaaauggagagaggucagcggagggcuggccucagccgcggcuccuuggugggugccuggcuuggcaacugcuagagcagggaggggggagggcaggggauuaccuaauuagaguggguuagcuuagauugguagcugcugaaacucucguugagucaggagcggguaaaagguaggugggguggggaguggggccccgggguggggccugggccucugcgugcaaaccccagccucccucuucuuccucaggcuuuggagccccugaguuugaguucaauaaaaacuuuaugugguaaacgagac

SEQ ID NO: 15418 - RNA, 13104 nt, Homo sapiens
cacgcgcgugcgcgagacgccaggcugucugugggccgcgccgagcggcggaaaggcggcgaugacuuaacuggcuguggaacggaaccucuugcagccgcgcgccccccggcggccaaccgcccccaacgccucaggccccgcgucuccgccccucgccucgacgccaucaggagaccggccaauaaacaaacagcaggaagaggcggggcccuguaguaaccgccccaaacaccuacuucuaaccagucgagucacaagacuggggggaagggcggagccaauccgacguaacccaauccaagauuugagggcgguuacaugcacccacucccucggguuuggcuccgccccucaccuugacguagcccucccagccuaucaacgacugcgcccguugggggugaggggaagggggcggagcgugggaggaggccgagagaggaaggaggcguaggcugaggaggaagagggaggagggguagggaaguccuggcggagaagcgcccuaagacuccaaaggagacaacaggaguuugugcuggagcucccccgcugcccaucggccguuccggauccccuaaggcccaagucggacagagacggaggaaaggaggaagagacuuuuaugucggcggacaggggagcuguacccgucaccguugccucacauccggggcuuuggagggcuggccucgcugccccgccccgccucgcgccuuucauggcgaccggaggcggaggcuggaggagcugggcccggaggaggccccuuuaaaucuccuuaaagggguggccacugaacucggcggacugcaacgccagccuuaaaggggaagccgccgagcagacgcugacaaauugagaacugugccguugggagaacuggggcgagugggguuuuucuuuacguccuccucccccacacacaagaagucuuuuaaauucaacuuaaaggggaaguggccgcuuguggaggacuagaaacuaacuccgagcccuuaaagggacggccugcuguuagaaggacccuggacuccuuaaagggguggccucuuugagccggaggacuugagacacuuuuaaaggggaggucugcguuucggggcgagcuuucggccccuuuuaaagggguggcccuuccucuuccucggggagacuugcaucgaccccuggcaggggguggccaccgcacuaggccgccggacacugucgggucgucuuaaaggggccgggagcuggacaacuuggggccucgccuuaaagggacggccgccccguuuucgccgucgcggccccgccgagcccgcagggggggcccucgggcuugucgccccgggggcggcgccggcuccccgggccguggccuuggggcaagcucggggccagcagauccggcuuuaaaggagaagccguggcccucucgucacugugcagccgccagcgccgcgccugcgaccccgggccugcggacaggccgcuucgggccccgccgccuccggaugcggcgcugagggcggucgccauggagacggcagcggccgcggccccggguccgggcugggcagcagagggggagcgccgacggcggcgcugcucgcgccgagaccgagaccgggagcagcggcgccgccgagguccaggcggcgacgcgccccgggcccuguuggccgccccgcgcggcuccucguccucgucgucgccgccgccgcccgccaggccuuggucgucagcuucgucuggagagcggccugggggcccgagacgccggcggccccguccgagaccucgacccccgcgaccccgagcucggaagcggccugccggcucgggcagccgcggggaggaagaggaggaggaggaggaggaggggggcgcagacgacggcgaagccgaggaggagccugaggaggaggaagaggaggaggaggacuugaucgauggcuucgccaucgccagcuucgccacccucgaggccuugcagguggggccuaauggggcuaggagacuuuggggguuuccgaggggcagcaaggagggggcagugccccuaguggguggaguugaggggggaaugcuggcaccccaaaccagagcaaccggcuccucuggccaggccucugccccgcccuggggugggaggagguagagcucgucucuggggacccgguuucccggcccgagggguacuucggcaaccuggucaccccuagagggguugggagcuugcccuuuuccaucuaucucagccccaccuccuccuccacagaaggaugcaucucuucagcccccagagcgacuggaacaucggcugaagcauucugggaagcggaaaagggggggcuccaguggggccaccggggagccaggggacagcucugaucgagagccuggccggcccccuggggaucgggcccgaaaauggcccaauaagcggagaagaaaagaggugagguugucccuuaaaacucuuuaggcagaauguauuucccacagccccguuuuucaucagcaacgccacugccccuuguaaacagagaccccaguuucuaagggcaaagaggcaagcagggcaaauuugagcccuuacucauccgggucugacgaaggccugucuacagucaggugcaccuccuuuugccugguucugugucuacuucaaacguuuugauaauucagagaggcgucaaaggaauauaguugggucguaaauuaauugugguuccugcccuuccucgaggugguggcaguccagcagaaaagaaauagccagcaagcaaacaccuagaccuuaauuugagaagcuacagaagacaaagauggggagagaugcuacagaaacccacaugaggaagccgcuugugcugccugggggaugggaggagaguugugguuggggaaagcccccuaggaugucuuagucagguccugaaguauagucagaaguuugcuaagaaaagacacggggaaaaguuguuuugggcaagagcaugaagacgugaggacccggcguauuuagagaauggugagagcacugggacccgggugggcaguggcgggagaagcagcuggaaggagaggcugagaguagauccuggaggcccaugagcgcccugcugggagcugcgacuuucccagcugccucagcagccgccucccucaccucuggacucuggucuuccucaggcguccucccgucacucucuggaagcuggauacauaguaagugcuauccaccuguccuggccccucccugcuccacccugggccucuucccucucgugacaccucugucuuuccuucuccccagugugacgcggaaagugaucuggacgagagggugaguggggcuagagcuugggugggcagugucacugcuuguaaaagggacugcagcauaaaggucuucugcgugcagcagacagccuucccuugagugagaaacauggcuuagguugagucaggauuagguuuuugggaggaacggggguggauugggaggguaaauggcgucauuuuuucuuuuggugacuagggguuagcugaccaaggaauggaggguccaugcuuuggcauacuauccuuuccaaagcccuugagcuacuucugguucuccacggaaacccagaguggcuguggcacugagaugggccuucuucccaucuuagaaugaagaucuagauucaagucugagcagagaccgcagauagaguagugaggacacuaaaucauuguagucaguguagggacucagcccauaaagguguauuugaguuuauccuuaggggcgauuugcuuguugugagauaguauguccuagaaguuaaugcgcuacccauugggcccauguaaguaacucaauuugcacucccugaugugugucuuguuuuuguuucaaaaguuggcuggauaggacuguggugaaccagaggguucuugucaauuuccgucauccaucucuaucugucuaggcugauuguugcuacgagaacagggggcccauucuugaggcaaucugcaagccugaguuuuaaugaggaaucuccggauucuuaaauaucugcaguugguuuaaaacuuuuaccaacgcugguggaccaaauaaaucuguaagcgagggaggccugugggccagcagcuagugaccucugacguuuugguuugguuugccugcuucucugcugcuucaacgcugccuccauuuaguccucuuggccuaucggauucuuggggucagcugcuccacucugcuuuuucuccaagcucagcccccuagagcccagucuuugauggaucucagcuaaacugaaggaacagacuugccacuaccaccaguuccuagcagccuccagaggcuauuuggccuuccuggguggaggccuggcccacccacaaccuaacucuaucccuugcccuucuuccccaggucuccgaugaugaccucgacccauccuuuacugucucaaccagcaaagguuggucccaaggucuggggcuggaggcacgggagggcaguggggugagcaugagccucaacugagcaugucugccauccugccccacagccucgggcccccacggcgccuucaaugggaacugugaagcaaaacucuccguggucccuaaagugucgggccuggagcggagccaagaacagcccccggggcccgacccgcugcuagugccuuuccccccaaaggaaccaccgccuccaccggucccucggccuccugucucacccccugcaccccugccggccacucccagucugccacccccaccccagccccagcugcagcuucgggucucacccuucggccuccgcacuucuccauauggcagcagccuggaccucagcacuggcaggugaguggucuugggggauugaugcgguccggaagggccuggucaguuugguggcggggacacaggaugguaccugugggguaugacuugaaaaaggauucugagacugaaaaguuugagaaaaacaaauggaaagagaugacugcaggacuuauuugaguccguuacacauucccaugcaggggaauccaggcugugcuguuucccaguuguguuugcuggugagaacguuuuuucaggcaggcaagucugcucggaauaguguucuuuggaacauacuuugggaaaugcugacaugaugguuaagagcgcuggcuuuggugucagacccagauucaaauucuugcucugacgcuuccuggcugugugauuuuugacaagucacuuaaccccucugagccucgauuuccucuuucugucaaauggaaugaucauaguacuuucaucuuaaagcuguugugaggauuaacuacgagugaaugcaguguuucccaaaguguguacauucagcgucagugauauaugggaugauuucaggucuuacgugaguaaacuuuaaaaaauaguccugaguuagcuuuugugaacuuuagaaagcugagugucaugccucagccccuugauuucacacgcgauugcuuagggggaggcuaaguuaaaaaaaaaaaaaaggaaauugaguucuuaaaagaagccauugaugcaguucagaugguuacuuugcugggcagcaguggggaagguggcguggaauguuggagacuuggauuagcuuuuaaagcaggugccagcacuuggccuacagcaggugcuugccacaggguaagaacuauugacacuuacuauugaugcucuauuuugucaccgucauugucauuguuauuauugagaaaacuaaggcucagagaggggcagugacuugcucaaggucaccccgggcauucauggcaagaugggccuagaauucaggucuccugacucccaggccaggccaguguggugcugcuuccacuguuguagggugggaccccagguggcuuguucuaauuaagcgucaacaugaaugaucuguucugugcugugguugagucagaaagggaaagucaucuggccagagauggcagaggcagcugcguggaugcagagaccuagacagggagaaauagggguugcugggugugggaggcgccucagucugagaacggauucccucgguggggggcgguccuggggcuggguucugccaccucccguguuggagaaccagggucacgguaucacccaggcuucugacccccucccgucagagcuggcaccucccaaccccucacucaucuccccacuucucuccccagcucuucacggccgccccccaaggccccggccccucccguggcucagccuccccccucaucauccucuucguccuccuccuccucaucugccuccuccucguccgcgcagcucacccaccggcccccgacgcccucacugccccugccuuuguccacccacagcuuucccccucccgggcugcggccccccccaccaccccaccaccccuccuuguucuccccuggccccacccugcccccacccccaccccugcugcaggugccagggcacccuggggccucagccgcuaacgcccuuucuggugaguuugggguccuggccgggggguggggggccaucaccccgggcucgggcccaguuggcuuuggggcaccugagccucagcagacagcagggcuugaggagggaguggcucgaggccagagggaaggcagucaccugggcccaaggaggcugauguggcgacagcauuaaagccuucucccguccccucccacagagcaggaccugaucggccaggaccugaacucucgcuaccugaaugcccaggguggcccugagguggugggggcagggggcucggcccggccccuggccuuccaguuccaccagcacaaccaccagcaccagcacacccaccagcacacccaccagcacuucaccccuuaucccccgggccugcugccaccccacggcccccacauggugagcuccucauugggcuggcgaugaggcucggaggccucuggggagggcauggcuucugggggaaggcccgggucccuggcuggcagcuuacucuucccuucucuucccuaguuugagaaauauccaggaaagauggaaggccuuuuccgacauaaugugagugugugugugcgugugcguaugggguguguggugugggcguggaugcauccaugcuugugacccugacugcugggguccagucuucagcacaaaagcaagagccuugagccugggacagcucccuggggggcuuuaggguggaggcccguggacugacgggcaggcuggacuugggcugcgccuccacccccaccuguacuagucccccuucucuccacagccguacacggccuucccucccgcagugcccgggcugccuccgggccucccgccggccgucuccuuuggcucccugcagggggccuuccagcccaaggugagcucccaauccagacaccaccaccgccuaccaucuugacaaacccagacacgccggguccaagcacccuucucccauuccccaaagucgugcccauccuccugcccugcccugcugcacccaguuuucuccaaagccaugaucccucccugcccagugucccagcuugguucuggaucccuuugugcuuggugccagcucuccugucugaucccuccacuccccuuucccagagcacgaacccugagcugccaccacgacuggggccggugccgagcgggcucucccagaaggggacacaggugagggggccagggcagguccugggggagcuggaagguguguugcggggagaacagaacugacuugaggagagugaacugcugauuccucccuugaauucacaaucggguguuccugggugucuaauagagagggaauuucuguaaauagcuggcuuucccaggcaugaggaaugagaguuucaugagcuugucccagaaauaggaugauuaggacaaugguuuuuguagugguuuucaaacuuuuuaauaaaguuacaaaacacuuuuuuuccaaaugacaucauaccaggaagcccuguucggaaaacaaaagauaagcugccccuuggugaagugaggagagccagagccucccuccccuuagcacuugcagcaguguagaccccagggcugcgggaacguugugaaacgcacaggaccaguuuccuacagggaagacuaggccagagguuuuccaacuuccuucaaaggcauuuucccuaaauaaaucuuaaacagaccgcuauacucuaaaguugguaauaggagagcuucucugagaaaccuguccugccugcccccucaccacccgcagccuuccagcagggcagcucccuggggcuugguucagaaaccuugugcuggaggagagaugccuagacugggagagauggggaaaggaguuugggccugagcaggaaggguuugagggagucccagugucucaggcauguugggggugaguggaugcuguggagaugcgaggcgccuggcccaggacucgggucugagucgccucccaucucuccuuugccauccccagauccccgaccauuuccggccaccuuugagggugaguugugugaggaccucaggcugcaugaggcugggggcugguguuagcauguuuggcuaagggggguuuugcuuacaaauaagugagaagcccagaacauggaggcagccagauguggaacagcagagagugagggcuuucaaguugcagaccugggcucggauggaacuggccaugggaccuugggcaaggcaguugaucucucugagccucaguuuccuaggcuguaaaaugaaccuagucaucccuugguuguaggaaugaugaguagggauauuuuguggcgaggcugggcccagagccaggccuggaguggaugaugagugaacguucuuuccuucccuuucccuuuggucauccuucuggggcggcagaaaccagggaaguggugugccaugcacgugcguguggcuuacaugauccugagacaccaggagaaaaugaagguacuggggccggagggcuggggagagugggucucagagucaggggaggacugagcucugggcauuggcccucaacagagcucagcagaaucuuggccagaaacauucucuccugucccccaucacugcugaacaguucuauggcuggcaccuuaguucucuggcucauuagggggcugcucagagaaggcuccgagagaggcagaagauaggcauccaggccccaucugggugccagccagccuuuggaggggaaccacgggugagagagcaagagggggaccagacuggcuccucauguacugccccucucccugugucccacacagggugacucccacaagcuugacuuucggaaugaccuccugcccugccuuccggggcccuauggggcccugcccccugggcaggagcucucccacccggccucccucuucacugcgacuggugagucuggccagcccccucgggccugagguucccugucuauagccugaggcccagcuugugcccacucagccucaucagaaucucccaccucucugccccaggugccguccacgcugcagccaacccuuucacggcagcucccggggcccacggacccuuccugagccccagcacccacauugguaagagccaagggcguguugggcaacccaggcuuugucccugacuuccaggagauggaaaucagacccagcaggcagcuggaaugcaggauagaccugguuccacuugcuuagugaccuugggcagguuacucuacccccucugagccuugauuuccucaucuguaaaaugaguagggaagggcagggugacuucagucucugccagcuggagcccugucucccaguagccaguggcaggggcaguacgccaccuggaaggggaagguggggaggccaugcuggcccaggggagagcauggccacugacuccuaggaucuuggcaggcuucuuggggagguuucaccuggguuuggguggacaaggaagaguugagccugguggcuuggagaaagguguuccuggcuggggacguggugacauuccaguggcgggauagguuaguuguucugucuggcugugugacgcaugcaugaaguuagggucaggucgggaagggcccugcaugucagguggggggaagccaacaaggucuucaggcuugcugcggagcggagaucugcugugauggguccaggcggcugguguuggggaguuggggagaagagcgugacuucaugucaaggaagcccuggguugguaccgcucccuggcuagaugaccaccagcaagucauuucaccucucugagccucucuguuuuaucaucuucaagugggcaugauccuaaccaccucuugggcuuuuugugagguuaaccgacagggugcuugucaaagcucaacaccuuccuggcccaaggaagugcucagcacauggcugcugaaagcaggcagcugaggacuccaggcaccgguccugccucugcccagccaggccuggugccugcucagcaccggcugcccagugcucugaccaccccccuuuccucccacagaucccuuugggcgucccacaagcuucgccucuuuggcugcccucuccaacggggccuuuggaggccugggcagccccacauucagugagugcgggugcgguggggugggggggcugcggccacagggugagagcucagacggucugggaggaggccugaacagggccucccacuucuggccccugucacucucugcuucacccucugcccagacuccggcgccgucuuugcccagaaagaaagcccaggggccccaccagccuucgccuccccaccggacccauggggccgccugcaccgcaguccucugaccuuuccugccuggguccggcccccugaggccgcccggacuccaggcucagacaaggagcggccuguggagcggagggagcccuccaucaccaaggaggagaaggacaggugugccucccacccacccugccccugccccacccucagccccugcugccccuggagaacuucauucucuccccacgccugcccuccagggaccuccccuucucacggccccagcuccgaguuucuccugcuacucccaaggcccgggcuggugaggaggggccucggccaaccaaggaaucugugcggguaaaggaagagcggaaggaggaggcugccgccgccgcugccgcugcugcugccgccgccgcugccgccgccgcagcagccacugggccccagggccuucaccugcuguuugagaggccccggccgcccccguuucugggcccuagcccaccagaucgcugugcuggcuuccuggagccaaccugguuggcagcacccccacgccuggcaaggccaccccgcuucuaugaggcgggugaggagcuaacuggacccggggccguggccgcugcccgccucuacggucuggaaccugcucaccccuugcucuacagccgcuuggcuccuccaccaccaccugcugcggccccgggaaccccucaccuucucagcaagaccccaccgggagcccuuuugggggcaccaccuccgcuugugcccgccccccggcccaguuccccaccuaggggcccuggcccagcucgggcugacaggugaggggaacgggggggggucggggcaaagcuccaucuccccuuccuuuaaccagguccuagggcugagguuuuaagccagggcuggagggcaaaggucauaaccucaccagccaccucugaggucauggaaccugggaacagaagccucaacccccacaagaccaagcaucacauggaguguagggucacugggagagcagaggucacagccucuagagaagggagaggggcgugugcaugggaguguggcucaucucgggggccauggggccuccugagguacaccuuugccccuguaagggccucuaggcccugggccugccuccccaagggcucacuaagccagaggccaaagugcccccucccguucaccuaccacccaaguccucaugcccuccgagggcugggggaggaggggcucaaggaagggggguuccauguacauauuuaucaccccuuucacauagccccaagaccuuuuguacauuuuuacaggggugccccucccaacaguucccuuccugguuaauuaaacccucagacuggugcuguguuccuagccucuggccucucuguggggaaaggggacugcagggggaagagccgggaagggacagucaggcuucucccugggaagguggggccagcaggagaugaccaacagggggcaggaccuggggaccugggcuggagggaagggcagaagcuuccuacuuggcugacagccccgguucccccaacauguucccguucacucugcccccacccccaaaggcucagccucuaaaucucagacuccaccaccucuuaauggcucaguccccuucaccccauuuccaagugcccccaggacuccugggcccugcuucccugaacccuguucuccaaaacccugccccaggcuaaggguggccagagaaggucaccauguaccacacaccaaagaagggggucggcccaggggugggcgacacaggcagcuucuucggcagccucacggcagcaaccccagccuucccaaagcagcaggcgccuccaggcuggggcccaaccuagaaggcaggggucaaucuaacaaaacccuaacguugacuuuuuucccugguggggcuucuucuguaacaugacuugcgaauauuuauauaaaaacgaguguuacaaugagacccccggcuccucuuugagugugugugggguggguuggaccagggugggguguguggguccugggguaagggagggaugaggacaguacuguccguaucccgccaagguuuuccucccugccauccacugggcaaguuggucugccauuucuggagggauggguucgaggguugggcacugaaguuuuucacacuguuuuucuauaauccaggaauacauaguauguaggauucaagcaacccaguaagacacugagcaaaacauuaaauuucuccuucaccugcca

SEQ ID NO: 15419 - RNA, 13104 nt, Homo sapiens
uggcaggugaaggagaaauuuaauguuuugcucagugucuuacuggguugcuugaauccuacauacuauguauuccuggauuauagaaaaacagugugaaaaacuucagugcccaacccucgaacccaucccuccagaaauggcagaccaacuugcccaguggauggcagggaggaaaaccuuggcgggauacggacaguacuguccucaucccucccuuaccccaggacccacacaccccacccugguccaacccaccccacacacacucaaagaggagccgggggucucauuguaacacucguuuuuauauaaauauucgcaagucauguuacagaagaagccccaccagggaaaaaagucaacguuaggguuuuguuagauugaccccugccuucuagguugggccccagccuggaggcgccugcugcuuugggaaggcugggguugcugccgugaggcugccgaagaagcugccugugucgcccaccccugggccgacccccuucuuuggugugugguacauggugaccuucucuggccacccuuagccuggggcaggguuuuggagaacaggguucagggaagcagggcccaggaguccugggggcacuuggaaauggggugaaggggacugagccauuaagaggugguggagucugagauuuagaggcugagccuuugggggugggggcagagugaacgggaacauguugggggaaccggggcugucagccaaguaggaagcuucugcccuucccuccagcccagguccccagguccugcccccuguuggucaucuccugcuggccccaccuucccagggagaagccugacugucccuucccggcucuucccccugcaguccccuuuccccacagagaggccagaggcuaggaacacagcaccagucugaggguuuaauuaaccaggaagggaacuguugggaggggcaccccuguaaaaauguacaaaaggucuuggggcuaugugaaaggggugauaaauauguacauggaaccccccuuccuugagccccuccucccccagcccucggagggcaugaggacuugggugguaggugaacgggagggggcacuuuggccucuggcuuagugagcccuuggggaggcaggcccagggccuagaggcccuuacaggggcaaagguguaccucaggaggccccauggcccccgagaugagccacacucccaugcacacgccccucucccuucucuagaggcugugaccucugcucucccagugacccuacacuccaugugaugcuuggucuuguggggguugaggcuucuguucccagguuccaugaccucagagguggcuggugagguuaugaccuuugcccuccagcccuggcuuaaaaccucagcccuaggaccugguuaaaggaaggggagauggagcuuugccccgacccccccccguuccccucaccugucagcccgagcugggccagggccccuagguggggaacugggccggggggcgggcacaagcggagguggugcccccaaaagggcucccgguggggucuugcugagaaggugagggguucccggggccgcagcagguggugguggaggagccaagcggcuguagagcaaggggugagcagguuccagaccguagaggcgggcagcggccacggccccggguccaguuagcuccucacccgccucauagaagcgggguggccuugccaggcgugggggugcugccaaccagguuggcuccaggaagccagcacagcgaucuggugggcuagggcccagaaacgggggcggccggggccucucaaacagcaggugaaggcccuggggcccaguggcugcugcggcggcggcagcggcggcggcagcagcagcggcagcggcggcggcagccuccuccuuccgcucuuccuuuacccgcacagauuccuugguuggccgaggccccuccucaccagcccgggccuugggaguagcaggagaaacucggagcuggggccgugagaaggggaggucccuggagggcaggcguggggagagaaugaaguucuccaggggcagcaggggcugaggguggggcaggggcagggugggugggaggcacaccuguccuucuccuccuuggugauggagggcucccuccgcuccacaggccgcuccuugucugagccuggaguccgggcggccucagggggccggacccaggcaggaaaggucagaggacugcggugcaggcggccccauggguccgguggggaggcgaaggcugguggggccccugggcuuucuuucugggcaaagacggcgccggagucugggcagagggugaagcagagagugacaggggccagaagugggaggcccuguucaggccuccucccagaccgucugagcucucacccuguggccgcagcccccccaccccaccgcacccgcacucacugaauguggggcugcccaggccuccaaaggccccguuggagagggcagccaaagaggcgaagcuugugggacgcccaaagggaucugugggaggaaagggggguggucagagcacugggcagccggugcugagcaggcaccaggccuggcugggcagaggcaggaccggugccuggaguccucagcugccugcuuucagcagccaugugcugagcacuuccuugggccaggaagguguugagcuuugacaagcacccugucgguuaaccucacaaaaagcccaagaggugguuaggaucaugcccacuugaagaugauaaaacagagaggcucagagaggugaaaugacuugcugguggucaucuagccagggagcgguaccaacccagggcuuccuugacaugaagucacgcucuucuccccaacuccccaacaccagccgccuggacccaucacagcagaucuccgcuccgcagcaagccugaagaccuuguuggcuuccccccaccugacaugcagggcccuucccgaccugacccuaacuucaugcaugcgucacacagccagacagaacaacuaaccuaucccgccacuggaaugucaccacguccccagccaggaacaccuuucuccaagccaccaggcucaacucuuccuuguccacccaaacccaggugaaaccuccccaagaagccugccaagauccuaggagucaguggccaugcucuccccugggccagcauggccuccccaccuuccccuuccagguggcguacugccccugccacuggcuacugggagacagggcuccagcuggcagagacugaagucacccugcccuucccuacucauuuuacagaugaggaaaucaaggcucagaggggguagaguaaccugcccaaggucacuaagcaaguggaaccaggucuauccugcauuccagcugccugcugggucugauuuccaucuccuggaagucagggacaaagccuggguugcccaacacgcccuuggcucuuaccaaugugggugcuggggcucaggaaggguccgugggccccgggagcugccgugaaaggguuggcugcagcguggacggcaccuggggcagagaggugggagauucugaugaggcugagugggcacaagcugggccucaggcuauagacagggaaccucaggcccgagggggcuggccagacucaccagucgcagugaagagggaggccgggugggagagcuccugcccagggggcagggccccauagggccccggaaggcagggcaggaggucauuccgaaagucaagcuugugggagucacccugugugggacacagggagaggggcaguacaugaggagccagucuggucccccucuugcucucucacccgugguuccccuccaaaggcuggcuggcacccagauggggccuggaugccuaucuucugccucucucggagccuucucugagcagcccccuaaugagccagagaacuaaggugccagccauagaacuguucagcagugaugggggacaggagagaauguuucuggccaagauucugcugagcucuguugagggccaaugcccagagcucaguccuccccugacucugagacccacucuccccagcccuccggccccaguaccuucauuuucuccuggugucucaggaucauguaagccacacgcacgugcauggcacaccacuucccugguuucugccgccccagaaggaugaccaaagggaaagggaaggaaagaacguucacucaucauccacuccaggccuggcucugggcccagccucgccacaaaauaucccuacucaucauuccuacaaccaagggaugacuagguucauuuuacagccuaggaaacugaggcucagagagaucaacugccuugcccaaggucccauggccaguuccauccgagcccaggucugcaacuugaaagcccucacucucugcuguuccacaucuggcugccuccauguucugggcuucucacuuauuuguaagcaaaaccccccuuagccaaacaugcuaacaccagcccccagccucaugcagccugagguccucacacaacucacccucaaagguggccggaaauggucggggaucuggggauggcaaaggagagaugggaggcgacucagacccgaguccugggccaggcgccucgcaucuccacagcauccacucacccccaacaugccugagacacugggacucccucaaacccuuccugcucaggcccaaacuccuuuccccaucucucccagucuaggcaucucuccuccagcacaagguuucugaaccaagccccagggagcugcccugcuggaaggcugcggguggugagggggcaggcaggacagguuucucagagaagcucuccuauuaccaacuuuagaguauagcggucuguuuaagauuuauuuagggaaaaugccuuugaaggaaguuggaaaaccucuggccuagucuucccuguaggaaacugguccugugcguuucacaacguucccgcagcccuggggucuacacugcugcaagugcuaaggggagggaggcucuggcucuccucacuucaccaaggggcagcuuaucuuuuguuuuccgaacagggcuuccugguaugaugucauuuggaaaaaaaguguuuuguaacuuuauuaaaaaguuugaaaaccacuacaaaaaccauuguccuaaucauccuauuucugggacaagcucaugaaacucucauuccucaugccugggaaagccagcuauuuacagaaauucccucucuauuagacacccaggaacacccgauugugaauucaagggaggaaucagcaguucacucuccucaagucaguucuguucuccccgcaacacaccuuccagcucccccaggaccugcccuggcccccucaccuguguccccuucugggagagcccgcucggcaccggccccagucgugguggcagcucaggguucgugcucugggaaaggggaguggagggaucagacaggagagcuggcaccaagcacaaagggauccagaaccaagcugggacacugggcagggagggaucauggcuuuggagaaaacugggugcagcagggcagggcaggaggaugggcacgacuuuggggaaugggagaagggugcuuggacccggcgugucuggguuugucaagaugguaggcggugguggugucuggauugggagcucaccuugggcuggaaggcccccugcagggagccaaaggagacggccggcgggaggcccggaggcagcccgggcacugcgggagggaaggccguguacggcuguggagagaagggggacuaguacagguggggguggaggcgcagcccaaguccagccugcccgucaguccacgggccuccacccuaaagccccccagggagcugucccaggcucaaggcucuugcuuuugugcugaagacuggaccccagcagucagggucacaagcauggaugcauccacgcccacaccacacaccccauacgcacacgcacacacacacucacauuaugucggaaaaggccuuccaucuuuccuggauauuucucaaacuagggaagagaagggaagaguaagcugccagccagggacccgggccuucccccagaagccaugcccuccccagaggccuccgagccucaucgccagcccaaugaggagcucaccaugugggggccgugggguggcagcaggcccgggggauaaggggugaagugcuggugggugugcuggugggugugcuggugcuggugguugugcugguggaacuggaaggccaggggccgggccgagcccccugcccccaccaccucagggccacccugggcauucagguagcgagaguucagguccuggccgaucagguccugcucugugggaggggacgggagaaggcuuuaaugcugucgccacaucagccuccuugggcccaggugacugccuucccucuggccucgagccacucccuccucaagcccugcugucugcugaggcucaggugccccaaagccaacugggcccgagcccggggugauggccccccaccccccggccaggaccccaaacucaccagaaagggcguuagcggcugaggccccagggugcccuggcaccugcagcaggggugggggugggggcaggguggggccaggggagaacaaggaggggugguggggugguggggggggccgcagcccgggagggggaaagcuguggguggacaaaggcaggggcagugagggcgucgggggccggugggugagcugcgcggacgaggaggaggcagaugaggaggaggaggacgaagaggaugaugaggggggaggcugagccacgggaggggccggggccuuggggggcggccgugaagagcuggggagagaaguggggagaugagugagggguugggaggugccagcucugacgggagggggucagaagccugggugauaccgugacccugguucuccaacacgggagguggcagaacccagccccaggaccgccccccaccgagggaauccguucucagacugaggcgccucccacacccagcaaccccuauuucucccugucuaggucucugcauccacgcagcugccucugccaucucuggccagaugacuuucccuuucugacucaaccacagcacagaacagaucauucauguugacgcuuaauuagaacaagccaccuggggucccacccuacaacaguggaagcagcaccacacuggccuggccugggagucaggagaccugaauucuaggcccaucuugccaugaaugcccggggugaccuugagcaagucacugccccucucugagccuuaguuuucucaauaauaacaaugacaaugacggugacaaaauagagcaucaauaguaagugucaauaguucuuacccuguggcaagcaccugcuguaggccaagugcuggcaccugcuuuaaaagcuaauccaagucuccaacauuccacgccaccuuccccacugcugcccagcaaaguaaccaucugaacugcaucaauggcuucuuuuaagaacucaauuuccuuuuuuuuuuuuuuaacuuagccucccccuaagcaaucgcgugugaaaucaaggggcugaggcaugacacucagcuuucuaaaguucacaaaagcuaacucaggacuauuuuuuaaaguuuacucacguaagaccugaaaucaucccauauaucacugacgcugaauguacacacuuugggaaacacugcauucacucguaguuaauccucacaacagcuuuaagaugaaaguacuaugaucauuccauuugacagaaagaggaaaucgaggcucagagggguuaagugacuugucaaaaaucacacagccaggaagcgucagagcaagaauuugaaucugggucugacaccaaagccagcgcucuuaaccaucaugucagcauuucccaaaguauguuccaaagaacacuauuccgagcagacuugccugccugaaaaaacguucucaccagcaaacacaacugggaaacagcacagccuggauuccccugcaugggaauguguaacggacucaaauaaguccugcagucaucucuuuccauuuguuuuucucaaacuuuucagucucagaauccuuuuucaagucauaccccacagguaccauccuguguccccgccaccaaacugaccaggcccuuccggaccgcaucaaucccccaagaccacucaccugccagugcugagguccaggcugcugccauauggagaagugcggaggccgaagggugagacccgaagcugcagcuggggcugggguggggguggcagacugggaguggccggcaggggugcagggggugagacaggaggccgagggaccgguggaggcggugguuccuuuggggggaaaggcacuagcagcgggucgggccccgggggcuguucuuggcuccgcuccaggcccgacacuuuagggaccacggagaguuuugcuucacaguucccauugaaggcgccgugggggcccgaggcuguggggcaggauggcagacaugcucaguugaggcucaugcucaccccacugcccucccgugccuccagccccagaccuugggaccaaccuuugcugguugagacaguaaaggaugggucgaggucaucaucggagaccuggggaagaagggcaagggauagaguuagguugugggugggccaggccuccacccaggaaggccaaauagccucuggaggcugcuaggaacuggugguaguggcaagucuguuccuucaguuuagcugagauccaucaaagacugggcucuagggggcugagcuuggagaaaaagcagaguggagcagcugaccccaagaauccgauaggccaagaggacuaaauggaggcagcguugaagcagcagagaagcaggcaaaccaaaccaaaacgucagaggucacuagcugcuggcccacaggccucccucgcuuacagauuuauuugguccaccagcguugguaaaaguuuuaaaccaacugcagauauuuaagaauccggagauuccucauuaaaacucaggcuugcagauugccucaagaaugggcccccuguucucguagcaacaaucagccuagacagauagagauggaugacggaaauugacaagaacccucugguucaccacaguccuauccagccaacuuuugaaacaaaaacaagacacacaucagggagugcaaauugaguuacuuacaugggcccaauggguagcgcauuaacuucuaggacauacuaucucacaacaagcaaaucgccccuaaggauaaacucaaauacaccuuuaugggcugagucccuacacugacuacaaugauuuaguguccucacuacucuaucugcggucucugcucagacuugaaucuagaucuucauucuaagaugggaagaaggcccaucucagugccacagccacucuggguuuccguggagaaccagaaguagcucaagggcuuuggaaaggauaguaugccaaagcauggacccuccauuccuuggucagcuaaccccuagucaccaaaagaaaaaaugacgccauuuacccucccaauccacccccguuccucccaaaaaccuaauccugacucaaccuaagccauguuucucacucaagggaaggcugucugcugcacgcagaagaccuuuaugcugcagucccuuuuacaagcagugacacugcccacccaagcucuagccccacucacccucucguccagaucacuuuccgcgucacacuggggagaaggaaagacagaggugucacgagagggaagaggcccaggguggagcagggaggggccaggacagguggauagcacuuacuauguauccagcuuccagagagugacgggaggacgccugaggaagaccagaguccagaggugagggaggcggcugcugaggcagcugggaaagucgcagcucccagcagggcgcucaugggccuccaggaucuacucucagccucuccuuccagcugcuucucccgccacugcccacccgggucccagugcucucaccauucucuaaauacgccggguccucacgucuucaugcucuugcccaaaacaacuuuuccccgugucuuuucuuagcaaacuucugacuauacuucaggaccugacuaagacauccuagggggcuuuccccaaccacaacucuccucccaucccccaggcagcacaagcggcuuccucauguggguuucuguagcaucucuccccaucuuugucuucuguagcuucucaaauuaaggucuagguguuugcuugcuggcuauuucuuuucugcuggacugccaccaccucgaggaagggcaggaaccacaauuaauuuacgacccaacuauauuccuuugacgccucucugaauuaucaaaacguuugaaguagacacagaaccaggcaaaaggaggugcaccugacuguagacaggccuucgucagacccggaugaguaagggcucaaauuugcccugcuugccucuuugcccuuagaaacuggggucucuguuuacaaggggcaguggcguugcugaugaaaaacggggcugugggaaauacauucugccuaaagaguuuuaagggacaaccucaccucuuuucuucuccgcuuauugggccauuuucgggcccgauccccagggggccggccaggcucucgaucagagcuguccccuggcuccccgguggccccacuggagcccccccuuuuccgcuucccagaaugcuucagccgauguuccagucgcucugggggcugaagagaugcauccuucuguggaggaggagguggggcugagauagauggaaaagggcaagcucccaaccccucuaggggugaccagguugccgaaguaccccucgggccgggaaaccggguccccagagacgagcucuaccuccucccaccccagggcggggcagaggccuggccagaggagccgguugcucugguuuggggugccagcauuccccccucaacuccacccacuaggggcacugcccccuccuugcugccccucggaaacccccaaagucuccuagccccauuaggccccaccugcaaggccucgaggguggcgaagcuggcgauggcgaagccaucgaucaaguccuccuccuccucuuccuccuccucaggcuccuccucggcuucgccgucgucugcgccccccuccuccuccuccuccuccucuuccuccccgcggcugcccgagccggcaggccgcuuccgagcucggggucgcgggggucgaggucucggacggggccgccggcgucucgggcccccaggccgcucuccagacgaagcugacgaccaaggccuggcgggcggcggcggcgacgacgaggacgaggagccgcgcggggcggccaacagggcccggggcgcgucgccgccuggaccucggcggcgccgcugcucccggucucggucucggcgcgagcagcgccgccgucggcgcucccccucugcugcccagcccggacccggggccgcggccgcugccgucuccauggcgaccgcccucagcgccgcauccggaggcggcggggcccgaagcggccuguccgcaggcccggggucgcaggcgcggcgcuggcggcugcacagugacgagagggccacggcuucuccuuuaaagccggaucugcuggccccgagcuugccccaaggccacggcccggggagccggcgccgcccccggggcgacaagcccgagggcccccccugcgggcucggcggggccgcgacggcgaaaacggggcggccgucccuuuaaggcgaggccccaaguuguccagcucccggccccuuuaagacgacccgacaguguccggcggccuagugcgguggccacccccugccaggggucgaugcaagucuccccgaggaagaggaagggccaccccuuuaaaaggggccgaaagcucgccccgaaacgcagaccuccccuuuaaaagugucucaaguccuccggcucaaagaggccaccccuuuaaggaguccaggguccuucuaacagcaggccgucccuuuaagggcucggaguuaguuucuaguccuccacaagcggccacuuccccuuuaaguugaauuuaaaagacuucuugugugugggggaggaggacguaaagaaaaaccccacucgccccaguucucccaacggcacaguucucaauuugucagcgucugcucggcggcuuccccuuuaaggcuggcguugcaguccgccgaguucaguggccaccccuuuaaggagauuuaaaggggccuccuccgggcccagcuccuccagccuccgccuccggucgccaugaaaggcgcgaggcggggcggggcagcgaggccagcccuccaaagccccggaugugaggcaacggugacggguacagcuccccuguccgccgacauaaaagucucuuccuccuuuccuccgucucuguccgacuugggccuuaggggauccggaacggccgaugggcagcgggggagcuccagcacaaacuccuguugucuccuuuggagucuuagggcgcuucuccgccaggacuucccuaccccuccucccucuuccuccucagccuacgccuccuuccucucucggccuccucccacgcuccgcccccuuccccucacccccaacgggcgcagucguugauaggcugggagggcuacgucaaggugaggggcggagccaaacccgagggagugggugcauguaaccgcccucaaaucuuggauuggguuacgucggauuggcuccgcccuuccccccagucuugugacucgacugguuagaaguagguguuuggggcgguuacuacagggccccgccucuuccugcuguuuguuuauuggccggucuccugauggcgucgaggcgaggggcggagacgcggggccugaggcguugggggcgguuggccgccggggggcgcgcggcugcaagagguuccguuccacagccaguuaagucaucgccgccuuuccgccgcucggcgcggcccacagacagccuggcgucucgcgcacgcgcgug

SEQ ID NO: 15420 - RNA, 9024 nt, Homo sapiens
accuguucucccuggcguguagcagauuuuauuucauaugcagugcaugcagcacugaccgggccaggcguggcguucagaauggcucccuuccaccccagcucugaucucagaguccuggccaguggggagagagguaccgggcuggucuucaagaggguagcaggaucauuagugggccugaggccagaggccagagcccagaggagcuggaaugaucaaaacccuucuucuggagaguucugcuuccugggaaucccugggguugagguccuagcccagcacaagcacggccucauccucaguuauagcagcagagucucccuccucuucagggcccaugaugggaaaaggcccagggggccggugcugaaagagagccgcccgguucugcugcuccccuuucuuuacccagugcccguagagccggaaggcacaguugucgaugaggugccgcacugaccgcagcgcauaagggucccucaacagugcauucuuggucaguggccguacacgaugggugcuuagggccacucguccagcagccagcacuguccacacugccaccugggaaggggggcagggugagcucuagugcaggggaaagaucaugggacagagaaacgggcccagacccugauacacucaggcuuacccggaaccgcuggcggggggugagguuccaggguuggcugccuucacaacgcucaaagaaggggugcuguagggccugcucagcugucaggcgugccucaggauccaccugcagcagccuggagaucuaggagagacccagagcaugaggggcagcucuugggccuccccuacuguccucucagcccccgcucaccaggucuuugacagugcuggaacggucaucccacucgggggaacugaacugguacuggcccuccaugaucaugcguaacaucaggaucugccgccggugccagaaggguggcgagccagccaggagugugaacaagaucaccccacaggcccagcugggaaagagacuggagucaggcgggacuaggugacgggcagacccagcaaaggacagcaagcacgggagggagggggagaccaggaacucacaggucgaccuccuugccauagccuggguggguuucauccauggagcauuuaaggaucucuggcgcuagauacccuggggucccacacaacucuggggagagaggaccaagauugaggggaugccaccagccccucuagggcccuuagcacuggaucucugcuggagccuccucaacgcugccaggacuaccaguguucccaucuuccuucugucugccuucugccaagucuccugcugaggcacuaucccugcgcaacaguuggcucaccauggcuccugguggccuuccuaggaaaaccuggguuuuggauugauuucaagguccuuguuccaccauaucauuugccuccuccaacccuaccuacccacuauccaagccaaccuacccacuccucacaacuuguuaccuuaguuuuauauauaucauaaugcauauggaaagauuauguauuuuuacauacaucauaauacauacgcaaaaaaaaauuuucugcauuccuaucugcccaaaccucuuccuccuccuauaaucuccaacuaucacucaacccaaggggaagaaguggagauaaggaauuucuuuucuuuuuuuuuuggagauggagucuugcccugucgccuagucugguguacaauggcaugaucucggcucaauguaaccuccgccuccuggguucaagcgauucuccugccucagucucccgaguagcugggauuacaggcacgugccaccacgccuggcuaauuuuuugaaucuuuaguagagacaggcuuucaccguguuggccaggcuggucuugaacuccugacucgugauccgcccaccucgggcucccaaagugcugggauuacaggcgugagcuaccgcgcccggcgagcuaugggauuucuuaaagcacauaauggguaaguccuuuguuuaaaacccuucccugauuccacaucaugacacaugaucaaaucuacaguucuaaaguccagagcccuccaaaacuuuauccaagucuguauuuuuauauuuauuuauuuuuagagacagggucgcuaugucacacaggcuggagugugguggcacuaucacagcucauuguagccuugggcuccuaggcucaagugagccuccuccuucagccucccgaguagcuggggugacagaugcgugccaccacgcuuggcucaagucuguauuuuuaguuuguucuaccacucgggcaccaauucuuccaguacuuucugaaccuuguuccauggcacacuuccaggagauuuuaacagccccgaauugaaacugacuuuguugggaaauucauuccuacaccaaguauuucuugaaugccaaguugcacugauuugccaaguggcaaaugagaugagcccuuaccgagcucacugucuaccugaaggcaagugagaaauaacaauacaguaagacguguugugaaugaagaagaugggagaacagaaagcaaggggaccuaagcugcccuggagguuuaaagugaagccugaauuacccaagccaaggagaggaugcagugggcagaggcaaagaugauuccacaaacgggaaaaguacauguggaagccaaaggguuuuaaaguacaacauccaccagacauguggguccacagguuaagaguauuaacucuggagucagacuguccaaguucaaauccuagcauuaggacccuagagcagucaucucaccucuuugagccaaucuauaaaaaaagagacacaaauacugucugucacacagggcuguggagaggauuuaggggaauaagccauauaaagacuggugccgacaaggcacagugcucacaccuguaaucccagcacuucuggaggcugggacaggaggaucacuugaggucaggaguucaagaccagccuggccaacauugugaaauuccaucucuacuaaaaauacaaaaaugagccaggcguaguggugggcaccuguaaucccaacuacuugggaggcugaggcagaagaauagcuugaacccaggagguggagauuucggugagugaagaucaugccacugcaucccagccugggugacagagugagacucugucucaaaaaaaaaaaaagaaaaaagaaaaaaaaagacuggugccugccucacaggugaaugcccaguaaacgguagcuuuucauaagucuaguacaaaccauugagggagagagucaguggcagacuaaaggcucugaagaaucccacaggugaauuuuauuugaaguuucccauuugcaguagaaacauuccugucacaacaacuguauucacaucaggugaaccugaggcccagggcccaggugggaagugcagucuggacacaucacaucaggcucuugugguccugcacuccagaccccaaacguggcugaacauguggcucccuuuuuuaccuccucuauggggcucaggcugaauuggcguuccuuccuccggguuccccuggccuggcccucugcccacugugcaccacugucugucugccugcuugucugucuccauccucccaggucaggaugcccacucugagguaaacauaggcuuugcgcccacaggauacuuggcaagugcccaaugacuucucccuuuuucuuggcaccagggacuugguacucagacccagccaaccaaucucaucaggccugggucuccccucccaagccuauuagggcacuagauccccucaccucgaagcuucucgccagguuccaaguggcaggagaacccgaaaucugaaagucggaucugcauauugucaucuaggagaauauucucgggcuucagaucucgaugcacaauguuguuggcauggagaaagcucacugcuuccagcagagaccgcaugauggaccugggggaaggggaggcgggugcagucuccuccucggcuccucccugcccugucccacccccugcucaccccuggggcuucaggcucaacccuuaccugguuuccuuuucagagagggccaccuucucugugagauagucaaacagcucucccuuccgcauccuaagggaaggaggggcauaggaggcagcugcaucccacagugggggcugagaaaacagaccagugcucauacaaaauauuguggaagaggccacuaaagauagaucucugcagacaaaccaaagggucuagaaacacagcacuccaacaaggcaguuuggccugguguguuggcagcugaaauaccugcauuaugccaugauggggcaauuauggcaaaaauaagagacuucuugugacaauauaauuuauaggagguucuuguugagaguaacuaugccugaaaaaggccucucaaagugaaucuauaaagaaaauggaccaaaauuucaguuuuuuguggcacaaagguugaauaggaccuuauuuugaaguuucgucuuuaaaagcugagguuauaauuaugugucaauuaaaaauaauacuuucaaaauugagguuauacuugcacucugcaucaguccucaaaguaacauuaucaggugcuguuuuggggaguguaggcacucugcauggcugcaggauggcauaauagacauccuuacguccccucugacuuuugcagagggccauuucuguaaauauaucgaagccuucaugaauuuuuuccaagggccucuuuuaaaucuuuggaauucaaaucauucucuuucaaaauaccuuugcaguugguuugcauuauaccaauugcaucggacauucagauucugaccagaaaaagaacugaugggcagagacagacaccagaauaguuagcguguuaagcagcgcgagaggcuggugagugaggaucuauuuucuaaguggucaguccacugcugaacacucucuuuuuuuuuggagauagagucucgcucugucacccaggcuggagugcaauggcacgaacucagcucacugcaaccuccgccucccggguucaagcaauucuccugccucccgauuagcugggauuacaggcaccgaccaccaugccuggccaauuuuuuguauuuuaguagagacgggguuucgccauguuguccaggcuggucuugaaacuacuaaccucaggugauccaccugccucagccucccaaaaugcugggauuacaggcaugagcuaccacgucuggcuggucacuauuacuuuauuuuuugagauggagucucacucugucgcccacgcuggagugcaguggcgcaaucugggcucacugcaagcuccgccucccggguucaugccauucuccugccucagccucccgaguagcugggacuacaggcgcccaccaccacgcccggcugauuuuuuguauuuuuaguagagaugggguuucacuguguuagccaggauggucucgaucuccugaccucaugauccacccgccucggccucccaaagugcugggauuacaggcgugagccacugcacccagccacuagucacuauuaaagaauuugccucaaucauggcaccaagggagaaggccagagccaugcgcuagcaggcaggcccaggugauagagagccccagcuggaacaggaaggugugagcaggauggguccagcccacugcaccacaaaugcugggccauacauggagguggggaggaggcuucucagaugguggcagggagauacucacaggucaaacaccaggaacaugaagcuagaagacucguaggaaucgaugagggugacuagggagagaggaagagaggcagagagacagagauggaaaggaguggaugcacauuaacggggcuuggccacccugggacagcagcgggcuguuacugggaagaaaggagaaccagaggaggcagugggcgcccaacggauggccacucuuuaguggaaugaagggaggagagguguggaggcaauguuggcggaagugggcuaugggcagggccagcaggagguggggggucgucugcuaacaggagcaaggaagacagccucacugauguggggguggccggcgaccuggcgaaggaugugugucucucgccguguggcuucccgcaccuccuccagcugcucaggacucagccgcucagcugucacuuccauaaucuucaccgcaaacucguggccaguagcucgaugaacacaacggcggaccacagagcucacuccucugcaagagccggaaaauagcacaagucagggccucugugcucacauuuccgcacaggcuggggccucagcauccucaugcccgcugugccagacucugaagacccaucuggaucacagggcaacaagcuuaggagcucacccuggcuucacagcagccucagaaaccugaguacccagcaaggcacaacacaaagcucacagggaaggcagguagggccuggguucaaauccaggcucugccacuuccuccaugggaaagccuaggcaaguccuucccacacugagccucagcaccuguuccuugcaggaaggggaaagaaagaucuaagucucccucuauauuccacuuacacuugccugauuaccccauccaaaucccaaaguucccucaaguguaggaagcuccaaauaaguaggaagccauugacuagaagaccaaagcugaaaauuagaucuuagugcagaccccagauuugcuaccaauuaaccuaagugguccccugacauaagguucuuggacuucagcugugaaaugcagccaacagcauccugaagggauguugaagggcauucaugaggcacacacaaaguccuagacaaggauuuccuugcucaggcuaucaccaacuccauaugacccuacacauuccucagacuaaggagcaaaucccuccaggauccagccucaaauccuguuucuuauccugguucccuggcugcccuucgcagagccuuacuguuaugcucucuggggccuccuuggccucacauaacucacuugggaauucggccacccacaucuaguuaaaucaagggauguaaacuauugauccacaggccaaacacagcccucagauguguuacguuuuggccggugcaauuuuuuuuuuauuuuuuuacacaaaucugaauucauacaucauagguggggcaaaacccuccaccuuccacaacacuuccuacucucuuacucuuggccacuucacaguuucaauuuccugcgcaaccacuaagggcaucugaguuugaggccauguuuuaauuaugacccagcuuuaaugagccucuuugagaaucugaugaaagcuggagacaucuaccacacgcauacauuuuugcgauuuuaaagaccccccccugaacuccuacucauaccucaagacccagcccaaaggugacuccuccugagaaggugugcuuuucuggaaucccauagcacuugauacagaccucuaccuaucuagccugaugccuuuuuaacguucacgugccaauuucagucacuucggguggaguaccuccagggcauacgcaucuuuucugcccuccccguguugagcuuuguguugaaggcauaaaugaaugaauccgugaaaaaaugggguugacccaagguaagagucuagucacuagguguucuccacugaucacugauucuucccauuuagaacuauucagucaaccaggcgcgguggcucacgccuguaaucccagcacuuugggaggcugaggcgggcagaucacgagaucaggaguucaagaccagcguggccaauauggugaaacgcccgccucuacuaaaaauauaaauuagccggcgugguggcgcgcgccuguaaucccagcuacucgggaggcugaggcaggagaaucacuugaacccaggaggcagagguuguagugagccgagaucgcgccacugcauuccggccugggcgacagagcgagacuccgucucaaaaacaaacaaacaaacaaacaaaaccaacuauccagucuucuccugagaaaaccugaacuugaaagacacacacacacacacagacacacacaccaccaccaccagcaccaccagcaccagcaccaccaccaccgaaagacacacacacacacacacaccaccaccagcaccaccaccagcaccaccaccagcaccaccaccaccagcaccaccaccagcaccagcaccaccaccaccagcaccagcaccaccagcagcagcagcagcagcagcaccaccaccaccaccaccaccaccaccaccaccaccaccaccaccaccaccaccaccaccaccaccaccaccaccaccaccaccaccacccgcgaacucuccagccuucaaacggaagcgggaaugcuggggcucgaccucuuuggaccuccguuucccuggccgcggccuuaccugccgaugacguccuuagggucguacuucugguaaaacucuuuggcggcggcccagucgggcagcucauccuccggccccacguccagcgucauccugaaggaggcgggggccugcgcggaggaggagggcagugagggcagggaggcccacaggcucugagacgacccgcauggcggcucccgggggcgcagcccuugcagcuggggcgccaggguccuggggggugggggggggugggggaaggacccggacuggggagaccccgcagaagagccugggggcgggaggauggcagggcagggaggggaguggggagaugugcccaggaggcagggggaaggggcgcaagggcaggcggcuguugccgcgcaggcgcauucgggcgggcgcaggaaggggacgggggucuagcgcaggcucaccugagggggcaggcagaggagccagggucgacgcgagcugcgcugucgccggguuugccugcagucgcucaccuuaacccccggcggcgggcgacaacccaaggcuccgccuccauccugcccgccaauggucagcgccgcccg

SEQ ID NO: 15421 - RNA, 5726 nt, Homo sapiens
cacuccuggcuggcucgccacccuucuggcaccggcggcagauccugauguuacgcaugaucauggagggccaguaccaguucaguucccccgagugggaugaccguuccagcacugucaaagaccuggugagcgggggcugagaggacaguaggggaggcccaagagcugccccucaugcucugggucucuccuagaucuccaggcugcugcagguggauccugaggcacgccugacagcugagcaggcccuacagcaccccuucuuugagcguugugaaggcagccaacccuggaaccucaccccccgccagcgguuccggguaagccugaguguaucagggucugggcccguuucucugucccaugaucuuuccccugcacuagagcucacccugccccccuucccagguggcaguguggacagugcuggcugcuggacgaguggcccuaagcacccaucguguacggccacugaccaagaaugcacuguugagggacccuuaugcgcugcggucagugcggcaccucaucgacaacugugccuuccggcucuacgggcacuggguaaagaaaggggagcagcagaaccgggcggcucucuuucagcaccggcccccugggccuuuucccaucaugggcccugaagaggagggagacucugcugcuauaacugaggaugaggccgugcuugugcugggcuaggaccucaaccccagggauucccaggaagcagaacucuccagaagaaggguuuugaucauuccagcuccucugggcucuggccucuggccucaggcccacuaaugauccugcuacccucuugaagaccagcccgguaccucucuccccacuggccaggacucugagaucagagcugggguggaagggagccauucugaacgccacgccuggcccggucagugcugcaugcacugcauaugaaauaaaaucugcuacacgccagggagaacagguguccugugucugucuggcuugggcaggaaagcccagaaggugcucagcagggugcagggauggugccauucuggcccagaccuuuauuggggaaaauguugggggucacuuggucuugcucuugccuuuacccggagguagcuggaagggccgcucuagugcagucaacuugcugcugagccuuuccucgcuggccuugagccgcuccuccaccagccccuggagcugcuccagcucuuuguucacuugggucuugauguaggcucggaggacguggauguggccugcaggggcagggaagaaggggcagggugaggagagaugcugucuggcaauggggggauggucccuaguugggcaaacaguccccaaauuuccccugguggggauauagagguagcaauguuguuucccuuuaggaaauguuagcaagcccuugugugagagguaguuggguaggguggcuaugcuggacuuugcagcuucaaauucugaucccuacucaguagcugugugaccuuaggcagguuauuuaaccuaucugugccucaguuuccuuguaugaaauguggauagugauaccuagcacauaggauugagggaggauuaaaugaguuaauuuauguaaaaugcuuagagcagggcaugcacugcacaccuauugccaaguaugugcuggcuguuauugucauuggcuuucucuuuuuuuuuuuuuuuuugagauggagucuugcuuuaucccccaggcuggagugcaguggcagcgaucucagcucacugcaagcucugccucccagguucaugccauucuccugccucagccucccaguagcugggacuacaggcacccgccaccacgcccggcuaacuuuuuguauuuuuaguagagacgggguuucacaguguuagccaggauggacucgaucuccugaccucgugauccgccugccucagccucccaaagugcugggauuacaguugugagccacugcaccuggccuguucuuuguuuuuuuuuaacucuuaaguucugggauacgagcagaacaugcagguuugcuacguagguauacaugggccauggugguuugcuuuacccaucaacccaucauauagguuuuaagccaccgucauuggcuuucuaaugaucauuucucuggagccacuucagcugugcuuuuuguuuguuuguuuguuuguuuugagacagagucuugcucuguugcccaggcuggagugcaguggccagaucuuggcucacugcagucuccaccuccuggguucaugcaguucuccugccucagccuccugaguagcugggacuacaagcgcgcaccaccaugccuggcuauuuuuuguauuuuaguagauaggggguuucacgguguugcccaggcuggucgcgaacuccugagcucaggcaauccgccugccucagauugugcugggauuacaggugugagccaccacgccuggccugcagcugugcuuuuaucugucaucuuggacuucugcauaagggaucauuuagagaaaggacucugacuaaaaacaaaaagucugaaguccugaugucauccaaacccuucauucuacaccugcucagagggacagggcagccugcccucuccagauccucacuuggcucuggcucugguggggccacugucucuaguuccucuuucugcgggguaacugccugcuccuccaucuccuugcuuucuucuuucucugcaaaccagaagcaggaagagacuguggccccaggccuggcccagcccagcccugcccuggcacucucccuuacccgucucacucucuggccacaguuuggguggcuguagccccauguaagucaaagacagauccagccgcaccugggaagcaaggcagagggaggcugaaaggagugcaccugugcugaggggaggggcgguugaggguggcuccucaugguccaccacccccuaccuggggugugaagacguauuuauagagcuugaaguggcggaaguaaguguugaccacguagucuuccaaggccagcagcuguuccucuuugaagaggucgaugcugaaaggaggccgcugugguggugacucggaauuagaacccugacuaccuuccggagcccuggcuuugccuccaaaagcccagcaacaggagcaaggagagcccacuggggucuucacaagaagauaagggugaugaaugugagagagacugggugagaccuugucuggggauggguaaaguuuccagaauguuccaggggaacugacccugacuccauggcaaaaaaggacacuggugaaguagcgguagcacuccuccacguugcccaaggggguugcugguagggaaagcaagaugcagcagugaggcccucucugguauccauucauucacuucacucaacagcuguuuaugaccaugagcuucagaagcagacagaucuggguuucagcacuggcuuguuuccuuaacucauguaacaaauacugaauacccacuauaugcccacuguaugguuuucggcacugaacaagacagacaagguccugcccuuacgaagcuuauauucuaggggaauaaaccaagaaauagaucauuucagcuauuaaacauucugaagcaagagcuauuaaacauucuaaagcagguguuauugugcacuaugcauauauuugcauauauuauuucucagaacaguccuguaaaaugugugcuguauccuuaauuucuagauaaggaagcaguggauuggaaagcugauggcuuguguaugaugaugcuacuaauaaugacauauuccaggcagaaauccccugcuucugcuucccauggucacuugugccaggcccgguuccucuucucccuggggcucaaaccugguagcugcccccucucaccaauacaagccuugugaagauccuggagcagggcacaagccgcugacgucugcuccagugagaagcccugcuggcggcagaaaaugagcgcguggcagaagagguccagggugauggcgucccucaggcucugcucaggacacccuagcuccagcagcucagccagcacccuugggagggagagaggagugagugacaacugggccuccuuucaucacccuacacccaccacaugcuuuggagucagccauuccucauguuuucccaaccugaccccucagccuuugccaagagcucuucccacgccccccucagucccuacucccucaucucagcauugguggucuucuccagcuggugcauggaauggacguccagguacuuccuguuauaguaaaagaaaaagaguauugguggccguuaccuaucaugacaaggcugugacagcuagugcgugagacugggaguuggccaccggcgugaagcugggcucuuuugccagcuugcugugugacuaugcaaaucguuaacucucugggccuaaaugaacucuuaugagccucuccauuucuaaagccuaggguuaggaaucuugaauucuuuuuucugcucugccacuaccuuguaugaccuuggucaaguacucccuguggcccucagugucccccucuguacaauacuccuuagcggccaugagacuccauuuacauucugucuuuggcucuuuuuuucucacacugccuccucuuuggacuggagaggcuggaaagccaacuuccagucaccuggaguaauugcaucuccaggccucagucucaucuguaaaauggggaugcccuggccacagacaggacuguuggggagacaauaaagaacgcaaauauucaguguaauuuuugucucuucacacucaccacaugcagauccggggucggggcagcggcggcugcggaaagaaagcgaauuggggaaggcagcugcgguguccuggcccguagcgaaucuccagcaggccggagaagccgcuguaacuugccaucucaucucaaggacuaaggagaggcgcgggcgagggagggcuucagcaggcccuaggugcucuacgcgagcacaguaaccaccggggucacacaccccugccucuccucgcccaagcagcccgggagacgucccgaacguuaguaagcauaaugacagguggcgccugcgggggagccgguuuauaaauauucacgagcagaccagacugucccgcccucaccggaaacaaguuggcuccggggucuucauccgcuuucgccgccgccgccgucguccacugaguccgcacacucgcacgcguccgcgcggccgacccaugcacugagcugcgauccuuccccgcuucccgccgcagcucggagagauguucaagcuccgacugcacccucauucccaaaaaguggcuggucuugcgguugagcaucucgccgcucuuccgugccgcgaggcgccccgggcucccgccgccuagguuccaggacagccagcgcucggucggcggcuaccaaggccgggcccguucgccucgcuccggccaaucuacgcgcggagaggcgcggcggggcgaauccgugggggcgucucccuccgucucaacggcgacgguugccaagggggcuugugagggaaggaaggcggaaagcgcaggcucacgccagugggagcgaagagaacgcgcagauacgugagaaguugcgagugcccaccugggcgcccucucuuccagguugcuaauacgagggccggugcuguccuccaggcugggaagugggagcgcggugucaguuacuaug

SEQ ID NO: 15422 - RNA, 3859 nt, Homo sapiens
gaguauugaagggcucagucuggaacuugguacagagugguaguaacugcugcucuuauccucaugagggucuguccauuccuuccagaccccuugcugaugcagcugcggcccccucucagugagccggccuuggcuuuugugguggcacugggugccagcagcagugaggagguggagcuggagcugcaaggccgaauggaguucuccaaggcagcugugucucgugugguagaggccucagaccgccuacagcgccggguggaggaacucugucagcgaguguacagccgagguggguucuuugugcccauacugaagggguguccauccccaccugcaucuugauggcaccccuuccugauuccccuaaugcccgaguccaagggcggccagaauuucccaaggaauaaaucagccauguucuuggaagagguagguuaggcuguagauggggguuccaacuuugauuccgggauugaaugcuagagagauggguuggaggaguuguugaugccgguagaggcuccuggccagaggccccucuggagcacuugguguggguugcggauccacaaggcauagcuucaagggcucaggccuuguagguugacaggcuucucccaccuuaguucugccacccucaccuggacaugcugggaaaguggcuccccucucugagcugguuuccuucucugugcaguggggauaaagacuccuggcuuugucaugagaaaugggcaagacagcugguggaucacacuggguauauagcagacuccagaaugaguuaguuguuugccccauugcccugagcugggcucuuaccugggcccugccuucccaggggacagugagccccucagugaggcggcucaggcacacacccgagagcugggccgugagaaccggcgacugcaggacuuggccacucagcugcaggagaaacaccaccgcaucucauuggaggugaggagccgggggcuuugggggugugauuagaaucaggcaggauuuggguuagaugggcacucagggaccucaggaaccaagucccccauccaagcaucugcucccucauuguucccaguacuccgagcuccaggauaaagugacaucggcagagaccaaggugcuggagauggagacaacaguggaggacuugcagugggacaucgagaagcugcggaagcgagagcaaaagcucaauaagcaccuggcagaggccuuagagcagguggggcaggggugcuggggcaggugaggcaaggcugggcccuugggccuuagcuccuccccucuacauccauugccugucuguuuucucuccacagcuuaacucuggcuacuauguaucugggagcuccucaggcuuccaggggggccagaucacacucagcaugcagaaggugagcggcguuuuccucccaccccuucucacaaccucuucucuguugcacucuugaaauuccccucaggacaaaggacaaacauccaucucugaggcccuuccuggucacuccugcugcucuuuuuuucaugcauucauauacuuguugaguagauuuuugaacacuuagugcuaggcacuaggcauauuggcgagaacaaaauagaggucaaaacuuucauggaccagacaagaaauaaauaaaagaauauaucuuuagguucuacuugugguaacagacaagaaaucaguaaaauagcauaucaguguguuaugaguaccacaaagauaaagcacagaagagagagcuaagagugaguuggagucaguuggcaucugguggucacugugcccuuuuucccuuuauuagcacuuuaggccuuucuggaaugccuuccgugacuccccaucaguuaagagccuuaguucccagcaccgaccaugcaguauugaauuuucucccauuuuucugggagcccuuaggaaaguacuugguuuggggugucagaaucgaucauugcccugcacggggugcuugggguggaguguaugcuggggauguaagggaggccugcugccacgucuggcccugccucccauggcccugccucccacuccuuaguuugagaugcugaaugcagaguuagaggaaaaccaggaacuggccaacagccguauggcagagcuggagaaacugcaggccgaacuucagggggcugugcggaccaaugagcgccucaaggugggcugcuguaggggcugagagguccugggccuguaagggagggacugagcccugaauccuguugcugaucccauuugggcaucccugccccagguggcccugcggagccuuccugaggagguagugcgggagacgggggaguaccgcaugcugcaggcccaauucucacugcucuacaacgagucucugcaagugaagacccagcuagacgaggcucggggccugcugcuggccacaaagaacucccaccugcgacacaucgagcacauggagguauggcccuggaacaggcguuagggcugggcuaagggccaaaccguuaguguugacguguuugugccuuccgaggcccugugugccagccaggggucccuggggaauagauucuuccuaagauacugaguccugaggugggaccgaggggcuguguggguccuuaacacaucaacccacagagcgacgagcuggggcugcagaagaagcuacgcacagaggucauucagcuggaggacacgcuggcccagguacgcaaggaguaugagaugcugcgcaucgaguuugagcagaaucuggcggccaacgagcaggcggguauguggugaggauagggcggagguggggccuuaucugggagugcugggcccugguguggggcugcugcuuauccagaugcaagaggcuaaggccuuuuuuuucacagagccucggcuuccuaugcaaaacagggccugcacugcuuggcucccaggcacagugaggguccgccagcugggguggcugauggagcaggcacaugcagagucugagcugucagcccuguccucauucuucuggucugaugacgucucugucucucagauacuuguguuacaaagauuuaucaaaugccaccucugagccaggcucuguucuaggguuugggguuaugccagugaacaaaacagaauuccugccauguggagcaacauucugguagaagacagacuagaggaagacgaacuaguagaagaaaaauggaaaauguguuagcucuugacagauaggaaaguaaagcagaaaaggaagauaggaaguaucaggagaaaggguguugcaauuuugaauaggaggccagggaaauguacugggaaggugauauuuaagaaucuagaagaaguuaacuaacuuuugugaauguuacaguuaccuucucuauuaaagggaauuggauguauaaaaaaaaaaaagaaaaaaccuaggccagguguggugauucaugucuguaaucccagcacuuucggaggccaaggugggaggaucacuugaggccaggaauuugagaccagccagggcaacaaagugagacacuguuucuauuuaaaaaaaaaacaaaaaaccccacauauucuauauuagcaaaaaucguaugaauaggcagugucaaguuaauuuugggugaguuuccuugaagucagcauuauuuacuuugaugaguucaugcuccguugaggccgcaauguuccccuccugcacagugggagugauggcauagccucuuaccccacugagggguuggaguccuaacccaggaacugguucugacaccuuuacuugcugaugcuccuccagggcccaucaaccgugagaugcgccaccugauuaguagucuucaaaaccacaaccac

SEQ ID NO: 15423 - RNA, 8949 nt, Homo sapiens
gcgggcaucggggcucucccagaugcccacgcugccugcucccacuggagacggggacaggggcgucgucccagccuccucccugcucccaccgcuguccccuuuuuuccccaggcugcgggaggcaaaggguuaaaucccauagagcugaugcucugacuccaggcuagaggggcccgggaagcuggggucacuuccugcuccgucccagucacccugaacugguccccggguccucagccuggaaucaccccuugagaaggaccccagaguccucggcgcccaguccgucccccgaggcagggcacugaagggguuaaguccccuggggcuggauuccgccuuccggcuuuucccagaccccagagccgugaguuggggacgccuggguucccgggggguggccuggagugcccgggacggccgccggggaacaauggggcccgggaggcgggggccgggagcccgggccugagccccccacccgcgcccggggcuguggccggggugggggcgggcggggggcgcggagggccgaggauucugggaagcgcgggggucgguggcgggggaggggagccuggggauucugggaagagggaucggccggggccggggaccagcgcugccagcgcagcccuggaggagccuggcagugcuggaaggagccgggaccccgggggccggggcaggggcggaugcccaggcucuguaucagcagcgggacgggggucgcggcuccgggggagcagaaguccggagccaagcggugggggggccgggccgggcggccgcauucccgccgccuccaugucagggucacccugggccguuccccacaucucucgggaggcggcuccucauucccucccucugcaguggggccaucgcgaggucucaggcuggcgugccuggcgccugggcucccagcgccucggccucccucggucuucccacguccaugcucugugucggcccugucauuaacccuuucccuccuacucuggaccacuaggggagaauuuuuuggagaccaucgagguccacaaacucuuaccugucccgagcaaacacagcagggcauccuucccggaccggacaucaggcagcccccaguguggcagaggucuccgcuuccaccaccccaaagacacuuacaggcggggaggggggauucucggagcuuaaguagcugcagagaugaagaaauuaauuuacuuccuaaacgcuaacuucugucucuccuaccgcucuuuggcagggugcagccagucuugcuucaccuuggucaccucucagcgccuccugccaugucucccuugccccacugccccugugcacacagcgcccaccucacacagccauccaaaguuuccaggccccacccagggauucucugcaggguguaaauggugugggaccuccuucaagcgcuuuguuccuguggccccauucccucauccugaacucaucucaccauuuuuggagugacagcuggcuguuuuuauuuauuuauuuauuuauuuauuuauuuauuuuaccagggggccacuuggaacuccugcuccuuugcugccauccccuugcaaacugaucuuuaaaggcauuagaccaaacagguguuccaggggcuagggacaucucacucauucauucauucaacaaaguuucuggagcaccuauucagugccaggcuaggcuugggaaacagccucaagaaagcaggacaaaaggaguagaaggaggguccgggcaggaguggggauaggagggcuuugguggggaguaugguuccagcucaugggugcagaccagcaggccuagucccuggguccaacuccuccuuuucuagccugggaaaccucugggucccaggaauuucuccagccuauucucacugccagcaggcuccccaugagcuguccucaucaccugucuccugccagccucccaugagcaugagucucacaugacucccaaggucaccucgugcucucagagacaggggugagccagauauggagcccugcuuuuaucaucuuagcucugccacuucccagccuugaccuuggagagguuuccccaggcauugauguacuaaucuguaaaauggacagccugauuccugggucuccucaccaggcugugggaggacugggugagagaaaugacaccauggcaggcacugggucugccgcagguguucacacaagcauccauccuccccuucuccuuacuuuuucucuuccucugggcgguuccugcagaugcagcuuuaaacugccccucuccccaccuccagccugacccucuuucugugcuuggauaacagggaagugccccaguccuuuuagagggccucugucuccucugggaaacugggguguuuuuuuuucuuaacccuuuaagugucucaggcagccucgguucacucuggggcacagaaaaguuuauuggucucaauuagcagccccauuaagaggaaaauuagagucuuaaugagcuuccucugauuagcaaauaacagguuucccagccucugggcaucagagguauggggugaaaaacuccuuccccuguggaugucagagaccgcuccagcccccauccuggguucaaaggcuuaugagugaugaguuuuuaauuacgcucuuaaauucaccugcuugcuuagcugugcgcuuaagaucuggagugagaaucaggccugcaggggaagggggccacagcaagaacccgugcccagaaaaauggggugggaggacacugaaguucacacaaggaggaauggggcggggcagggugggagugagguucagggggaauaaagcaaagugcaaaaucagcucccagugugcgcucaucgcugucuucccccgcagggucccuggaacacugcaguccugagcucugggauggagcccgagacugcgcuguggggcccggaucugcaggguccggaacagagccccaacgaugcucacagaggugaggggcacaagaaggggcugcggucccggcaagacgguggucccggcucagggaggggccuggacucugggggacacccgggggagggaagagagaccaaaccccguguucugaaaggggcugggggcuguagacucccuuucuuucuguaggugccgagagugaaaacgaagaggagagcccucggcaggaaaguucuggggaggagaucaucaugggagacccggcucagaguccagaauccaaggacucaacagagaugucccuggagagauccucccaggaccccucugucccccagaaccccccaaccccacugggucacuccaaucccuuggaccaccagaucccccuggaccccccagccccggagguagucccuaccccaucugacuggaccaaggccugcgaggccagcuggcaguggggcgcucucaccacauggaacagccccccagucguccccgccaacgagcccagccugcgggagcuggugcagggccgcccggcgggggcggagaagcccuacaucugcaacgagugcggcaagagcuucagccagugguccaagcugcugcggcaccagcgcauccacacgggagagcggcccaacaccugcuccgagugcggcaagagcuucacgcagagcucgcaccuggugcagcaccagcgcacgcacaccggcgagaagcccuacaagugccccgacugcggcaagugcuucagcuggagcuccaaccuggugcagcaccagcgcacgcacacgggagagaagcccuacaagugcacggagugcgagaaagccuucacccagagcaccaaccucaucaagcaccagcgaucccacaccggcgagaagcccuacaagugcggcgagugccgccgggcuuucuaccgcagcucggaccucauccagcaccaggccacccacacaggcgagaaacccuacaagugccccgagugcgggaagcgcuucggccagaaccacaaccuccucaagcaccagaagauccacgcgggcgagaagccauaccgcugcaccgagugcgggaagagcuucauccagagcucggagcugacccagcaccagcgcacgcacacaggcgagaagcccuacgagugccuagagugcggcaagagcuucggccacagcuccacccucaucaagcaccagcggacucaccugcgcgaggacccguucaagugcccagugugcggcaagaccuucacccugagcgccacguugcugcggcaccagcgcacgcacacgggcgagcggcccuacaagugcccagagugcggcaagagcuucagcgucagcuccaaccucaucaaccaccagcgcauccaccgcggcgagcggcccuacaucugcgccgacugcggcaagagcuucaucaugagcuccacccuuauccgccaccagcgcauccacaccggugagaagcccuacaaguguuccgacugcggcaagagcuucauccgcagcucccaccuuauccagcaccgccgcacgcacaccggcgagaagcccuacaagugccccgagugcggcaagagcuucagccagagcuccaaccuuauuacccacguccgcacgcacauggacgagaaccuguucgugugcuccgacugcgggaaggccuuccuggaagcccacgagcuggagcagcaccgggugauccaugagagggggaagaccccagcgcguagggcccagggcgacagccugcuggggcucggggaccccucccugcugaccccgccgccgggagccaagccgcacaagugucucgugugcggaaagggcuucaacgacgagggcaucuucaugcaacaucagaggauccacaucggagaaaaccccuacaaaaaugcagacggccucaucgcacacgcagcccccaaaccuccucaguuacgauccccaaggcucccuuucagagggaauuccuaccccggggcugcggagggcagagcggaggcccccggacagccccuuaagccgccggagggucaggagggcuucagccagaggcgggggcugcuguccuccaagaccuacaucugcucccacugcggagagagcuuccuggaucgcucugugcuccuccagcaucagcucacccacggcaacgaaaagcccuuucucuuuccugauuauagaauuggccuaggggaaggcgcagggcccagccccuucuuaagugggaagcccuuuaaaugcccugaaugcaaacaaagcuuuggccucagcucugagcugcugcugcaccagaaaguccaugcaggcgggaagagcucccagaagaguccagagcuggggaagagcucuuccguccuccuggagcaucucaggagcccccugggggccagacccuaccgcugcucagauugcagggccuccuuccucgaccgcguggcccucacccggcaccaagaaacccacacccaggaaaaaccccccaaucccgaggaccccccuccagaggcagucacccuguccacagaucaggaaggugagggcgagaccccuacccccacagagagcagcagccauggggaagggcaaaaccccaaaacccuaguggaagaaaagcccuaucugugccccgaguguggagccggcuucacagaagucgcagcccuccugcuccauaggagcugccacccaggugucucccugugaaaugggucuggagaccaggggccucgcucucuccagagaggaacacuggauuuuuucccccaaaaaaauuacauggggaagggaggauaacccuaucagaugguaguggaguggaggagaaagaacccugggaaaaaauagugcuuuuacaucagugaugagaaacccuauaaaauuguuggugggaagcacuuauaaggcaguagagaaaaacuguuggguuagaaacccuauaaauauguaggaaaaaaaaaagcccuuuaagucuguagcagaaaaacccuauaaaccauaguggauaaaagcccuauuaauuguaggaagaggucccaauaugucucugaacaacccuauaaaauuguaucaaaauccuuaggaaaauccuauagggucggggaaguaccgcaauggcacugacccgggaguaacgacccucagaugaugcagaaaacaccucucccucacuguuccacaauguucucucccagcagcccuggacaguucucauggaggaagaugcucagcugggggaguggugugggaacuggguggaacugaaaaggaagaaaauaggagaaaaauaagugaccaggagcucuggagcccccagaggagauaagacagagacuaggaagaaaaggucccacucacugcacugggguccuugggguuugaggacaauguuagaugcauuguguguuuuagggaaagaggccuauggaaucccuuaucaaaaccccaaaauggggaagaaaaaacaaauuggcaagccuuuuuaaaggcugaaguuuggggugcagaaacauggucaguauaagaauacugagaaaccaccacaaaaauuagggggaagcagggggcaguuucuguuagauugcuuugaggggagcaaaccaagguggggaaacugcucacauggaacccagcuaacuccaggccccuucuugcuuccggaagcuugcgaaacugcaaguagcaggcaggucccagcucucagagugcaaggguucuccccacaccaggcaggaccacccuuucucccugcccagccagggacuucuacucugcaaggccuccagggauggcgguugccucccaccacauucucaggucucaccuucaggagguuuuuccugaaaucuaacugccgccaguggcagcucauuuccucaaauucuguccucaguggagagggagaaccgcugcuagucgaccuccaaagaauaaagcccuucagagacuuagggccugcgugugggccuccccagccuucuccaagucaucagggccacagaauuucuuagaaagcuuugauuagccagcaacuugauuuuaaacuucagcuauucaucuuuguugguagcaaggcugccccgcaggauaaggcagcccuccucccugguggggauccagacaccccacagacugagccacaggucccugaagaguccgcagaggccguaucacccucuucacccugguaccuggagcccuccaggguugugagauccagcccaaucucagccuugagauggaugggauggauuccacucacuuggcuccccucuccuccuuagccagaaaccuucagaaggaaacagaaggaugagaaagccucccuugccaggcccaucucaccucccacaccacacaguuacacauucauaaacagccaagccugcucacaggccugggcauauguggcuggggagagacuguugcccuaugagaugguggaagacagaaaacucuugaaugaaacaucuguaacaagacucccacucccuaauccuggagaccccuucaaaaggagaggacucugcucagcgcugggucagaaaggaagugcuugccaaccccaguaaugcgcuguccuggaguaagaggacugagaugccagcuguggggcccgucaggagucacgucucaagagaggggugacccagauuuuugcaaagcuguggaagagaccucuaauuccaugaccuaaaguuucacacaaccuuuaugcaaauccuucgccauuugucuauccuggccccagcaggaugacccucacauuuaaaaggaucaaaaucucaaacauugugggaggaaaacgccaggccugcuggggagagggagaaggcaggccucaggauugugcggagaaccauguugccaucugcauaacgccccagccuauccaagugccaggaagggaagcacuacugaggggggugcugccugugggucucuuccuaacagaacgccaacgaagggggugcccuguaagaaugagaagucugccaagucuaaggagaugucccccuccccaagaugguagcagaaacugaaguuguaaagacaaaccucucgcaaagccagaagcagaugcucucaaaaacaggccuaaggaaucuguucccagaagaggccuggggagcagcuuuuggggcucagaggccagucuggggggaggcaggcagugugacugaaggccggcgcaggccuguuucggacuaggguguagcauauuuaguaggaugcucacauguuguagggaugggugagggcuaaggggcuuggcucuuguacgggauggaugaugugagcgcacaguucguagggucaggcgucuugcgguaggaaaggggcaggguucgauaccucugggguguggcguguucucucuugcccaccuccccaagcuccuuuaaccaggagcuucccucccagagugagcuacgucuugggaggauugaagcagggagguggcaguggcuagaguugcucagaucggcucagaugaaggcccaggggucaaagcauuugcucaccacaacugagucuggaaggcacugugcagccaaacccucuuguccaaucacaugcaggccccaggccccucagaaacgcccugguggagggaggagcccaacagauagggucagggagucaguggggaaagcagaggggagagcuuagagugaaacuugaaacugcuauggacauggaggucagaugggaacuuggaacugggcaugaauccugaaugguggggaaacuugaagccaucacagccaagaggugggguuccaugaccugcccugaggucagcagcucccagacuccuuugcccucacuagggaagccccagucaccggacuuguccccauggagugaagagaggccccauuuuugaguguuguguguccaaaacaguguugugucacugguggucauguugcuuaguugaagagaauaaagggaauaagauuuccugggug

SEQ ID NO: 15424 - RNA, 6045 nt, Homo sapiens
cccaguuccuguuuuggccuccgcugucccgcuccggcuccuggggcuccccgcagacgcugcuuuucuugcuccacugggggugccucuuccugggcgcccgccgccugcauccugcucguccugucugggaauggggccgcccccgggcuugggccggcccggcuggggcccccgaggcgcuuccgccccguagugaccgccuggugccgccccccccccaggaugaagggcggcgagggggacgcgggcgagcaggccccgcugaacccugagggcgagagcccugcaggcucggccacguaccgggaguucgugcaccgcggcuaccuggaccucaugggggccagucagcacucgcugcgggcgcucagcuggcgccgccucuaccucagccgggccaagcucaaagcuuccagccgcacgucugccuugcucucgggcuucgccauggugaggggccgggaggggucacacccgguggggcagagcaaguggggggcacaggucggggggggggcgaaguaaacaggucccaagggagacagguuaaagggggcuuucgucaaagggggaaggaacaaggucccgcgggacugagcaagucccuucuuacggauguguguguacaggggaccccaggagacggggccaccggaggacacgaaaguccuaaaggugucguagugggaguggggugaacaaaucgcuggugggguugacugcaacagugaggcagagugguccagauggagccuguaccuggcagaagugguuccuaagucccagugccagcuucaaaggcaggucagcugggugggggcugcaucaacagguggggggcucgagauggauuagcuggguggaagggucacccagcugaaggugggcccgucccagggaagguggccacucuccagcgggcccaaggggugcuagugucaaccaggaaaacugacaagagaucaugcccgggagggaaccgcuggggaaggaggcugaugaggaaacugauaagcgagucucaagcugauaaaccccaggugcaggaggacgguguuggcuaacggucugccccagcaguggccucacaggaagugggauggagggaggucccagggugaggaucagcagacacaguccuggcuccucccugcuuguggccagcugugugacccuggacaggccuccaccccgcuugcaagccagugggaaacugagaucauggagggugcgcccucuguagccagccaaguaaccgccccagggugagccaggcaugucagagcaggucacguaccaaggauggcucagacuagccugcuaauuggacagguguggaaaguaaaagccuugccucugggcaggagcgaaugaacugggacccaggguugcugcucuguuagucugggguugccccaccaucaccccaggaaaaaggagaaagugagcugcaggagguacuuuggggaacgcacuccuguggggguggauaucagaggcgguugggguggggaccauggcgcuaggggaucugggcuagucccugcccugucugugccacaaccuccauauuugaacaaugacagggaaacucucuaacccuaagggucaucauaagccuauggucuucuauguggggucccagaauccacagaccagcuuaccuuucaugaugggggcaucaccuagggacaggauguuggcuccccuucaucugcacagccugcagagggaagggagcagccacccaagcugagggaggucaaccccaugguccagccuguucccaaggagacaaucccuccacggcagaauaugcaggugcagguugcuggggugacagcuuaagggcccgagccuucucugcaggaggaaggggcuggagguuuagguuccgggggcaggacuggccgcaguccuagcaggggugaccgaggcugggccaggcucugggagaaaccaggacuaagccuggcccagaucccugucuguggaaaacaccuccugacaccugccauggcccaauuucccaaaauacucagcccuguuuuccuaccuccacccgccagccucuacaccuaccuucuucuuuccccaggcccagagcaaucgaauggacccuacaagaaccagggauggggagagagugggcuucugaaacucagguggccuaaguuagaauagcauuauacaaauuguauccagcugucacuaagcaccaggcacugcccucagugccuuuauauacaucaucuguuagccuacaaaguggguacugcuacucuggccauuuuacagaugaggaaacugaggaucagagauguuaagacaccugcccaaggucccacagcaaguaaguggcaggauuugagccuaagccgucugguuccagacuccaaauuuauaaauuccuagaauagggucaucaacucaaauguuugcaaagggccaggcagguaauauggaugccaaauuggcuggguagggacuagcaagcaagagaccccaugacauugggggugauggcucacaccuuucaucccagcacuuugggaggccaaggcaggaggaucgcuugagccuaggagcccaggaguucgaguccagccagccugggcaacauagcaagaccuggcaucuaccaaaaaaaaaaaaagagagaccccaugaccuuuccaaggggagcagccaugacugauuugagcugauaguugccaugcaggaacgcaggccaaguguggcuaguucuuccaaguuuucaaggggaucuggaaauagggauauaagaaaucucuucaguuuuacaaguuggcagcaucuuccauuuuuuaagaaacacacugugugagccaagcaaaacacgucugcaagcuggcagugguccacagugugccgauuuguaaacucuguccucagacuuuagcauucacuauagcaagaacagcaaacacauaccuagugcuuacucugugccuggcacuguucuuuuucuuuuucuuccuuuuccuuuuccuuuccuuuccucuuucuuuuucuuucuuucuuuucuuucuuaucuuucuuuuuuuuuuuuuuuugagacagagucccacacugucacccaggcuggagugcaguggugcgaucucggcucacugcaaccucugccuccuggguucaagcaauucuccugccuuagccucccaagcuccugaguagccgggauuacaggcgcacaccaccacgcccggcuaauuuuuauauuuuuaguagagacaggguuucaccauguuggccaggcuggucuugaacuccugaccucaggugauccgcccaacucggccucccaaaguguugggaugaaaggcgugagccaccacucccagcccauuucauguauauuucauuuaauguuuauaccaacccuauaaggcagggaggugcuguuaucaaucucuauuuccagauaggaaauugaggcacacagagaacugacuugcucaagauuacacagcuagagcagagaaugaucccaggcagcccagcuccagaaucugcuguuugaucccuaugcaguaaaccuguuagaagcaugucauccagcccuuuuuuuuauuuuuauuuuuaauuuuuuuuugagacagagucuugcucuguugcccaggcuggagugcagucacaugaucucggcucacucaaacuucugccuccuggguucaagcaguucuccugccucagccucucaaguagcagggauuacaggcaugugccacgaugcccggcuaauuuuuguacuuuuaguagagacgggguuucgccauguuggccagguuggucucaaacuccugaccucaggugauccacacacuuuggccucccaaagugcugggauuauaggcaugaaccgccgcgcccggccauccagcccucuugauagggagguggggaaaccagaacagaacagagccuuugcaaagcuguccauucguuuacucaacagagacugaaugucucugguuucugccaggcacaguucuagguccuagggauauguaucagugauguaucccgauaggcggaaaaaaucucuacaguugagguuauggggagaucaguacauccccucuugucccugcagguggccaugguggaggugcagcuggagagugaccacgaguacccaccaggccugcugguggccuucagugccugcaccaccgugcugguggcugugcaccucuuugcacucauggucuccacgugucugcugccccacauugaagcugugagcaacauccacaaccucaacucuguccaccagucgccacaccagagacugcaccgcuacguggagcuggccuggggcuucuccacugcccugggcaccuuucucuuccuugcugaaguuguccugguugguugggucaaguuugugcccauuggggcucccuuggacacaccgacccccauggugcccacaucccgggugcccgggacucuggcaccaguggcuaccucccuuaguccagcuuccaaucucccacgguccucugcgucugcagcaccgucccaagcugagccagccugcccaccccggcaagccugugguggugguggggcccaugggccaggcuggcaagcagccauggccuccacagccaucaugguacccguggggcucguguuuguggccuuugcccugcauuucuaccgcuccuugguggcacacaagacagaccgcuacaagcaggaacuagaggaacugaaucgccugcagggggagcugcaggcugugugagacugguguuagccaccgcucacugcaagcacugccucccuccggggucuguaagaggccgcaggggccuacagaccucauccccccauccccuggcuggagccacuuccaguggccacucucaggcagaguucagauuccugcccgcaggguccucugggcugggccuuggggcagcucccacauucccagggauuuuccccaucagucugucccuuggguuuugcaagcuacucugcaccugggcuggccucaguugaaggaucaugcaguagauagaggggaggcagggagagcuugugggaccuucagugcugacuuuagccaccauuuccauuccuauacaggaugugaaggucagaaggcagccaauuguugguuuaauuuuuuuuuuuuuuugagacagucuguuucccaggcuggaguguagugauacagucacagcucacuguagccucgaccuuccaggcucaaaagaugcucccaccacagccucccagguagugaguagcugguacuacaggugugugcugccacacccgacuaauuuuuuuguagagacgggguuucgcuguucccaggcuggucucaaacuccugggcucaagugaaccucccgccucggccucccaaagugcugggauuccuuucuuuauuucuguagaaucuauuuuaugguuggcauuuugggggaagauuucgauggguuccacauucuugcuuuaguuguuguagagggauuuggguguuucuacccaaggcauuggucuagcuuuuccuacaaugaaccuaucuuuggagguucaagcuccccaccuucccccacuguggugaccuguggccacuugcagaagggauggugccugacccacugcccuagccccacgcuaugcaccaaacuuguucuccccguccugguccagggcuggggucuuuagagacugacagccucugccccaggccugaguccuuagcaaggguuggguaaggagguuuuaagggagaagguccaguccuuagcccuugaaauacaaagcucuucugacacugaauuuggaugcaccuuguuuuauauaauaaaucguguuucacagaugucccuguugcugugaaggggaugcagggcaggccuucuuaggauaacuuuacuuguucccaagagccgggugguggcaaguuuggguggacaggaccugggaggggaguggguuucagguguaacccugucagaugcuaacaagggccaacagcuucugaauggggaga

SEQ ID NO: 15425 - RNA, 1776 nt, Homo sapiens
ggaaggggcguggccaggauggugaccugcuguuucuccaacuccuggacuuuauuccccaguuugacaauagucugccgaauuguccggaccuggggagggugaccgagagggcugaaagagauaugggguacuccagaccacgcuacuccucggguccuccuacacccucgcgaauccaggcggagaccccagccccuuaccuuguggaagaacuccucguccgggcuccccagccgugccgugcccgggugcaccaccagcgcgacccgcuccuuguccucuucguccgagcugucaucccccugccaggcccggagucauuggcaccaccguuucgcugcggcucuuaccccgcaggacccacaggcuuccgggacuuuccuuccuggccaucagccaccccucccuaucccgaagaccagaaguccugcguuccaguucguccgcccguccccauccccgcugcccuggcgucucaccugucucagcucguggguccugucccgcauggcggccugagcucucccuccccggcgccagagccgggaggcccucaaauuuggaauucccguaccccgcucacacucugacacuccccucccucccccugcggaccccaacacccccacgagccgccagaggcuccgucccuugcaccgcccacagucaaugggaaggcgccgaccccggggaccccccaagguuccacagguuggaauucccuuuucuuccccgcuccagcucccgcagccucagccccgccccuccgugauaaauucggggcaugcgcacauggucgcgucucuuccuugcccgaggcugggaagguggagucggaaguuguugcgccccgagcggaagcggagaugccuggacgcgagaacuugcuaccgucaccggaaccguugcaucuuccaacggaaaucugguugccaaaagggguaggaauacgucauuuguacguaauccgagacacccgcaucucacaucaccccauggugcccccaccgcgucacgugaccagcccggucccaaacucguggaccgcagaaugugacccugugacugucacgugucccggcucugucaccgccgucucugggacgccguucucaucacgacguccccggcaccccaacgaccgagcgacgcccacacggcccccgcgagguggggaggggcgcgccgaccacccccagaggccuuucgaggcagugggugguaggacccuugcugaccucgccuuuauugcuuucggguccagggcgugggcggacugacgacuuagcauuuggggcugucagcaucaugggaccuugaaaaucgggaaauaauaggauccgagucgucagcgucagaaaauugcaggguugugugggcagggaaucugggggugggaagugaccucagccaaggcagaaaucucuucuuccgcauccuucuggcgcagccucugacaggugggcggccagccggcgcccuccuugaacacugcagcccggcugcacucaccaccuugugagccgucagaccaugucagggcagcucaggcuaagaaaaguguuuguauugaucacgcugccucccugccacucacaccccccagccccugccuugcaucugaggccagguaaugacuuuguucuuaacugaaucuggggaguuccuagcccaguaccaagaacauuacgggcccucuauaaauacuuguggacagaauuucaggcuuucauguaucugaggauaaagccccugguuccuuggucuucuuua

SEQ ID NO: 15426 - RNA, 3952 nt, Homo sapiens
ccauucgccgcccggccccugcuccguggcugguuuucuccgcgggcgccucgggcggaaccuggagauaaugggcagcaccugggggagcccuggcugggugcggcucgcucuuugccugacgggcuuagugcucucgcucuacgcgcugcacgugaaggcggcgcgcgcccgggaccgggauuaccgcgcgcucugcgacgugggcaccgccaucagcuguucgcgcgucuucuccuccaggugugcacgggagugggaggcguggggccucggagcagggcggccaggaugccagaugauuauucuggagucugggaucggugugcccggggaacggacacggggcuggacugcucgcggggucguugcacaggggcugagcuacccagcgauacugguguucgaaauaagagugcgaggcaagggaccagacagugcuggggacugggauuauuccggggacucgcacgugaauuggaugccaaggaauaacggugaccaggaaaggcggggaggcaggauggcgguagagauugacgauggucucaaggacggcgcgcaggugaagggggguguuggcgauggcugcgcccaggaacaagguggcccggucuggcugugcgugauggccaggcguuagcauaaugacggaauacagaggaggcgagugaguggccagggagcuggagauucugggguccagggcaaagauaaucugcccccgacucccagucucugaugcaaaaccgagugaaccguuauaccagccuugccauuuuaagaauuacuuaagggccgggcgcgguggcccacuccuguaaucccagcacuuugggaggccgaggcggauggaucacuugaagucaggaguugaccagccuggccaacauggugaaagccugucucuaccaaaaauagaaaaauuaaucgggcgcuauggcgggugccuuaaucccagcuacucgggggggcuaaggcaggagaaucgcuugaacccgggaggcggagguuucagugagccgagaucgcgccacugcacuccagccugggccagagugagacuccgucucaaaaaaaaaaaaaaaaaaaaaaaaaaagagacuuacuuaaggucuaagaugaaaagcagggccuacggaguagccacguccgggccuggucuggggagaggggaggauagggucagugacauggaauccugacguggccaaaggugcccggugccaggagaucaucgacccuuggacuaggaugggaggucggggaacagaggauagcccagguggcuucuuggaaaucaccuuucucgggcaggguccaaggcacuggguugacaguccuaaccugguuccaccccaccccaccccucugccagguggggcagggguuucgggcugguggagcaugugcugggacaggacagcauccucaaucaauccaacagcauauucgguugcaucuucuacacacuacagcuauuguuaggugaguggcuccgcccccucccugcccgccccgccccgccccucaucccccuuggucagcucagccccacuccaugcaaucuuggugauccacacagcugacagccagcuagcugcucaucacggagcguccugcggguggggauguggggagguaacuaacaggagucuuuuaauugguuuaaguacuguuagaggcugaagggcccuuaaagacauccuagguccccagguuuuuuguuuguuguuguuuugagacagggucuggcucuguugcccaaagugaggucuaggaugcccuuagugugcacuggcgugaucucaguucauggcaaccucugccucccugcccaagggauccucccaccuuagccucccaagcagcuggaaucacaggcgugcaccacuaugcccagcuaauuuuuguuuuuguuuuuuuuugguagagauggugucucgccauguugcccaggcuggucucaagcaaucugucugccucagccucccaaagugcuggggggauuacaggcgugagcuaccaugccccaccaacaccccaguuuuguggaaaagaugccgaaauuccuuuuuaaggagaagcugagcaugagcuaucuuuugucucauuuagugcucagcaggaaaauuuguaucuagucccauaagaacagagagaggaaccaagggaguggaagacgauggcgccccaggccuugcugaugccauaugccggagaugagacuauccauuaccacccuucccagcaggcucccacgcucccuuugagucacccuucccagcuccagagaaggcaucacugagggaggcccagcaccaugguccuggcugacacaugguucagacuuggccgauuuauuuaagaaauuuuauugcucagaacuuucccucccugggcaauggcaagagcuucagagaccagucccuuggaggggaccuguugaagccuucuuuuuuuuuuuuuuuaagaaauaaucuugcucuguugcccaggcuggagugcaguggcacaaucauagcucacuguaaccuggcucaagcgauccuccugaguagcuaggacuauaggcaugucacugcacccagcuaauuuuuuuuuuuuuuuuuuuuuuuuuuuugcgacauagucucgcucugucaccaggcuggagugcaguggcacgaucuuggcucacugcaaccucugccucccggguucaagcaauuuuccugccucagccuccugaguagcugggacuacaggcgcgugucaccacgcccagcuaauuuuuguauuuuuaguggagacaggguuucaccauguuggcuaggauggucucaaucucuugaccuggugauccauccgccuuggccucccaaagugcuaggauuacaggcgugagucaaccucaccgggcauuuuuuuuuugagacgaagucuugcucuugcugcccaagcuggaaugugguggcaugaucucggcucacugcaaccuccaccuccuagguucaagcgauucuccaccuuagccuccccagcagcugggauuacaggugcccaucaacacacccggcuaauuuuuguauuuuuauuagagaugggguuuugccauguuggccaggcugcucucgaacuccuaaccucaggugauccacccccauuggccucccaaaauacugggauuacaggcaugagccaccgugcccagcugaauuucuaaauuuuugauagagaucgggucuuucuauguugcccaagcuggucuugaacuccuagccuaaagcagucuucccaccucggccucccagaguguuuggaauacgugcguaagccaccacaucugcccuggagccucuuguuuuagagacccuucccagcagcuccuggcaucuagguagugcagugacaucauggaguguucgggagguggccagugccugaagcccacaccggacccucuucugccuugcagguugccugcggacacgcugggccucuguccugaugcugcugagcucccuggugucucucgcugguucugucuaccuggccuggauccuguucuucgugcucuaugauuucugcauuguuuguaucaccaccuaugcuaucaacgugagccugauguggcucaguuuccggaagguccaagaaccccagggcaaggcuaagaggcacugagcccucaacccaagccaggcugaccucaucugcuuugcuuuggcaugugagccuugccuaagggggcauaucugggucccuagaaggcccuagauguggggcuucuagauuacccccuccuccugccauacccgcacaugacaauggaccaaaugugccacacgcucgcucuuuuuuacacccagugccucugacucuguccccaugggcuggucuccaaagcucuuuccauugcccagggagggaagguucugagcaauaaaguuucuuagaucaaucagccaag

SEQ ID NO: 15427 - RNA, 4840 nt, Homo sapiens
cuuuccaguucuccucccagccccaccaggccgcccuuaggccuuucuucccuggcaagguggguaggguguuccuaccuaagaugucaucuggaguucugauucaggucuaaccuugagccuaccugauaucuuugcccaaauccuugguccuuucuaucagggccccaccuuuccuugcaguggggcacccagucccugcuagggccugccaaggcacaaccuuguauguucuuuuccuuggcagcagcagacacaguauuuuuaaccuacucaggcuugggaagcaguuggcucaggaguuugcccagucuggugaccuucaccucuagaaacugugacugccaggaaaggaagagucaaaacugaugcccgaagcugggucagucugggccuucaauauuaucugggacccggaaacauuuguucaacaagaugaaugaaagcucuuuguauaaggugcugcagucaucccacucccaccaaaucaaacaugcaacagacuugggacccauucuacuccuggccugccaggcucucagggcagguaagagacugggacacgaaccaguucaacccaagggcucagugaaccugaaugggggcagaaacaaaaguucaccugcccuccccacacacggggcccgagagggcauucaaaaugugaacuuuaauaacaggucagaguggggguuccccaggaacgagaaugacggaacuggugcuggaggccucagggugcccacuucccugcuccaaguucuggaggcgaggaggcaauggacccuguugaggcagggcagugcccagcuccauguaaguccaucugucugggucccugagacccaagaugcagcaguguguggagcagggggccgcccugccugacccgggagguccugcagggaaugcggcccaggcuggucgggugagcaggccaaaggcuguggggucagauccggaagcuuuccucccggccaucgauguggcggagccgcagguagacguccgugccaaugcccugcagggacugcagcugcagagacccaccgagguacuccgcguaggcccgugacgugggcaacccgaagccaaagcugggggugggcagggggacaggacaggaggcuucagaggcuugagucuccuggggucccccaccccuccauccuggccuggcagggucucacccgugcauggguccugacugggcgccacuaugcauguccagauggccaaagagggggcugauccggggguccugugugcuggccucagcaguagugaagugguaguccaugacccgguccagaucuuugugagcgauuccuccaccacggucugagauccuagcaagauggcaacaacaaugggcuuggcucagcuuugaugggguacucaccaccccccaagcagacagugcaaagucugccuuccuguuccuuccacccagagcuggaaugugguccaccuagacccuugggccuuguuuauaucauccucaccccugccagggccacugacugcuuauaccuucucacaggaugugacauuuauccucggcccagcauccuagaccgacuccugacuauuucucaauuucaagcuccucagcugcugacagaggcaggauaccuaggccugcagcuggccccagauccauuaauaagcagcucauggccaucucaggauucagagaauaguuugucuggucagggaccaagucccagaauggggcaggaaggggcucaagguccuaaaucaagucagaaacagugccuagacccccaucccauccaccucagcucaacucccacucagggcaaaccugaugaucagaucgacaucauuguuggcgauggugaugaccacaucugggacauuguagggagugucuaggugacucuccauuguggcucuaugcagaggggaaagaccaguagguacaagcaccccgguuccuguccgcccccaagccagcacaucaagccaccccaccucauggcauucuugagcagcuccggcaggauguaguccaguggcauagggaugaaggggaaccgggcagccacauggccauugaugcggacacggggcgcauugccauacuugugcucacacaggcgucugcggauaggagcgaggguucagucaggggccccuccaccagugguuugcaacuggaaacaauucugccccccuaaguaacauauggcaaugugcagagacauuuuuguuugucacaacuaggcaguacugcuggcgccagggaugcugcugaacuuccuaacgugcacggggcagccccugugacaaagaauuaucuggcuggaaaugucaauagugccaugguugagaaacccugcuccccgcagaucaugccccgggcaagggcucagacccaagccuucccugccccagaugucugcccacccccugagccauucuugccucaccuggcaaaguccacccacuucucaauaaucuucuuuggugagagacgaguacagaugaugccgacaaagucaggcuggccggagaaaggaggucaggacuacccacgccccuagccccaccccaagaugcuggcaacuucggaacugccccaaagcaccagccccacagccucagcccccaggcccuugacccggauccccagcccagucuccucugucucacuuaauguucccaggugggucucaggucccagagccccaccuuguccucaugcagcgccaggugaugcguggccaacaugcggauuccaagccucgaagucagcgucuuguccaagaaguagcggacgagcuuuucauccuguaaagagugaggucucagaaucccgugcccuucccacccccagcaggcccggccucuccuuugcugccccaaccucuaugugcuuccggcucucacguaggcccucugccaagagggucaccacauccuuguggucauccagcagcugucgcaccagcuggcaguacugggccucguccgccugguccuugaucugcaggucacagagucaugaggaagggugguccaagcccaaccucucagccccucacccugcucuggcccagcacucaccggagggaagucugucagcuucuggaaggcacggauauauagcucaugcugcaaggaagaggugugggaauucacaaagccgcaugggcacugagcagagaacagccacccccaccuacccauggggaucaccacccagcuggucgaccacgugaucaaacccccacuucgacccuuccaggcuccgugaauacacaccuuuggcuucugaaggccugggguugaauccuguguggcccugacaccuuuaggcaagcaaucgucugccacucugggccccagacuccccacuugcccccggggcaggguggcccgcugaccuaagguccucucuaccuuaccacgugcaguauggugggguugcagccaaugaugaaaggaaggcagcggaagcccuugaugcggugagcaauccucacuggaaguucuugcugcagguaccgagcacuuuucugggagaaaaugagaagggaaggcggggcuggagccugagugucugggagagcuccaggauccacgaggaaaauagagggcgugaaucuuaccagaagguggcugccguccugagagcggccagcguagagcaucauggugggcguuaggcggacugagggcuagagagggagagaggccuugagcagagaacccccaacacucucccucccgccuacaucccggacccugggcuggcugcccccuugcgcaccuucuccgcugccgcgucgauggccgacugguuguaaaaggaggugacggucuuggagcgcucccgagccaucuccacguggugugugucgguggccgacgucgagcgggcccggagcgcgagugcgggucccaggaggggccggagcggaagcccgcccccgggaccgcuccucagcaccgacgccaggaucaucgucuugcuccuuucagacccgguggccgcuaggacugaggauccgcuaggacugaggacccaggcgacccaaaauggggcaaggggguguggguggguaggggcucuucuccgacuucagggaccagggugcgucgaggaugcugacaggcucagcccgcggagagcagcucccaucuaccggggcggggaagaggaaguuguaaggauccgaauccacagaacccgcaccaucucuccaccugugcaucggucuccccagacccgggcgaccucuccccaccacucccaccgucuccccagaugcacacaggccgcgcccaaaggaccuagccucccgggggcuucuauuccccaacccgaggcucuacuggcggugggagggcugucgggggaggagccccucagacccuuccagcccgaaaaccucgccccagcgccccggggucccggguacccuucucagggggcggggcugccccugccugcccagcgccuucaaacccgggcccugggagcgcggccagcgaacgugcgacaccagcccugggccccuggggccggcuugggagggugcggcacggaguccccagcgggaccccccacgcgggucacuugguucggcccggaugccccccauaugguagaugccagccccgucugcgcgcccgcgcugugauggaggcugcggacgugcgccgcggggccuccgcggacugaguaggcuggggucgccccacuuaccgcggggccggagccagggcccgggucccagcggaagggcucgaacaguccacucgccaggcgcccagccgccugcgcccuccgccgccgugacgucgcgug

SEQ ID NO: 15428 - RNA, 13782 nt, Homo sapiens
ucacuucccuucccgcgauggcggcacagggagcugcugcggcgguugcggcggggacuucaggggucgcgggggagggcgagcccgggcccggggagaaugcggccgcugaggggaccgccccauccccgggccgcgucucuccgccgaccccggcgcgcggcgagccggaagucacgguggagaucggagaaacguaccugugccggcgaccggauagcaccuggcgugagggcggggcccagggcugggggcggggcggagcucagggccaggggguggggcggggccugaggacaggcugucagugaggccaagauccgggggcugggaguggagaggaggaggggcggggcuugaggaaagaacgccgcguuccgggcgcugagaaaccagccggguugugggaggcuguugaccuugaauuaugccgagcgacgccuacaaacccaccgcucaggccuucaccaggauuguucccauuccacuuccuugcccagucuuaggcuucauuccuuuuucuugcuaacgcugcuuccucacccucucuugucucugcgucuucuuuuuccauuugucccuggcagccauccgcagagagaagaccuuccagaaacaacaggcuucccuuuccuaaaguucugcugccuucucucauuuucaaaauuaaccccaaacuccuuaggguggcauucauuuuugugaccucuccaguuucuagccaacacuaggaaagggcauugccaggccagaacacacugugcccucugaagaccacacgcccuuuaccaccugugcccuuugcuuggaaugcuuuuucuucccuuucuccuuguuugccugccuagcuccuacucauccucuuagcuucauauccuuugugaugucauccuugauuccccuucaggcaaagugagugguucccuucucuauguuccugcaacauuuuuuuccuaccucagucauaguuuuuguaacauuauguuguaauuuucucucucugucuuccuccaucauacugggaacuucuggagggcagcacuucuugugauucaucacuguguccucuguacccggcaacaacacagcauagggccagacacguagugguugccuuacucauuuauugaaugcucugcuaauugucaggugcgcugcuaaaaauuuuggaggcauuaauucaccuucuaagguugguacuauuaucccuuuugucuuuuuuuuuuuuuuuuuuuuugagacaggaucucgcucugucacccaggugggauugccguggcacgaugacagcucacugaagccuagaccuucuaggcucaagugauccucccaccucacccucucagaguguugggauuacuggcaugagccacugugcccagcuguuaucccuuuucacagaugaagagacugaggcucagaaagauggaauaacuugcucaguuacacauagcuaggaaguagggagcuggaauuuuguguauuuuuuuuuguuuguuuguuugagauggaaucgcucucuguugccaggcuggagugcaguggcgccaucuuggcucacugcgaucucugccucccggauucaagcgauucuccugccucaaccuccugaguagcugggacuacaguugugcgccaccacacccagcuaauuuuuguauuuuuaguagagacgaaguuucaccauguuggccaggaugguuuugaccucuuaaccucgugauucacccaccucggccucccaaagugcugggauuacaggcgugagccacgaugcccagcccuggaauuauacauuaauguagguuaucuuaauccagagccagcacucaugaucccugaacaaaugaacaacugcggguaugugguaaaaugagcauugaauuuagagucagacuuaaauucaguuaaguauuagcucuuaccacuuuucaaaucugugacccuagguaagccucaguuuuguucuguuuuuugggguucuuuuuuuugagacagagucuugcucuugucacccaggccacagugcagugguacaaucucggcucacugcaaccucugccucccggguucaagcaauucuccugccucagccuugccucccagguucaagcaauuuuccugccucagccucccgaguaguugggauuacaggugugugccaccaugccuggcuuuuuuuuuuuucgucuuuuugguacagaugggguuuugccauguugaccaggcuggucucaaacuccuggccucaagugaucugcccaucucggccuccagaaguacugggauuacaggugugagccacacacccagccaguuauuuucucauucguaaaaugagaauaacagccucaaccugauccaccucacaguuguggcagugauugaguagaauggcagagguggaccagugagguuagcugauguguggcccugaacucuggaaacugcuucucagugugcaggauuccuuuuguuccagccuuaccuuccugaugacccuagccuuuuuccaucacagauucugcugaagugauccagucucgagugaacgaccaggagggccgagaggaauucuauguacacuacgugggcugugaguggcuuggcacaucugggcgugggugcagggaguuggcugcccuggcagcacucuuauggcccauacuuacaguuaaccggcggcuggacgaguggguagacaagaaccggcuggcgcugaccaagacagugaaggaugcuguacagaagaacucagagaaguaccugagcgagcucgcagagcagccugagcgcaagaucacucgcaaccaaaagcgcaagcaugaugagaucaaccaugugcagaagguccggaucccuucccauccacgggcccaggaggcccagcuucucugccaguucccuugggucucucgggccccagugccaaaaccauagcaaaucccauuucuuaagcuccuguagugugucagggacuuuaccuacuuccucuuacuuacuuuucauagguaagaaaacagacagaggguaagggcuucgcugcagucucacagcaaggaaauggcacagcugggacuagaacucaggccuccggcacugguagccucuuuugucuccuaguagcugugucuuaguagaaaaaaugacuugaaguucagugggaaagacgagaauguuauucggcaguugcuauagccaagcacccugccaagugcuguauauguauaagcuccucaaauccuucccaacaauucaacacacaggaauaguuacuuuuuugguaggugaggaagcaggcugagagagauuaaguaacaugcccaaggucacacagccaguaaaacggugggcuggaauuagaauaauaaugccaaacacuuguuagccggugagcagaaguauucagcuaaaugguuuuuguguguguguguguguguguguguguguguuuuguuuuuuguuuuuuuuuuugagacggagucuugcucugucgcccagguuggaguacaguggaaugaucucggcucacuguaaacuccgccaccuggguucaagcaauuuuccugucucagccucccaaguagcuaggacuacagguaccugccaccacgcccggauaauuuuuguauuuuuaguagagacgagguuucgccauauuggucaggcuggucucgaacuccugaccucaggugaucugcccaccucggccucccaaagugcugggauuacaggcgugagcuacugcgcccggccuaagcuaaguguuuuaauacaugaccucacugacauuucacaguaggccugugaaguaagcaugcagaagagcuacagauaaguuuagggacccagacaggaauuugaucaaccagcuaaauugugcuaccucagagccagaggccuuagcaaugauuuugguuuuuuucuuaagagacgggagucuugguguguugcucaggcuggacuugaacuccugggcucaaauguucuuccugccuuagccuucuaaguagcugggacuacaggagugcaucccuguaccugccuugguuuuuucuuguauugauacuuaauaauuguacauauuauuguuauuuuuuuuuuuugagacagcgucuuacucuaucgucuaggcugagugcaguggcacaaucauggcucacuucagccucaaccuccugggcucaagcaauccuccugccucagccuccugaguagcugggaccauaggcacgugccaccaugcccagcuaauuuuuuauuuuuuuguagagacgggaucugcuauguugcccacacuagucucaaacuccuggucucaagcgauccuccugccuuagccucccaaagugcugggauuacaggugugagccacugcgcccgaccaagucucaguuucuaaauuuauaaaaaucaggagugcacaccagagcaagauuugucaaagucuccagacacccagacauuuguuacuuucagcuauugcagcuucauccuucugaguacaugaguuagugggcaagcccaacauuuaaauuucuuuaaauggaagaaagaaaguggauaagauagaaaaaucaggguguugcacuuuauuaaguguagguauuguuuugagaagcuuuuauuucacacccaauaaaagugugcaggauuccucuuguuccagccuuaccuucccgaugauccuagcacauacuuguguguauauacagacauguuacagugccaaguguacuuccuacuguggugugauuuaaaaaauugaaauacccuaaacuggaagaacuccucaaggucuaaacugccgaaucgaacuuccuauuguaauggaaauguucuauagcuguacuaucuaguaccguagccacuagccacauguagcuguugagcacuugaaaugugucuagugugacgaagaauuaagaauuuuagcugggcgcgguggcuuacgccuguaaucccagcacuuugggaggccaagguggguggaucaccaggucagaagaucgagaccaucccggcuaacauggugaaaccccaucucuacugaaaaauacaaaauaauuagccgggcgugguggcgugcaccuguagucccagcuacucgggaggcugagguaggagaauggcgugaacccgggagguggagcuuguagugagccgagauccugggcucacuccagccugggugacagagugagacuccgucucaaaaaaaaaaaaauuuuuaaauuaugggugcaguggcucacgccuguaaucccaacacuuugggaggcggagguggguggaucacuuaaggucaggggauugagaccagccuggccaacauggccaaaaccccaucucuacuaaaaauacaaaaauuagccgggcgugguggugcacaccuguaaucccggcuacuuaggaggcugaggcaggagaaucgcuugagcccaggagauggagguugcagucagccaagaucaugccacugcacuccauccagccuggguguccgaucaagacugucucaaaaaaaaauuaauuaucauuuuuuaaaaaaauuuuauuuuuauuuuuucgagacagagucucacucuguuaaccaggcuggagugcaguggugcgaucucagcucacugcaaccuccgccucccagauucaagugaguuuccugccgcagccucccaaguagcugggacuacaggcacgcaccaucaugccuggcuaauuuuuguauuuuuaguagagauaggguuucacuauguuuggccucaaacuccugaccucaacugauccgccugccucggccucccaaagugcugggauuacaggugugagccaccgugcccagccaaaauuuucauuuuuugagacagagucucacucugucaccuaggcgggaguacaguggcgagcucuuggguuacugcaaccuccgccuuccuggcuuaagcaauuuuugugccucagccucccaaguaucugagauuacaggcgugugccaccacacccagcuauuuuuuauuuuuuauuuuuaguagagaugggguuucgccauguuggccagacuggucuggaacuccuggccucaagugguccucccaccucggccucucaaagugcugggauuacaggcgugagccaccacguuuagcugaguauaauuuuaaauagcccuaugugacaaguggcuacuuuauuggacaguguagaucuaagauuaauuccucaacuguuuugcacucaacaaagacauaccucugaguuggcaaccagcaggguggauaacgggccaguggugauaaaaucaaagaauagguaaugaaacaaucauccaguuaacaaucagcaagguucuucagagccuaauuaauguuuaauucuaaauaaauugcaacaauuaagaaaaguaguguuuuuguaguucuuuauugcauuugcagaagaguacuguauuuugugagaauugggaaauguguuuuaaagagaugugugaggaggaaaaucuuucuuccucaucuuuacagugguuagguucagaauuggacagaccaggggcccaugcccaacucugcugaguaccaguucugugaccuugggcaagugaccucaccucuuugugccucaguuuucucucauacaacagggacaaugagcacucuuauuucaaaggcucauugugaggaacaaaaugaaauaaugucggcugggugcaguggcucaugccuguaaucccagcacucugggaagcugagaugauuggaucauuugaggucaggaguucgagaucagccuggccaauauggugaaagcccgucucuacuaaaaauacaaaaagaggccaggcgcaggcagaccacgaggucaggaguuggaggccagcauggccaacauggugaaacccugucuuuacuaaagauacaaaaaauuagcugggugugauggugcacaccuguaaucccagcuacuugggaggcuggggcaggagaaucgcuugaacccaggaggcgagguugcagugacgugagauuuugccauugcacuccagccugggcgacagggcgaggcuccauuucaaaaaaaaaaaaaaaaaaaaggcuauggcucaugccuguaaucccagcacuuugagaggccaagguggguggaucaucugaaggucagaaguucaagaccagccuggccaacauggugaaaccccaucucuaccaaaaauacaaaaaauuagccgggcuugcuggugggcgccuguaaucccagcugcuugggacacugaggugggaagaucgcuugaacucaggagguggagguuguagugagccaagauugcaccauugcuccagccugggcaacaagagcaaaauuucaucucaaaaaacaaaauaaauuagcugggaaugguagcaggcacauguagucucagccacuugggaggcugacguaggagaaucacuuaagcccagaaggcagagguuguggugagcugagaucuccccacugcacuccagccugggcgacagagugagagucuaucucagaagaaaaaaaaaaaaacaugucugugccgugcuugccacuuggaauaaauggcagcucacuaguccccgaggguaagggaccucaccuugcccugccuguuuacuacucuguaaaauugaaauaacgcagcugggugcaguggcucacgccuguaaucucagcacuuugggagugcgaggcugguugaucaccugaggucaggaguuugagaacagccuggccaacauggcgaaacuccauugcuacuaaacauacaaaaauuaccuggauguggcggcaugugccuguagucccagcuacuugggaggcugaggcaggagaauugcuugaaccugggaggcggagguugcagugagccgagauggugccacuguacuccagccugagcaacagagugagacuccgucucaaaaaaaaaaaaaaaaaaaaaagaaauaacacucuauguaaggguuacugaaaggauuaaaugaggccauauaaacauauaggcacagugcuuuguggaggggguucuggguaaagcacuggcuccuuccucccuucucagcuacagggcagggccuugucugcccugguguaggucauggaccgucuugggucccccuuccauugucaggcuguacuggguuccucccacagggucuggccuaggagcaggauguguugugaguguggugugacucuuagucucugcuuucuaaggacuugaaaaauagaggaacccaggugggcauacuuggacaguguugcccuguugaccacuucucgcugaacuugggaaggagggaauguuuucuggaugggaagaauccagucaggccuccuggagggggugguaagaaucucaagccuugaaggaugggaaagagcacaauaacaacagugacaaaggauagaucacaaagcaucauggacucaccugacucaugcuccgugccaggcugaggaaguguuuucugcuggcagugagagaaggaagggcauucuccagguagaaggagcuguuugugcagaagcaugaaggccgcuaaaagggggcugcugauagcaaugaggaggcuggggcuggaggcagggagucugaggcggccuaguaaauuguccagaccugagauggggccaugacuaccuggagcaggacagagaggagaauuccagagagggcccaauuccagagaugucagaaguagacucgacauccacuguauuaggacuuggccaggccgagggagagagaguagucugaggcaagccuaguuaugggucuuggacacugggaccaagggugauguucccaguaaaaugagcaacccaggaggaggcgcagguuugcagggaggagugaugagguccuuucugcacaucuugaguccgcugucccugugggagggaccucuggggcagucgcaugggcaggcagggucugguccucaggaaagggguccaggaacaucggggagguaguaacaguucuuacgcugggccuggaaggcaaaucuguuauuucauuugagucucacaacuuuggcagagcuggauugccccccaucgugcagcugaagccccauccugauccuaacccuguucaucuggcaaaagguccaaacuuggacaucagggaugucugggauaucggggguggggcgggugggugugagaggagucuggaccagccagcuucagaaccaagucagauagguuagcuauuggugugguuauuauugccauccaggaaugaggucugguagacggcagggaagccuuguggguccugacgggagggacagccuggucaccacuucuguucaccucugcccacuuuucuuuccuggcccagacuuaugcagagauggaccccaccacagcagccuuggagaaggagcaugaggcgguaaguggggcugggaagcugccugcaggucccccgucuccccuugccgaggagccccugcugagccgugcacugugccucacucccacccugccugcagaucaccaaggugaaguauguggacaagauccacaucgggaacuacgaaauugaugccugguauuucucaccauuccccgaagacuaugggaaacagcccaagcucuggcucugcgaguacugccucaaguacaugaaauaugagaagagcuaccgcuuccacuuggugaggcugggccggccgggccgagcugggcaggggcccggugagaggcagaggcaggcauggagacugagggcggcugcgccggcagcuccagggaggagacaggcccaaaggagcgaguacagggaagagcugcugggggucaggaggccuggauuccaggccuggcuuugcuguugcuggcagggugaccuugccaacuucagaccucagcuccucuucucuggaauggggacaguaacucacccccuucaggucuuuugccaaggccagcuccaucccaggaagcacacauagccccuggcagugggaccuuaaguguggaugaaauugggggcugucaggaaggggcgcucucaucacugacacagugggcugcuucccgaaguguggaaucugaagcgaauaggugugguuuagggaagccauugucauggacgggucccuccagagccaggcccacagagacucaaaaccccaccgugcugugugauguuuggaucucugugccugggccuuggucuguaaaagcaggaucacuuuccuaaggcugcugggaggauuacucgauguaggugaaguguugaggggggaaacagagaggcagagacuugcuccaaagcaugcagugguggguugggugccuccuagcagagaacauaugggcagcgaaccuguucucuuguccccgaccagggucagugccaguggcggcagccccccgggaaagagaucuaccgcaagagcaacaucuccguguacgaaguugauggcaaagaccauaaggugaguggguggccagggguugggagaggccggggaggcccugggcaccucccagaugauccucaucaccaccaaaggggagggggcagccuuagcugagccucuaugggcagaaugccucugaggggccgggcacugcagcucacaccuguaauccuagcacuuuuggaggcugaggugggcagauugccugagcucaggaguuugagagcagccuggguaacaugacgaaacuccucgacuaaaaauacaaaaaauuagcuggcgugguggugcgcaccuguaaucccagcuacucgggaggcugaggcacaagaauugcuugaaccugggaggcagagguugcagugagcugagauugugccacuguacuccagccuggucgucagauugagaaucugucucaaaaaaaaaaaagaaggccucugagggccuccuagccuggcacuaggccuguaguuggugcauaggaaacacagggccuugugguggccccaagacucuucugcuggugggguuagguucaaacuuggguuguucuggaacccagaggagauuuucuugccugaggcugcuuuuagaagugcucucuccuuccguuggaaagaaagguguuuguuuuugccugggaggggacugcuuugugugaaauuuccuccugagagagcucuguggcuuucaagguuugaguuccuuguuccuggccccgaaugacuucagcagggcagguuggggccuuugggaccugccuagcuguuguagagaacuuggccuuugccuuaucagucugggagggucuggccaaguguacugguuucccgcagaugggccauacagcacaggacagagagggcaggcuucaggguggcucauguugccuugucacuuccucacugaccacagacaaguuacuuaacaugguuuguuccuguuuccuuguccauaagacgggagucauaauauuuaauauuuaccuaguuguguuguuaguggaauaaaugagacagcaaaugucaaguguuuagugcagugcuuagcacuaguaugugcuuaauaaacacgggccuuguuauuaucggugaccucuuggggcuugauuagccuuggacucggagaauacgcaggcugagcccagcccuugccccugcucugccuuccugagcauggcuguguggaauagcagaagggcccccgcuggagaugugggggugcuuuccaacugcgcucugccagcuuugaggcucugggcaagcacuuccacucugggagcuucagcuuccuccugaguaagaugggccuggcagugcugggcucgcacagcugccggguuggaugagagaguggcuguggugucauaaaccagggagccccuuagugugugccgugaagccaaacucggucccauugucccccuccuggagugcagccaaguggacagacagggcucgagguuccuccauucagcagacguuuaccaggcacccagcuucauacuuagacucgugcuaggcgcuggggacacagccaugaacaggacggucuaaauuccugccucggagccucaguuucacgagcugaaacagaguuaaugucugugaagacugaagcagauccugcauggaaggcacccagcucguauuuggcacucagaagggguggccgggcuucauccagcuccacuggcaccuccgaagugcuguugcucucucauuuccaguucccuguucgucagaggcugaccgaagacuccuuccagugugaaauccuucuggccuggcgaggcgcccacuucgcgugggcuggugccggccgcuggaaccagcuggguggggccugugccugcccccugagccugucuccccccuccucaacccuagauuuacugucagaaccugugucugcuggccaagcuuuuccuggaccauaagacacuguacuuugacguggagccguucgucuuuuacauccugacugagguggaccggcagggggcccacauuguuggcuacuucuccaaggugcugggucuggaaacucgggguggggaggguggggagggcgaaggugggcaugaacagagaguggggcagagccuccccagcggcccugagcaccugccuccugcaggagaaggaguccccggauggaaacaauguggccugcauccugaccuugccccccuaccaacgccgcggcuacgggaaguuccucaucgcuuucagugagugguuccuggccugucugggagggggagaccuguggggcaggggugccagggcaggcuggauccuaaguuccucuuucuacugcugccagguuaugagcucuccaagcuggagagcacagucggcuccccggagaagccacugucugaccugggcaagcucagcuaccgcagcuacugguccugggugcugcuagagauccugcgggacuuccggggcacacuguccaucaaggaccucaggugagggggccucccgggcccugggggcaggacuugcccugagaugggccacgauccugcuuccucauacccugucaccauccuggccagaucccacaagggcaccaggucuggcauuugcucucaucccuuuuugcagccagaugaccaguaucacccaaaaugacaucaucaguacccugcaaucccucaauauggucaaguacuggaagggccagcacgugaucugugucacacccaagcugguggaggagcaccucaaaagugcccaguauaagaaaccacccaucacagguggguggggggcugcugugugucgggggcggugggggagugucaguauauggacugguaggagucaaggccuccuuauugcugucacaugaucccaaaccagucagaccagcucccaggauggagcccggggcaggccucucauuccugggcuucccuaccccuccccagcacagccugcccuuuuguucucaccuggaggaggugaaacuggccugagcccagaggagggcagccaggugugagcuggccuggcccaggcccagcccugccucccgccccuucuccccacaguggacuccgucugccucaagugggcaccccccaagcacaagcaagucaagcucuccaagaagugagcagccuggccccugcugucggaccugagccuccuggcucccagccuguaaauauguauagaccuguuuugucauuuuuuuaauaaagucaguucugguggcccuggacuuuggaggggaaggggaggccaagagcggauguucuucauuucacuucacacaugcacggcaaguugugcucaaacau

SEQ ID NO: 15429 - RNA, 3499 nt, Homo sapiens
gcagugagauguuggggaguuaggagauuuaaaaucagggaauugggagaggucuugcuggaaagguaauauugagcaaagucugagggaggaaaaagaggaugccaugcaguaccuggguuggagaguguuccaggcagaggggaccguaagugcaaagucccugaugccgagugaucaauggggaaaggggugauaaaagagucagagugauuaauggggucauagcagauagggcuuuguaagccacaguuagcacuuugguuuuuauucuagaugaaauuucuuucuuuucuuuuuuuuaauauuuauuguuuuuuuugagacggaguuuugcucuuguugcccaugcuggagugcaauggcaugaucuuggcucacugcaaccucugcuucccagguucaagcaauccucccaucucagccucccgagcagcugggacuacagguguucuucaccaugcccagcuauuuuuuuugaguuggaguuucgcucuugucacccaggcuggaguccaguggugcgaucucgguucacugcaaccucugccucccggguucaagcgauucuccugccucagccucccaaguagcugggauuacagguaccugccaccacacccggcugaguuuuguauguuucauagagacgaaguuuaaccauguuggccaggcuggucucaaacuccugaccucaagugauccacccgccugggccccccaaagugcugggauuacaggugugagccauugugccuggcccuugccaacuuuuuaaugggguuguuuucugcuuguugaaauguuuaguuucuuuauauauucuggauaguagaucuuuguuggaugcauaguuugugaauauuuucuuccauucuuuuuuuuugagacggagucucacucuguaccccaggcuggagugcaguggcgcgaucucggcucacugcaagcuccgucucccggguucacaccauucuccugccucagccuccugaguagcugggauuacaggugcccgccacugcgcccggcuaauuuuuuguauuuuuaguagagacgggguuucacuguggucucgaucuccugaccucaugauccacccgccuuggccucccaagagugcugggauuacaggcgugagccaccgcgccuggccuuucuuccauucuucaguugucugucuguugauaguugcuuuugcuuuugcugugcagaagcucuuuaguuuaaugaggucccacuuaacaauuuuuguuuuuguugcuuuugaggacuuagucaagaauucuuuaccaaggcugauauccagaauaguauuucuccugcgguuucuucuaugauuuuuaugguuugaagucuuacauuuaaaucuuuaacccaucuugaguuaauuuuuuuuauauggugaaagguagggguccaguuucauucucuugcauaaggcuagccaguuaucccagcgccacuuaaaugaaauuucagcugagauuugaaagauacacauacaggaaccagggcagaauugaguucugggcugcaggcucuggauucaguucauucauuuguucaaugucucucuaucauucauucuccaagcauuuagagaggccuacuuugucccaggcuuguccuggguguacuagagagaccaaaguggaaaagacccuccccucagcucuggaggaagaaaacauuucaggguggggugagguccugcccuccugcaggugggguaauccugccagggugaccuuggucagccauaaacuuggggaaugagugggugacaggcuggggaggggcugccagcaaggaggaaggagcuggagaguguggaggugggaguggggggagaaagggcagacccccuucaauuuucugucuuuucuguggugugaaaggcccuggcuccccgcuggcucugagcucugacuccaggcaggccggggagagaacaguggaugggccaagacagguggcccugucaugugaugugugcccagggacuacucagcccucacuuuuagaacgguuuccggaagugaugggagggauugggcagggcagcuaaauauaguccuggggccauggcucagucugggagggucuuccgcugagcacugugugcccaucacgcgugguguccacugccagcugccccugugagucccuguccuugcuuggagccugcugcuugucucagauccuuggacccagcccugaccccaguccagcuaagcucaacccugaccgguccuccuucgagacucuuucagccuaagaucuccaaccagaccugugagucccgugggcuggagagagggggaggggaggucuggguaucuugguaaagugagggaggggagucucggagugggggcucuggagaauuuggguccgggacuaaggucagaggcugaggccuggggcuaaggcgagggcaaggacagugggcuagaaucugggcuuguguucaggaacugggguugacugauagggcauauuuuugggguuggagcugagaauugcaguggaggcugcuuuugggccugagaccgaguuccucuuuccccuuggccgucagagucccauccaguguaggaugugaggucuuuacaggcuggggcuucucccugcggggcggcgggcccggccugggcuagggcugggccagggcugggccgggagcgcggcgccgcggggucccccuaaccuacuccuccuccacccaggcccgccaugucggcugcgcccggccuccugcaccaggagcuguccugcccgcugugccugcagcuguucgacgcgcccgugacagccgagugcggccacaguuucugccgcgccugccuaggccgcguggccggggagccggcggcggauggcaccguucucugccccugcugccaggcccccacgcggccgcaggcacucagcaccaaccugcagcuggcgcgccugguggaggggcuggcccaggugccgcagggccacugcgaggagcaccuggacccgcugagcaucuacugcgagcaggaccgcgcgcuggugugcggagugugcgccucacucggcucgcaccgcggucaucgccuccugccugccgccgaggcccacgcacgccucaaggugcgggauccgcgcgcaucguggucggaggggcuguucgguggcacggggccgauggggaggucgcugcagugauuuggauucugagucucuagagaggcucacgagcuccuggaguugcggggggcgggggcggggcgaagcagccaggaaagagggucugaggagcuuaaggcggggcuggcagaggaaagccgcgcagggauggagccuggcgauaagggcgcugagcaaacguagguuucccggccuuagucccuagaggaaacuggagaugggcgggcggagccccagggcgggucugaugggccgggcggagccaggcggagcagggacugaccagccccugcggcccacgcucgcauuccug

SEQ ID NO: 15430 - RNA, 10823 nt, Homo sapiens
ggcccgccaugucggcugcgcccggccuccugcaccaggagcuguccugcccgcugugccugcagcuguucgacgcgcccgugacagccgagugcggccacaguuucugccgcgccugccuaggccgcguggccggggagccggcggcggauggcaccguucucugccccugcugccaggcccccacgcggccgcaggcacucagcaccaaccugcagcuggcgcgccugguggaggggcuggcccaggugccgcagggccacugcgaggagcaccuggacccgcugagcaucuacugcgagcaggaccgcgcgcuggugugcggagugugcgccucacucggcucgcaccgcggucaucgccuccugccugccgccgaggcccacgcacgccucaaggugcgggauccgcgcgcaucguggucggaggggcuguucgguggcacggggccgauggggaggucgcugcagugauuuggauucugagucucuagagaggcucacgagcuccuggaguugcggggggcgggggcggggcgaagcagccaggaaagagggucugaggagcuuaaggcggggcuggcagaggaaagccgcgcagggauggagccuggcgauaagggcgcugagcaaacguagguuucccggccuuagucccuagaggaaacuggagaugggcgggcggagccccagggcgggucugaugggccgggcggagccaggcggagcagggacugaccagccccugcggcccacgcucgcauuccugcacccggugggccguucgggcuggcucccugcucggcgcuggcccacuuuggacuggaggcgcggcguucgggaccgagccaggcggccggggcaggguuguccccuugugcucagcggaggcccacgcaccccugaagcugcggaacuugggcuggccugacgguccccaggcggggccucaccagaagggagacuguaagggcuaggcagccgggaucugcacuuaugugugcgggcccaggguggcaccgagagccccguccaggauguuuuucuggguggagcuggaagucccgaaagccuugggagcccacacgcaguugugcgcgucccgaaguacccagcagagacacccagacagaggcaaauagagacgaacgcacacuggcuggugcgugucauccguguggcaaaagcacacacguauagcuaccggcgggcacgugugcgcgcagccccaguaaagucugccaugaauauuuauugggcaguggaagaauaaaugacaggugcaggggcuggaggaggcggggucuggaggcacggaggcguccuugguccccgagguggagacacugcuguugucuuacgcgacuggugcgcgcguggggcuggcuucacaggcguugcauuacuccuuuugccuugacccgccuccuagaagggguagaccaccguccuuucguugguauucgaggcccccagacuucccagggacccagccucucaguccugccuggcccaguucagcccaguccuagcugguggucuccuagcucagggcaggagccuccucccgggaccccucccaucccagcacaccugugcuuaagaccccaaccucagggcaacccgcucggauccccuuccaugcuguggaagcuuuguucuuuugcucuuugcaauaaaucuugcugccgcuaaaaaaaaaacaaaaaacaaacaaacaaaaaaaacccaaccucgcccaaccuugcccgucuuuaucugcgaagaaagcacagaacccaugaaacggaacagggcccaggcagcccaggagccuggaagggggcaguggggcgagaugcagcccaccaggguucgcggcagcccagcccuucgcccccgggaggggcuggccggaggucugagggaggaccccaggagggacccugaaggaggggaacaggaaggcucugggcgggaccugacgcguggguccuuggcgaggaagcgggguugggucccgagaucacguaccagcucagaguggcccucacgcagcccgcugcagccgugcggccuccuccaacaugcgcaugucgcgcagcacggccacgacgagcucggcugcguaguccucguaguaggaggcgaccagcuugucggugagguccacgauaucuagcugcccgagcgcgccccgcgggaugcgcucaaagcccucgcgcagcggcaccguccccagcuucaucuugaacuucuugagcuccuccggugucagguucuccagcaccuucaggauggccucgcgcuucguucccauggcucagcccugcgccucugagccuccgagggccuggagccaucagguccuaccuuuccugcagcagguggagcugccgcccccggggaugucccgggaaggagacugaucuggcagcuccuauucaacccuguggcuccugcugggaggggacucugcaaacaccgccuagagggucccccaguuuccccugggagagugggggcgccaaauuguugagguggggauugcuguucccaaucugcagaggaggaaacagguugcaagucauugaggcaggaauggaacugauuccauggucaggcaccucccagcaaagaaguggcuuuguagccuggcaugguugcucaugcuuguagugccagcuacucgggaggcugaagcaaaaggauugcuugagccuaggaguucgaguugugauucugccacugcacuccagccuaggcaauccugucuccaaaaaaaaaaaaaaaaaaaaaaaaaauggcuuuggcaggaguauugggagcucuccuauauuugcauauuugcauuugaggucuuggguaagaucuagaccacagaaugguuggucugugcaggggacauuuuuuuuuuuuuuuuugaaaugcagucuugcucugucgcccaggcuagagugcaguggcacauucuuggcucacugcaaccuccgccucccugguucaagugauucuccugccucagccucccgaguagcugggauuacaggcacuugccacagcgcccagguaauuuuuguauuuuuaguagaaaugggguuucacuaucuuggucuggcuggccuugaacuccugaccucgugauccacccgcccuggccucccaaagugcugggauuacaggugugagccaccacgcccggccagcaggggacauuuuaauuaaauuuccugcccccuacuccaagcccauguguguacaggcaggcugacuugguggucaggcugacaggcugacugaggcugauguucugcuuuuaaguaagagaggaagcccaggaguagggguagguugccuuucuucuuucauauauccuucauguacccccugaggucuguugugugccaagcucugugccugccugucuggugggagagaccaaaccacacugauguuugucauccucgcaaagaccugugcuauggggcugacugcugagcagaggggaucagggaaggcaaggccagggaggggucaacaaaacagacaaggggcuggggguguggcgguucaugccuguaaucccagcaugcugggaggcugaggugggaggauugcuugaggccaggaguuggagaccagucugggcaauauagugagauugucucuacaaaaauauuuuaaaaaaucauggccaggagugguggcucaugucuaaucccagcacuucgggaggcugacguggguggaucaccugaggucagaaguuugagaccagccuggccaacauggugaaacccugucucuacuaaaaauaccaaaauuagccaggcgugguggugcaccaaaauuagucccagcuacuugggaggcugaggcaggagaaucgcuugaacccaggagguggagguugcagugagcugagauugugccacugcacugcauccugggugacagagcgagacuccaacucaaaaaaaaaaaaaucagaaaauuugcugggcacgguggugugugccuauaguuccagcuacuugggagacugaagugagagggucaauuaagccugggaaguugaagcuguaguuaacugugaucaugccacugcuccagccagggcaacagugugagacccugucucaaaacaaaacaccaaaauaaauaaauaaaaaaccgcaccaaaauagacaaggggcaggggaagcauucggaccucaggaguagcacuggcuggggcugggaggcauguaaguggguuuggggaugggaagauggcuggaggaggagcuggcauugagguugagccacagagggcagguuuaggaugggagguguggguuuuggguggguggcauccccaucacuucuccaugccucgacccccagacacagcugccacagcagaaacugcagcugcaggaggcaugcaugcgcaaggagaagaguguggcugugcuggagcaucagcugguggagguggaggugaggacuucacagggccaugucugagggcugggggccaggcuaggggucuccagccaagagucuuuaucccuucaaucacugccccaucccugcaggagacagugcgucaguuccggggggccgugggggagcagcugggcaagaugcggguguuccuggcugcacuggagggcuccuuggaccgcgaggcagagcguguacggggugaggcaggggucgccuugcgccgggagcuggggagccugaacucuuaccuggagcagcugcggcagauggagaagguccuggaggagguggcggacaagccgcagacugaguuccucauggugagcacugggugaccccccucccugccucagcccccugcucagggcccagagaccucaucccauugucagauaggcccagagaggggcagggauaagccagcagcacacagccgggaggggcaggccucaggacugcuauaugguuguuuagguugagcacugcauaaggacauuguauuaagugagcacuauucauaucauagacauuguagguuuauauauuuauuaggacacucuuauuuuuauuuuuuauuuuuugagauggagucuuacucugucacccaggcuggagugcaguggcaggaucuuggcucacugcaagcuccgccuccuggguucaugcuauucuccugccucagccucccgaguagcugggacuacaggcacccgccaccacgccuggcuaauuuuuucuauuuuucaguagagacaggguuucaccguguuagccaggauggucuugaucuccugaccuugugauccaccugccuuagccucccaaagugcugggauuacaggcgugagccaccgcgccuggucuuuuuuuuaaaggcagggucucacucugucacccaggcuggagugcaguggcaugaucauagcucacugcagccuuguaggcucaagcaauccuccaaucucagccucccauagcugggacuacaggcgcuuaccuggcuaguuuuuguauuuuuaguagagaugggggucucauuauguugcccagacuggucucaaaugccugggcucaaacaaucugccugccuuggccucccaaagugcugggauuacaggcaugagucaccgcacccggccuauuaggacaguuuucuaacagguggaaucagaguuucuuggaggcaaagauaccuuuuuguaauccacauaaaagugaagggguagggguggccuugaguucuaggucucuuuugcguuuuuuuuuuuuuuuuuuuuuuuuuuuuuugagacagggcuuugcucuguugcccaggcuggagugcaguggcaugacuucggcucacugaaaccuccuucucccggguucaagugauuuucguggcucagccucccaaguagcugggauuacaggugccugccaccaugcccagcuauuuuuuuuguauuuuuaguagagaugggguuucaccauguuggccaggcuggucucgaacuccuggccucaagcaauccacacaccuuggccucccaaaguguugagauuacaggcaugagccaccucgucuggccucuuuuagcuuuucugauucuuucugacguugcacucagcauuccuaguugucuaccccauccucaaaaguuuccaguguccccaccaucggcuucaccaccauucucuuuuucucucucuccagaaauacugccuggugaccagcaggugagagcaaccuggcccugucccuuugcccgacuugucccagucuucuagggacaccagccggcucacucuccacucacuauugugccugcacacccgcaauucagucugcugccccaccccugccugaacacaagguuguagacagaaaugaucuggaaggauccuuucacucagggaccuccuagauuggugccgugagacacauguggguggggacacaggcgucacugugugcucaguguggccguugagggaaagagguggccagggauggagugaauguuugaguuggggccuggagggaugaacaggagcuggcuaggcaaagcguugggagaagaagggcauugugaggagaaaggcauugcggggagaagggcauugcugagagaagaaggguauugcugggagaagaacauugcugggaaaagaagggcauugcugggagaagggcauuauggggagaagggcauugcggggagaagggcacugcugggagaagggcauugcugggagaagggcauuucugggagaagaaggacauugcugggagaagaagggcauugcugggagaagggcauuauggggagaagggcauugcagggagaagggcauuguggggagaagggcauuguggggagaagggcacugcggggagaagggcauugcuggggagaagggcauugggagaagggcauugcugggagaagggcauugcugggagaagaagggcauugcuaggagaagggcauugcugggagaagaagggcauuguggggagaagggcauugcggggagaaaggcauugcugggagaagaagcgcacuguggggagaagggcauugcugggagaagggcauugcugggagaagggcauugcggggagaaggguauugcugggagaagaagggcauugcagagagaagggcauuguggggagaagggcauugcagggaaaagggcguugcugggagaaggguguugcuggcagaaggguguugcugggagaagggcauugcugggagaaggguguugcugggagaauggcauugcugggagaggggacagccagcgagagggcuggcgagugggagggaagaggaagcugcgguaguaggugugugcacacuggcgaagcugagaggcuuggaccuuaucccaacagaaggauuaaaagaaaauguaguugggccgggugcaguggcucacgccugucauccaagcacuuugggaggcugaggcgggcagaucaccugaggucagcaguucgagacuagccuggccaacauggcaaaaccucaccucuacuaaaaacacaaaaauuagccaggcauggugguaggcgccuauaaucccagcuacuugguuggcugaggcaggagaauugcuugaacuggggaggcagaggcugcagugagccaagaucaugccacuacaccccagccugggugauagagccagacucaaucucaaaaaaaaaaaaaaaagaccaaaaccaaauaaacagugguaaaauaauacauguaacauaaaauugacaauuuucagcuucuucuucuucuuuuuuuuuuuuuuuuagacaggaucuugcuauguugcccagacuggacucaaauuucugagcuccagugagccuccugagucagccucccugagcagcugggacuacacucuaccucgcucauuuuaagcauuuuuaagugugcauuuaaauucaguggugcuaaguacauucacauuguacaaccaucaccaguguuuaucuccagaauuuucucaucuucccaaaccaaaacuccaaaggaagaguuuuaagcaggggugcgauguggggagauccuggaauccccccagcccuuguccuccccccucacacaugccuccccuuccccuccccacccccaggcugcagaagauccuggcagagucucccccacccgcccgucuggacauccagcugccaauuaucucagaugacuucaaauuccagguguggaggaagauguuccgggcucugaugccagguaccgggagggacuggcucagguuugugugugaccaggcaguugaugggaggcccuagccacccuggagaggccucccagucccaacuggggaggccacugaaggagguacccauugccccuuugccucuggacugccgcugcaguccucuaaccuguguugggaggagggccuuugagagcaugggguuugcagugggugacugacaugaaaaugcugcugcuguugguggcacgggacgcuggggccuaggucugagccacugacuugcugugugauccuuggucagucucugccccucucuggacgguggagaugauaaauccugccaauuggggacugaggcucugcagagcuccuggaacccuggggacuggccugggucagagagugacucuggcggccuguggcuggggaggcccaagggcucaguuccuccccccaagagcuggaugaugcagguuacagagcucugggacauacacauugcuggggcagcccuuccugccucagcgcaggugggaaugcagacagccucauuuuauucaagauaaaacuaaggcucagagacugggucuaggcugaugugaagaucaggcuccuugaccuugggccuugggccuugucugggccucagauggugagucccaugccuuguaucaauuuaguccuguuggccaggcucgguggcucacgcuuguaaucccagaacuuugggaggccgaggugggaggaucacuugagcccaggaguuggagaccagccugggcaacauagugagaacaccugucucuacaaaaacuuaaaaaaauuagccaggugugguggcacguggcuguagucccagcuacuugggagaugggagaugggaggauugcuugagccugggaguuggaaguugcagugagccuagguugcaccugcgcuccagccugggcgacagagugagaccccgccucaaaaaaacaaaaaacaaaaacaaaaaacaacaacaauaacaacaacaaaaacaaaaagaaaaugcaggccugccugcaacccuggagggaagcaaucauggccucaucucacagcugggcaaacugaaguugagccaggugugaucuuguggcccaagcccagugagcagagaugccaagaggauuaggggagagaaagcuggccugcaauugguugggagaagaccccagcgaggcagaaaccuaggguuuucugaccguguucucucuggcagcgcuggaggagcugaccuuugacccgagcucugcgcacccgagccugguggugucuuccucuggccgccgcguggagugcucggagcagaaggcgccgccggccggggaggacccgcgccaguucgacaaggcgguggcggugguggcgcaccagcagcucuccgagggcgagcacuacugggagguggauguuggcgacaagccgcgcugggcgcugggcgugaucgcggccgaggccccccgccgcgggcgccugcacgcggugcccucgcagggccuguggcugcuggggcugcgcgagggcaagauccuggaggcacacguggaggccaaggagccgcgcgcucugcgcagccccgagaggcggcccacgcgcauuggccuuuaccugagcuucggcgacggcguccucuccuucuacgaugccagcgacgccgacgcgcucgugccgcuuuuugccuuccacgagcgccugcccaggcccguguaccccuucuucgacgugugcuggcacgacaagggcaagaaugcccagccgcugcugcucgugggucccgaaggcgccgaggccugagccgccggacggguaguggaggggcgcgggggccuggguugaagcuuaggucuccuuggucgggucugacgggagaaggguggggagcggguugccagggcccagggggcugggaacugggggaucucccagaauacugacaagcgugggguaggacuggcuugguggcucaugccuguaaucccagcacuuugggagacggaggcggguggaucaccugaggucaggaguucaagaccagccuggccaacauggugaaacuccucucuacugaaaauacaaaaaugagcugggcgcgguggcauacgccuguaaucccagcuaguugggaggcugaggcaggauaauugcuugaacccaggagguggagguugcagugagcagacauugcggcacugcacucuagccugggugacaagagugagacucugucucaaaaaaaaaaaaaaguguggggguuggcauggccuggggacugcuggugagggguuggagugacgcuggggacaagacccagugggguagggagaucuggagucaggucaguggggaaaucagaauuugggaaccaggaggccugagaauuccaggaagaaacuaagguugagcgagggagggacagggccagguugggggauugaugggaggagcuugagaaccuguagauaaggggcuccuuuugccucacacuccccuccuccuuaggccuugggucccccgcuccagauucaccuuacccaaaagccuucuccuuaguucuccaccuuaggcaugcauuaaaaucaccuuuuuaaagcc

SEQ ID NO: 15431 - RNA, 402 nt, Homo sapiens
ccucuuccuuucuccgccaucgugguguguucuugacuccgcugcucgccaugucuucucacaagacuuucaggauuaagcgauuccuggccaagaaacaaaagcaaaaucgucccauuccccaguggauucggaugaaaacuggaaauaaaaucagguacaacuccaaaaggagacauuggagaagaaccaagcugggucuauaaggaauugcacaugagauggcacacauauuuaugcugucugaaggucacgaucauguuaccauaucaagcugaaaaugucaccacuaucuggagauuucgacguguuuuccucucugaaucuguuaugaacacguugguuggcuggauucaguaauaaauaugugaggccuuucguuuuuaaaaaaaaaaaaaaaaa

SEQ ID NO: 15432 - RNA, 3924 nt, Homo sapiens
uagcgccaccgcagugaugcaagucggaaguuguaguucucgaccccggaagucuguccuugcacacgaggcgcggcaguaccuuaaucgcagcgcauccugggacgugcgggcggugcaugagggagaugugguccgcgucgagcuucucacgccuaccucgggaagcgcuggaaacucuuccagggcccuccaggugggccagggccuccgaacagcccagaaguccgaccacggagccuucgugccgugccccgcccccggcgugcacucggcggggaccgccuuuucuccucuaggcucgcuucgcugccccccagcgguggugcggcccggccuugggacggacuccgagaaccccgagccgggccgaaagugcgggguccugaccgcgccgcagacggggagcccucgcucggucagaggaagaagaggguuaaaccuaccgagaacguucgcugccgcuuccuagagugacgggcuuguggaauuuuccguuuccggagcuggaccccggugucccgaguguccuccgcucuggacgugcucgugagcucaggagcuggcaucuaggaaacggggaguucuucacucgcagcgcagucggccgcgccagaagaggcgagggagaauccggacggggcggggcggcgggggagcgggacauucgcgucccggggagcccccaggucaccccuggauugcgagguggcuccgccugagcagcccuuccugguguggucggggcagcugcccgcccggaaaauggucaggcucuagcccuggggaggaagaagccuuugccaagagcaaccgucuacaagccccaaaaccugcgagugccggaaauguggacugaccacagccugccuccccggcuucauucaccaccaaggcagccccucuggugacaagccuuaccguuguccggguuauggcagaagcuuccgauguggcucugaucugguuaagcaccacuggguacacaccggugaaaagccguacuccugccccgagugugaccaucgcuucggcccuaugccugugccuagugugguaagacuuucagcgucagcuccaaccugauccagcaccagcgcgcucacaccgcuaaaagccuuaccgcugaggggacugcggcaagagucucagccuuggcuccacccuguugcagcaccugcgcuccacaugggugagaaggccucuaagugccuuguuuguaguaagaguuuugugcacaguuggaaucugcugcggcaccagcacagucacaaaguccggaaaccugaugcuugguggugaguguggccagaccuucggccacagcucccaccugcccauccacuaggcggcccacagcagcaccccugcgucugccugcaguguggcagggcccuagcgcaaagcuccaaccugggccagcaccagcggacgcacuagggcggcagccucugcaaauagcccuggcuucaauuuuagcugaaacuucagcucugacuuugguucggacuucaaggaaauggaaggaaccaggaucucuaagcagacccccuucugcucccuuagggcuguugauuuuagagcuaaugaugggauucgguuggggcgagggggucuccacaucuuuuugcccaacccuuugcuaagucaaggaaccccagucugggcugggcaugguggcucaugccuguaaucccagcacuuugggaggccaagguuagcggaucacuggaggccaggaguucgagaccagccuggccaacauauugaaacccugucucuacuaaaaaaaaaaugcuaggcguguuggcucucgccuguaaucccagcuacucgggaggcugaggcaggagacucacuugaaccccgggaggcggaggcugcagugagcgaagaucgugccacugcacuccagccugggcgacagagagugucucaaaaaaauaacaaauuuaaaaauuguuuuuaacaaaggagccccagucuggaagaaucagaacacuagaucugugaucacugccuucaaagagcccagucagcugagagggcuuagguuuguucuuugaaguuacaaagacagaacgucgaccagcugaagggagaguuuuggaauggcgggagcuauccagcguggacccagcugccugcagaucuggcaguagcugacacagucccuucacaggccuagggagugaugggguuaaucacaccuagaacaacagcuaccucuucccagaggaaugggaccagaaaucaggcaagccccugugaggaguuccauggcagcgcgcaggcggggcauuccuaaccuccagagggaaccaugagggauccuguguucuggcagaugggccagagaauuugaacuugggaccauugugugagcccugggugugugagcccuucaaaaguccucucagcacgugagaacuaucauuauggaugaugcuaggguggugggggccccagaacagaccuguauguugaguucagggguugcuuuguugcauuucugggcaggggcaagaggcccaggguuugucaucugccccuuccccugccuuauccccuucccuuccaaguuccccaggcuccuuuucugccagucugucaagagagggaagaguggcgaagaguccuuugugccuggacauuggggacugaacauggcccuuuugccugggcauugcccaaacauauauuucuacuggcauaacuuuguguaugugagagccagggguaggcuucccaaagcaccugccugugcucagaguagacaccaagcucugaggcccuucccuucccugcugggggagggaguugucuguuucaaggaccuaauguccaccccuugugggacaguccuaccaucaguccaggcaucuggucugcugcccccaaauuuuaccaucuuuuuuuuuuuuuuuuuuuuuuuuuuuugagacggagucucacucuguugcccaggcuggagugcaguggcacgaucucagcucacugcaaccuccgccuccuggguuaaagugauucuccugccucagccucccgaguagcugggaccacaggcuugcgccacgaugccagccaguguuuguauuuuuaguagaggguuucaccaacccucuacuaaagaccagccucuaguuggucaggcuggucucgaacuccugaccucaagugauccauccgccucagccccccaaagugcuaggauuacaggcaugagccaccacgcccgguaauuuugccaucuuuuaucaggcuuucugugucgaggacgcuacccacauagaguagaaccuaaagggaagggaugugaagugaccucacccucagcuucuagcucauggugucaaggcuugugugaucuuagacacgucugccucuucugagccuguuucuucaucuguaaaacagggaugggagguugugguaaagauuccacagcaacacugcacacgcaugaaguaccugggccagggaugacucggcagaccucaguuucccucugccuccugccuagagcuguuagcaagcauccaucaugcggcucacacaagagcuccccccggagguuacagaaaugaaggcagcagccccaguccuuggguagccuguuuccccuugaaggaaacagacucaauaucagcaacacagagugaaugacgccaggguggcgaacgggccuuuccuggagcaaaugcgggaggcuucauggagaugacguguaaugaacagcacucaucucaggcugggagcagcacaugcccccggcagggagucagugaugagguaugggguucuugacaucuuccucacccaggacccuucagagaguacgagccaggguuugagugaagggccugagcccagcacaugcaugguaggcacucaaagaauaauugucaugaucagguccuuuuu

SEQ ID NO: 15433 - RNA, 8484 nt, Homo sapiens
guauccaacuccaaauuguuuaaucucaauuccagaggucuaggccaggccaggcaccuggggcucugggcuguucugcuucucugggcccuacacccagaaccuggccuuggcuucucgcucccgggucuuuagaucgucaucuuggaguccgguuccauguucucaccgcuccuccaugaugacuccuucugcucagccuccucccuugccagucucagggaggauccuucacagccaauucauccuuggguccccuucccaggggacgucaacagucuaggcagggacccuugcccccaacucaauccccaucaccacagccagcaaagccuccgucaggggcccugccucuucaccugcugccuccacaagccccaccagggccagaccccgcuuccucgggcacugcucugaccccaguguccagcgggcacagugggcagccagccggggccggcccaggcggaacaccucacccacugacuccgggccacccuggggucccagguggaugcggcccacggccucuuccagcuccuccuccagcccaggcaguaggaaacggccagcagccuccagugccuccucggccucugaacccagcaggggcuggccuggugggggcacgggccccagggcagccccacacccccgacaaccaugcaaaugaugcaggacaggccaggcugcaccaggcgacagaccucgcaggggcaccagguccaucugggcuucugcaaagcugccugacagcagggcccggaagaaaggggaggcgguggcugaggccgcucgcugggcagggagcuggaggccugaguccagcaggaagugcaggucgggagcugggacaggggcugggcccagcagagguucauagaggcaaggggaaggugagucuagguccauggggacugccugugggacagcugggcucacagugggagacaccaggucuuggaggcaggaaagggaguccgcggcaaagaagaggaagagcggguguggggccggccgggucagcgccgcaaggaggagccggagaccacccugcuccagaagcagccggcgccacagagagggcuuccuacagggaagagagggccuuucaaaaggugggcaacgggccugggaaacacagcacuccucccccaaccccgcaaggcacccacuucccacucaccggcagaugaagggcagggucagcgcgcaggccacucgguccucagggcucccagagagcagcaggugcgucagggccccaaccccaaagggcgacucagccugaaccgucagguucugcaguagccucuccccugugaguggaaagcuugucaggcugggaacuggggucuaagacagguggggugagugagacagggcucugggcccgugagaugaaggagggugaaaccucugggugagaaaucagggcacugaagagacagugcugggcucgggacgcugggaaccugagguccaggacaaggacagaaggugggacagucaggguguaagucugggccccugaagugugggcggcaagccacccaggcgccgaggcaagagacggaggacacgagcuguuccaguauaauacaauauaaaacaagaauaguuauaccagauauagaucuuagagauauaugaauaucauuaaucauuaguuuguaguaauuacucuuuaucccaauauuguaauaauccucgcucuauaaucauaaccugggaaaaaccaggccauacagagauaggagcugaggggacauagugaggugugaccagaagacaagagugcgagccuucuguuaugcccggacagggccagcagaagggcuccuuggucuagcaguaacgccaugaagcagccuguggucagggcacagcagacagggcagucccuggcagugcugggggugauggugaggcugggguucacaggucagcgugcugguggggagcagucaggacagugcugaaccaauggcagagccaggaaagaagcacagaccagcccagauccugggcgcggggcugcaucuagaguuaggguaucugggucccagggcuagggcagaggacacagcagaacucugccugugggcccauggagggacuggaacgcccugcuccccaccccacucuggugacagguugucuggaggacgggcuggggaggacaggugagugggaaggugagguucugggcccauggaagccaugggggaggauggggacucacaugggggcaaggagacggguggguaugggaacucacccagcucucggugccggcuguggagagugggccgggcacguggugccggccaaucgucaggcgccacccccagcaccagccaggcccgcagcagcgccgcgccauagcugcgcacgaaggccucgaggcaggcaggguugcaggugaggcgugacagaaugcgcagugcacgugggcugggcgggcccggugcgccggucacauaggucagcaggccguacagcgccgggccggucacaagugccccacuugggucaggggccugggaaaagcgcgacagcagcagcagggcuggcccuucgcguccccaaggcuccucgauggcggcggcggggcugcggcccggagugcguugggugcguggugcccgcagcgaggucggggucggggcggggcuggccggcuccaugggcuccggcggacacugcucaggagaccagucgggggagaugucaucagggccuguggcauagcccucggagaucagccacgaccugcggagggcagaaagggaaggagacugaacccagagccaagguuaaggggcagaguccaagaggcgugaggcgucuuuuuuuuuuuuuuuuuuuuuuuuaaagaaaugugguaucccucuauagcccaggcuggaaugcaguugugggauccuagcucacugcagccuugaacuccugagcucaagugauccucccaccucagccucccaaguagcuggcacuacagcugugugcaccacacucagcuaauuuuuuaaauguuuuguagagaugggucucgcuauguugcccaggcuggucucggacuccugugcucaagcgauccuccugccuuggccucccaaggugcuaggauuacaggcgugagccacugcaugagcuaaaagcugucuuggagggagguaaagccaggggagagaaggagggcggagaaaggggagaaacggaagugagagggggauacgacuaaaaccucauucaguaauuacugaugccugucacgugccaagccguucuuuaggugcuggguagaagcacugaacaaagugccugucccccuggaguuuauguuccagugagaagaagcagacaagaaguaagaguaccaugaguuauguuaguguggggcuaguguagaguacaggggucauggagaaaauaaaaaggaaauaggaagcgcugggggcugggcaugguggcucacaucuguaaucccuacacuuugggaggcugagccaggagggucacuggaagccaagaguucaagaccagccugggcaacaaagcgagauccccaacgcuaauguuuaaaaaaaaauaaagaguuccucagcuuuccugugaugcuucagcucaugagugaugguaagagaguaagaacuuggacuccagagcccaccaucuuaaccagcguauaucccaccucccagugaacuugucuggggcccaaaguucaaaggugcuggcguggaaccaagguuaaaagguagauccagccagugcaguggcucaugccuguaaucccaggacuuuaggaggcugaggcggguggaucaccugaggucaggaguucgagaccaggcuggccaacauggugaaaccuugucucuauuaaaaauacaaaaauuagcugggagugguggccggcaccuguaaucccagcuacucgggaggcugaggcaggagaacugcuugaaccaaggagguagagguugcagugaguggagauggcaccacugcauuccagccuaggugacagagugagacucugucucgaaaaaaaaaaagguagacucaggggaguggaguguguuaaauaggaacuggcagguggucgugugggaaucaggagucuggguuauaaaagucuuauucagacagaauagggguggagguagugaagaggaccaagacagacacaaaccccacaucacugcacugcucacccucccaagcccugaggcagggacucaccugaggcuccggaagcuuccacccugugcccgcucagggguccucuccucaggaaagucccaggaagcagcuucucuucccucuucuuccuccucaccagccucaccacacagcugcccagccaggagaggcacaagucccagagccugcagccggcccagggccccagugucauacagaaaccccacaagggcagccacaauacgagggugccaugcgcuugcacgagggucccgcagcaggcccaucaguagauccaagccaccagcaucccgcagucgggcccgguugauggccucacgacauaggaggcacacagcccgcaccaggggcugcugggagguugggcuagcuccauuaggaucccggcgcugccggagcucaucuaccagcaccuccacgccaccagcauugcccagugcaggccgaaucaggcccugggcacacagguuggcgaggaucagaaugguucccucgcguacugcccgcuuggggugggaagccaggcugacgagugggcccaaucccccacccagacuuagcugcucagcacaggcccgggagcagccucggcugaguuccaggagggcacggacgagggcuaaggucagugcagcaucuggggcaguggccaggagcucggccagcggacgcacugcucccugcugugccaaggccaggcggugcuggggugagucugccagguuacggagggcacgcaccacgcucuguaggcacugcgaguccuggcaggcugucaggcucuccacaagcaggggaacagcaccugagggcaggaaaggggagcacagagggugaacaaggacagacacucaagccuuucuucugccccaagcccuagcagaccccaaccucacagccucuuaccagcacaguggauguccccacagcucucagguuccauggcuaaguuccccagggcacgggccguucgguucuggaugcugucugucuucaugcacugaagaauggucacugcaacgacaguuugggcuugugaggguucuaccccuuacugucucucacaucaauaaccuggagaauguggccugagagggccuggaaggcuuucagaagaggcuaauggucggcagggcaccguggcucaagccuguaauccuagcacuuugggggaccaaggugggugggucacuugaggucaggaguucaagaccagccuggccaacggggccaaaccccaucucuacuaaaaauacaaaaauuaucugggcauggugguacacgccuguaaucccagcuacccgggaggcuguggcaggagaauugcuugaacccaggaggcagagguugcaguaagcugagaucgugucacugcacuccagccuggaugacagagcaagacuccaucucaaaaaaauaaaaagaaagaggcuaacacucgggcugggucuggagggguacacaggaagguauuugccagaagcacgguggaugggggugugagaaggcauuucagguuuggaagcagccuuuccaaaggcccagagguaagauacagugucugugaaaggcuucaaaugucaggccaaggggucaggacuugaaugugaaggcacugggggccacacaaggguuuuaugaaggggagugacacgauacaaucugacauccauagggagaaugcauuauggggaaagaauaggaaggggggagucaaaaggcugucauaauaguccaagcaugaaaagacaauagcuugaaccaacccagcuacuggcaucacacagcacagagauaccagucucugggcacacaauggaaguaggaagagagagaagcagauaaauucagaagauauuuaagaugaaaaauaguagcugaaugauggggguuauuuaauaaccaaagcucuugucaaacauauaugguccagauacauuuuauguaaauuuuaaauauauuaaugcuucccuuuauccgaaaaguuaagaugucaucaaaacuagcauaauuucguggaaggcagguagugacauguaaacugcuuucacacauugccacuaggaggcaccaauuuagcugguaaacagaaaagcuuauguuuugcuaggauuuguucuuacugugcugguuuuaauuauuuuuauuuauuuuuuccugcuuccuaagcgacuacugauuuguuugguuuucuaagauacgaggucuuguuacguugcccaggcuggaaugcaguggcuauucacaggcagucauuguucacugcagccucaaccuccuaggcucaagggauccucccgccucagccucccaaauagcuggaacuacaggcgcguaccacugcacccagcuuaugcuaguuuuuaauaacuugaaauacguaucaugcuuagaauauuugcauauucgugccauauuuguacuucguuuucuccccacucugauuuuuuuagguagcuauuauugccccauuuuacaaggaauccuagccucggagggguuaggugacuuuugcagaucucccuuucugaaccacuacaccuuccagcucaucaguggggcuucagaaccuugcacagggccggacacauaguugggcacugaaugucugcuaugaacaucauaacuggacgguaagaaucaucugaaaaaaucaccaaauaacucuuuggccuccgcuaguccagcuucgaaagaaguccucaacaaccaauuccuagauaauggcuacaauuaucuggucugggagggcucucucucaucuauagagagugcagugacgucacggggcacaacagauugagaaacaggagcgaugcgccaucacaaagcacguuauuccgggauaggacacaaagaacuccagacugcccgggucuagagagcaagggaguugcaaaccuaaucuuucuaggaaacgggggcggagcacuuacccaaagggaguaugccuccgagucugcgcacuucgguccggcacgccccuuccguacagcaaucggcuaggaugcugagcgccaaguccagcgucuugcgcaggcgcacuggcggcguaggacuagacgacgacacagcggagggggcggggcccgacgcgggggcggggcuagaagcucccgacgcggccgacgagggggcggagccggggccugccugggacggggcggaacccgcugcagccgcucgccguagcagcgcgaguagggggcggagcccgccgcgugcccggaagcgcucgauuccccccgcugccuugauguggcgcgugcggagggcuaggagcgcgcggcucaggggugucucguuggucgcuggguccuuuuccccacccagagccuccccggccgccgccgcgagcugcgcgaggcagaacgagagcgaguccgugaggguuggcuucgcagccgccaucuuggcucgggccucagacuccgccccgcuucucgccgcugaucccagggagcggaacuggaagacagggaaaucgucgggcaccgccucgcugacgcuguuuagcgccaccgcagugaugcaagucggaaguuguaguucucgaccccggaagucuguccuugcacacgaggcgcggcaguaccuuaaucgcagcgcauccugggacgugcgggcggugcaugagggagaugugguccgcgucgagcuucucacgccuaccucgggaagcgcuggaaacucuuccagggcccuccaggugggccagggccuccgaacagcccagaaguccgaccacggagccuucgugccgugccccgcccccggcgugcacucggcggggaccgccuuuucuccucuaggcucgcuucgcugccccccagcgguggugcggcccggccuugggacggacuccgagaaccccgagccgggccgaaagugcgggguccugaccgcgccgcagacggggagcccucgcucggucagaggaagaagaggguuaaaccuaccgagaacguucgcugccgcuuccuagagugacgggcuuguggaauuuuccguuuccggagcuggaccccggugucccgaguguccuccgcucuggacgugcucgugagcucaggagcuggcaucuaggaaacggggaguucuucacucgcagcgcagucggccgcgccagaagaggcgagggagaauccggacggggcggggcggcgggggagcgggacauucgcgucccggggagcccccaggucaccccuggauugcgagguggcuccgccugagcagcccuuccuggug

SEQ ID NO: 15434 - RNA, 7841 nt, Homo sapiens
caggacugcaggaugccggcuggaagaccgagaagcaccagcuagagguggaugaguggagggccacauggcuucugucucccgaaaagaaggucuugugagcagcccagacggaggcccaagcccagggcaggaaccuggagcaaggacacuuuggccacagcaggacaggggaaaggcagcuuuauuuuuccuuagggcaacugcagcgggugggccaggcccucaugggaagugacugccaaucagaugcagugggccccaggcagaggaaggccgggagaaggggagccaggaccuucucaccccacugccccuuccccuuuucuggggagcaccgcaggcuccucacccccacuuccugugaggcuguggcuuaugguguccaacgcaguuggucuuaggcauagaagccccagaggaacacggccacugccaucaugagcagggcauugagguugaccacacgggcccagcucggguccucgcugauguccuccagccgccuggcugcugccgcugccuccuccuggguaaggggcggaggacugcccaccccaccucugcucauuccacaaaaccagagcaggcacuggcggaagaggcuuggugccggggccuggggcucugagggaaauugaggcccugcaguuaguuugcgggaacucagcuccuccagccccaccucccagcauggugcccuaccauucaucuccauggcacucucugggcacccauucuguacagggagugaggagccuugcugcucaucagcauccagguccucccguuccuccuugcuaugccggagacugaagaccaggcgguggagcuggggagggugggagcacgaacgaggugggaguucuguccccccaugccuggcccuaaagucucuugcacaccagcucgucacugccugcccuacccaccucuguccagucuacacacccagcccaggcuuaacucaugccaacuccacccuacauggcugcccugugcccucgggauaaaccccaagccccugagcuuguguuuaaagccguuggccuugcucccccagcuuugucagcucaggucugucuacacccagaugguagcgcuugugacacuggccuggcaguccugcucacaguguucugugccugugugcucccacccuuuccuccugcugcugcagaaacccggccauccuuccacacccagaucucuuguccuguccucaccccacccugccaccaucagcccugccuggagccaccugcccuuuggcaacaaaaccaaaccuuuuugugggcguucaagaugguauugugcccaccagucagauccuguguuuugagucccaaaggccaugccaaggauuggcuuugggaggcuuuaaucaccaacccaucaacaucaagccucccccaggccgguucaaauaaauguauuuaaauaaaaauucuugcucggcaauugcaacugcagcuggacccccagcccauucccaacccucagucgagaaauucagguccucccagcugggcacuccaggaagcagaggguaggugcugugucccacagugcuugccuggggcaccuggccacucacgugcuuucuggggaugggcgcggugcacagggagaccgugagggugaggaggccagagcagaagaacagcacaauggcgaaguagagguagugcacgccgcagaggaaagcugggcacgccgagggcugcacacagcugcccgagccgaaggagaacucgggaaucaggcgugccaggcccaucagcaggcccccgaugaguccccagaaggcgcccugcgaaggaaacaggucagccugcugaggaugugcaagcccagcccugccgucaccacgcgcgugccgcucaccugcucauuaacgcgcggcacgaagagcgccagcacgaagacggcggacacgggcggugccagguagcuagagacugccuggauguaaucgaagagcugcccgcccugugccgccugcaccacgggaagccaggccaccgacacuaccacgaugaacaccacccagagccugcggcggaggccgucggaucgaacccggacccugggcuccccugcaggugcgcaagcccccgccccgggcugauccguuggggaggaggggagcccaggccgcaccgucccaccagcagcagcucgcggucgccggcgcguggccgcaggcgcguguagauguccauggugaagagcgugcugcugcuguugaagauggaggccagcgaggacaugagcgcggccagcaugaccgccagcaugaguccgcgcagaccugcgggccgacggcagccgugaggcuggggccacuggggguccagggcggcugcagcugcgcgagggacgaccccucccagcagcgggcuccgcagcgagcuugcgccuguggcccggggcugcccuuaccguugggcaugagcuucacgacgagccgcggguaggcgauguuggagcagcccaccuccgugccgcacacgcgccugcacaccucaggcaccacgcacgccaccucgucugccagagagaggccaccgcgccguuaggacggggccuggucugggaaucccaggagguggggacugggaauccuagcagaggaggcgugcgacccccggagggaggcgggacuccgggcccaaacugccgagucuuaggagggugacggaacugggcgacgggcgcccgguugcuggcacaggaaaggggcggggcagggauguuaccuggguacagaaugcggcugaucaugccuggcaugaccaugagaaacaugggcgucagcuucagguacccacacaggaugcagcccgccuugaugugggucaggcucuucccggccaggcagcgcugcacgaugaccuacgggaggggcguucagcugcccgcuugcgggccuccccucggccccgccccgcgccccguuccgcucugugccccgccucuggcucgugagugccccaaguucagcugcacgcuuggaguagauggagccuucugucugguuuagcaccaacccgagggguucccgccccucagacugcgccuuagaccguuguggggaaggcggggagggacucaggcuccgcccgucucggcuccgccccggccucacugcaggcgcagcccuauacccgcaccuggucgcugcaccaguaccagcccgagacgauugugaguccgaggagcagcgcgggccacggcagauccccggucacggggugccggagcaggugguaggagucgggccggggucgauagcagaagcuggagauguuucccacggcuggauccucggacaccgucagcgaagucgcugcucccagguauuugucgaagagacccgaauacccgcccaccucguggaaggcugccgggcaaggccgucaggggacccuccuuaggacccucagaccggagacgcgcaacggccccgcgcgcaggccgagagcuccgcgaccaugcccuccgcgccccucccugguaggcgagccccuaccguaacccaugaggaugcaggcgccccccagaaugacgaaggucuguaccguguccguguacaucagcgcggccagcccuccugcaacaggccggggucaggggacagcccagcuguuuauguuacaggcuggccuuagcaauaaggcgucuuugugggaauuugaaagaguuccccuuccuggagaauaaauuucaaaacgauagccuguucucggggcucaugcacgcaggcaccaacaagcagggcuuggcgggcagaguguggcugaguuuuagggccaggcgccuacuugcaggacccccacuagcagcccccucuaggccccaguuuuguuuguuuuuguuuuuguuuuugagauggagucuugcccugucgcccaggcuggagugcaaugguggaucucagcucacugcaacuuccgccugcccgguucaagcaauucuccugccucagccucccgaguagcugggauuacaggggcgggccaccacguccagcuaauuuuuuguaucuuuaguagagacgggguuucaccauguuggccaggcuggucucaaacuccugaccgcgugauccgcccgccuuggccucccaaagugcugggauuacaggcgugagccgcucccagccggccccaguuuuuucugcgucaucguaggagaggaugauugucuaagguccuauacucaguuccguuccuucuggaggugggucccucaagcgggccuuggcaccaagcccugccuacucugguccgcaucugaccucaggccccaccccaggucccuaugaaccauacuggguuuugccagagaucuuggagacucgucaggugugcucucccagguguucaaggcaggcaagagcugcuaaaucuuccuuuucucaaaguccucacucaagcccagcauggcuuucucucugaacuuccagucaaaauccaagagacaguggaaagagaggaagccuuugcucuccaaagauuuaguuccuucuccugcuuggaccacaccacccuuccagaccucuccagcuugcuuuccucuggcagcucccuaaacccuggccacagcuggcagcagugucccaggcccacucccuuuccuaagccccugcuggcaccugucaccguguaaaucauggugaugcccagaagcgcgaugacggaggcauagauguuccagcccagagccugcuggaugaauacagcuccggagaacauguccaccuugggggagaagcaagugccaggucaggacccagggcaguguccccagcccaccuccugcccaggccaugcccuacuagccucaaagcuucccuccauuuuuccaggucccagcacuguagcuggugccccggagacauucauugcaggcucugccuccaucaucauaacccucgcagugguuucuccuaggucucacgcccucuaggguucucuagagaccccacuugagccccacccuucuagggcccaaucgcaucugccacaggcacucacugagaucuuggugaagauguacaggaaaagggagagcacagacagguagaggcggaugcggcggccgccgaagcgcuugcgcagguacuguggcaucgugaugacccccgcugucagguacacgggugcaaacagccagcccaguagcagcaccacgaagagcgccuacggggggcaguacugccgcugaggguggcuuugcccucaucccugaggaucugaccucuucgugaaggugcuacuccaagcaaguggcccugggaagggccacaucuggggcccagaggacaacugcaggugauggccccggggcccugggcaccaaggaacagagcugacacccuccugggcucuuaacuggagcccuccuugucuccccaggcuaucacuucuggcccguuuuucccaauguugucccuaugaucaucuagauaugaaccccagcauagaccccucagacugaccugagccaaagccacccaaaccuugugucccucaaggaucagcucagcagucuccuccuccaggaagcccugagcucaaagcccaaucuccccuccaacaggagccucagucccagagcuuugucucugcuccucucuucugcaaagggcuuuaacuuggccccaaauuccucacagaccacagcuucggagcgcaucugagcaggugcuucccuggcuuugaggcugcucaccccacucagagaggaauaaauggaagcucccagaggcaguggcuggugcaggcuggcucacauggcaagucagaagcaggaccaacaguggucaccccugcaccccucugcuuccuggcuagauguaugaccuccacucccagcccagucacaccccgcaguugggaagucccacugccagucucauucccccuuuccuggaguuuccccaaggugugacccuuccagguguucucacugagggugggguuauuggaaaaaagagggccucacauuccacucgaauccagcaacagccaagccacuugcagcgccagucccugccaggcccacaaaguggccacugccgauguugcuggcgaagagagaggccccaaccuggguggccagaggagggagugagcagggcugcuucuccaggccccucccguucccggcccagcccgucucaccggccaccacaccaugcugcguccugccaggaaguagccgcccacagugccucuguugguucugcacauggacugggagacagaggcgggggagaccuggguuuagggcacagccuuggaccucaucagccaccucaacacauuccucagccuuguuucuggcugaagauuaacgagccaaguuucccugaucguuugcacucccacccccaacuccucccagacacucagggcaacccaggcucuaaucccaguguccuauucccccaguuuuuuucacauauuuuuucuuuuucuuucuuuuuuuuuuuuucucauuuuuugagacagagucuugcucuuguugcccaggcuggagugcaguggugugauuuuggcucacuacaaccuccaccucccagguucaagcaauucucaugccucagccuccaaaguagcugggauuauaggcacacgccacuauacccagcuuuuugugugugugugcguguguguguguguguguguguguguguguauuuuaguagagacaggguuucaccauguuggccaggcuggccuugaacuccuggcuucaagcaauucaccugccucagccucccaaaguacugaggcaugaaccaccgcacccagccccacaucugucuuucuuuuuagagacaaggucucgcucugucuccuaggcuggagugcagugacaugaucauagcucacugcagccuugaacuccugggcucaagcaaucuucccaccuuggccuccgaguaguugugacuacaggcacacacaccaccaugccugacuaauuuuuccuuucuuucuuuuuuuuucuuuuuucuuuuuaagaaacaaggucucauccaggcacaguggcucacaucuguaaucccagcacuuugggaggcagaggcagaaggauugcuugagccuaagaguucaagacuagccugggcaacauggugagaccccucucucuuuaaaaguaaauaauuuuuaaaauaaauuuuuuaaauaaaaaagagauacgguuucaccaugugggccagucuggucucaaacuccuggccucagugaucccccugccuuggccucccaaagugcugggauuacaggugugagccacuaguuccaucccaacuccccaggauuuaucauuuguggauuuggcuugaccuuccuggggaccuugaauauuuucugcuggucagccacaauguggccaggggaaugagaccccauuuagaaugucgacccugaugaaaauccgcggaccccuucagcuagcacagucccaaagugggaagacaagggaggaauguuggcugggucucccugagaacuuccaaagaccugcuugcccccaggccuagguuucuccuucaaagauccaagcaucauucucccaccuagggucccccugagacuuuucccccaggcccccaaagccagcagccaccagcagcacaccccccaacuucucacccacaagccaacgccaaugaccagcaggaaauaugcagcaaugacuaggaugucagcaggauugucaaucagggccuucugggcccccaucucuggugccgagccugccucugugugcuccuccauucuccccaggaucugccccauccaggaaccagccccuggauu

SEQ ID NO: 15435 - RNA, 26503 nt, Homo sapiens
cagggcggagcuccgcauccaaccccgggccgcggccaacuucucuggacuggaccagaaguuucuagccggccaguugcuaccucccuuuaucuccuccuuccccucuggcagcgaggaggcuauuuccagacacuuccaccccucucuggccacgucacccccgccuuuaauucauaaaggugcccggcgccggcuucccggacacgucggcggcggagaggggcccacggcggcggcccggccagagacucggcgcccggagccagcgccccgcacccgcgccccagcgggcagaccccaacccagcaugagcgccgccacccacucgcccaugaugcagguggcguccggcaacggugaccgcgacccuuugccccccggaugggagaucaagaucgacccgcagaccggcuggcccuucuucguggaccacaacagccgcaccacuacguggaacgacccgcgcgugcccucugagggccccaaggugagccgggcccgcggcccgcccuggucgguggcgccaccucgacggcaggcggcggggagugggcugggccggggggacgcgaggcggcggggcccgggggucggcgaaggccccucgcgggcggacaccggcuccgcgccccgccacacacucccgcugcgcccggacgaguccccgcuccggacccgcccuugacaggcgucggggcgaaaggaggccccgggauucgguggcccgggaagcgaccccgcaguggcuccggugccguccacggcucgacuccagggcggaaggccggguguccagcgcuggccucgcgcucuagggcugggagaggggcggccggccuggucagcuccggaggccccggcccaccguggccccugcugcccgcucggccuccgggcccgggacccgcggcgcacccugcugaccgcggacucgagggggacacucgcaagcuuggauggugguuuuggggggaauuuuaccgcucaaguucuccaacuugguugagggguaucuuggcuacugucccauguuaggcacccaaugacucuggaggcuggugucaaaacauucauauauauauguguguguguguauuuuaaauuaaaauuguauuauuguuugaaagugcuuucaauaugaacguauccuaguaugauuuguaaaauaaaaaacagggugugcuucuccccagcaguuucuagagaucuagacuagagaucugagacugucuuacaguuggccauugccuuaccacauugccucacacuggagagaaagagaaugauacguguauauuuauaauggcauucgcuuccugccuuguuaugguauuaaaauacuuaggauuuguuaccaguacacaaauaacugacuaaugauacucuugugaauacagcagaaguaugucucauuuacauacaugcaaggauauauacuucuuaauccccaagagcaugaaauuugaaaauguaaauuuggaaugaguguguuaauuuucaaaaaucagaguuaguuauacuauucuuucaauuuuuuauaaauuugagcuuucaggauaaaaaguuuuuaaaauaaauauguuauacuuaaagcugaauuguuaacgccgucugggcaagauaaaagcagcaaagagcugguaaauuauuuugaagauuuaaaaacucaccaaauuaaaacugcuguguaacccauuguuuuagaagaaagaccuguauuauuucccuucaucuuuaugcacuuuuuguuuuaacaauauugauaaaacuccggugcccagcagugagaccguguacaggcagcaguuuacauuuacgagagauuaguuguauauuuauucuugaaaauuaguacaagaggcuguaauuagcugggaugggcacaguuacauauaccuuuuugugugucuguuccacccauuuuugggugaaacugacacucauuucaaaccaccuuucuuaggagucugcguggauguacaugaucuuuagugugguuuacaacuauuauuuugaagccuucuuccuguagacauagggauagugguaucuguuggcagccuuuguugugagugaagaucaaguuugaacauaaacauucccagcacuuuguucucagcaugaaacuuacccagcaaguugagaucuuccuguacccaccuggugcauggguuaggcugugauuucauaaaccuuauuaaaagaaaaaaagcagguuuaguuaccauuauucuugucagcaaauacaaagaacuacuaaaucagaagucugaugcugggaagauuuauuugaaaauuucacggucaaaauuuuaaaguugaaauguccuugaagaucucuuauguuaggcuucuuuauuuucugaaacccagagaguucaggugugacuuugaaggucauccagcuaguaccaacaacagggagagaacuagugucaggaaaguccuaauaagaggcagugugucucuucagaaguuggaagugaguguuuugggaaacugaggcaugcaggcuagaauacuugauuauuuuugugcccuccuggccaccaaguuauugggucacugaccucugugcugagguugcuuggauuuugaugaugggacugaugaacucaagaaaagaguucccuuuaccaagugaaugacuugagacuugucagcauggcaccaaaacuuaaggagaaaacuaacauucagcccaugagcuguuugugcuucauugcuuucaauccugugcuuugacacacacaauaucagguugcacuugugugaguuacaccuuacuggagacuaaauguaguggaaaauccuugaauaucauuuuguauuugaaauuggcuucucaaugcauaaugagaaaaaggcccuugcagaaaacaaagggcgauuuuggaggagcugagcugaggcccgucugagcaucaucaucuucaagaggaaaugcugucaaucaguaaaaagcuguucauugagcaugaggagcucaagagacgaccucucuuuugggggaggacucagcuucaggauguuuaaaauuuaaucacguuaguaagaaaauggaaagaaaagacuagaccuuuguauuuuauuucgucuucuacugccgucuugcaguugaucuuccgccuucuccugaaguaguuaggacaacucccuguuuucacagaggggcagagcgaaagcaaguaucuucugucauugcugaagcaggacggcucccggcaaagaugcugggcuucauccagccccauucuaagcagcugggccuccccaccugcagucuuccuggauuuugauuuucugcacacuugggcuucccacuaauuuggcaaguucauaccaguccaggcccuuuccuggcagaggauggcauucagugcuggugcagccacuccuccaggcuccucccugaauaaacagaggccggauguucuggagugcuguucccgccaggccuccuugggaugagagggagaccuuccucccucauggagcagggccgcucuagcuccauggaucuuggggguuaccagucuggcacucuccagggaguccuguuaagaacacagauuguggcugugucucaucgccucccugccccaaccccauguucaaaucugaauugcucaguguagggcccagaaaacuauuaaguccagaaagcuuuuuuggugguucugauucugcugcacuggcagugggagccacggauggccagugaucccauuuuggggaggaggagcugcggcuuagugccuccugaacaucuauccugcagagcauuuucccaagccuccauuuuccuucuuggggaaacuccccagguacgcgggcuucuggaggugugaauauggggaugacaugggaagcgagccgagacagcaccuugcaaagucuggcaggguggcuggcagugcgagaguggggaggugguccagagaucuuccuggaccccaggaagaagcaagccagagccuuuucuuuuugucuugcccaucuggcagaaucucaccauaaucauuuaacagauuauacucaggcacugugacagggagauagaaacauccuuucagauaacacuggaaauguuucgaguuaugauugaaguagagagacccauuuauuuugcuuaagguucagcagagccuccugaauuuucuuaaagaugagaucguuuugcucuuuccagaucuauugcaagcuguuaugccucuuagcagaggcggagcacaaucaggaaaugaguggccguucucuccuucguauuuccagcaaguugcaguuguggcugagcaaguuccugugcgacugcaugaaagugauuuguuggggggcagaugaacagcauggccagaugccuuggagcccagcucauccaggacuuucauuuuccccucugaagaacagccuguguuguucacaugagaaccgacugcaccuccgagaacaucauuugucccguuuuguaggguagauuugcccuuuaugaggguggagccuguacacaggaccugcggcagcguuugacguuggccagggcugggaaggcuuaacuguuggaugcuaucagggcugcuugugagucagaaagcuucauaccacccaugaggcuugcuuagugcuguccucguuucuggaaugacacacagucaccuuauauaaaccacucuacauguuuauuacuuucuauugacauuuaaaaaugauguucugauguuuaucauccaaaguagaaaaccauucaucauccagaccuacucuuucuccuuuaaguuuugcuguuuuaauauugcucuuaaauguuuaagagagcuuacagaagaaacugaagacaaaggccuugcuuauuaggaucuuugagacccucuggcacuggcgaacacgagugaacccugugucacacuugaccguguuauucuccagccccuccuggguucccuuuuguugugagucaaguagacaccucugaucugcuucugccucagagcauagacucagcuggccuucuuuuuuuuuuuuuuuuuuuugagacggagucgcacuuugucucccaggcuggggugccguagugcgaucuuggcucacugcaaccuccgucuccuggguucaagcgauucuccugccucagccucccaaguagcuaggauuauaggugagcgccaccaugcccaucagccggccgucugaggcaggcuccagagccccuuguuuugcaggugcaggauucaucuguaugcaucauguggcacaugugauaccaugugagguaucugguguuacuaagucgucacguauuucgaugaagguaucuuugggaccuuggcagccuuuuaggaagccaggcagcuugcaaaagcuuaggaagaauuuggggggagaggaaugaauguaguauuuuucugucugucaacacacacacauauauauauauaugugccagauaugagugggugcuuuugguaaccuuaucucuaaauccucaccagcucuuugaacuagaaacuaugaagugucuuacacaugggacagcagauuuggagaggcagugugccuggccugugauaaacagaaagacuucuguggcuuuacccccaucugaguuccugaaggggugacagacagacuugccuuuagcgggccuggcugcuuuauacuccccaggcacggcugcuuuauacuccccaggcacagcuugaggugauaaacagcccugaguccaucuuuguauaguuaaucagaaauguuggccuguuucuugaaccugggucuggauuuaggagaugggcccgacucuuuacucacuccuuuaccccaucugaaauucacugagugcccacagugugcgagucacaguguuaaaugccauauagaggacaagucugcccacuuugagacuguucuccacaaagcauguccugccucucccugguccgaagcaggcugucucucuucuggaacccauauuauuuuaauuugaaucuuuuugcuuaagcucugcacuuuucugcuuugucuuggggucacaccccuguuaggaguucuggggcagagucugugugcuucaucgcugccucuugaugccuggcaggguccacaggcucagaaaagauggaacgagugacuguggagaaggguagaacaugggccugcccagagcgcgaaggcagauacagaagagcugcccgugaaggaugcaggugugucccgggaagccuuccauugguuccuaagaacugcagaguuguccugggcuccuaaagguccccagaggccugcuccuuuuugucacuuugugaauggccuucucugcacaaaggacuucaguauugauucccuaaguucauccuuacaggucuggagaagcucuuuuuuguuucucccaaugacacagcaucuuacagcagggcuggagaggcugggagcuggcagcagccagacccuacuuccauagcugugcagagagcagccccuggcacugugaaaagagucucuuaaaaauuuuuuuucguguggcuggcagcaagaucagacaccguauacgugaagguucuuauucacugucaauucagaaaagccuagaaucgcagagugccagcucugugcgucaggagccuguaaacagcucagcuguccaagagcucccagcacagagcugugccccagugaacuggggagacuuuuuacggaaaauuccuuagcauucaauuggagaacaaacguuugcuguuuuaaaguaucuuccucaguguuuauuaaaguagaauuauauauuuuuuucaguuauuuaaaaaauucuuccuugacauugaaugaaugaauaaaugaauggaugguuuaaaaauucauacagugggaggaugggaaggccccuucaugugcagaagaaaagccagccccuucgcuggcccacccuuucagggucaguucagacccccagcaucccagcgggguuagcacuccuuccuggguuggacggugucuuccccgguucugacagcgcuccaugccgggcgucccugcagucuuggggcuguggugacucagaauuaagcugagugcucucacucucguguacccugccuggcuggccugaugacucagcauggagcgcuggcucccugacccagagcacacuugaacugaauguuccaggucugagccucagccgagcguggcugggcgaaauggaagccuuucucuccugcugccucuccugcugcauuuuaccccgggagaugaagguuuuggagacguuagugacacauggauguuaucacaguguacagcugugacaggaguagcagaaagguuagcaucuaccuggccuuaccaucagacaaaccuggguucuagagaucuuaggcaaagcacuuacccuucuugagccucagucucccguugugugaagugggcauagcaacacuucuguuagcaggguugggagaaucaaggaagauggugugugggaggcgaacgucccaaagccugaacugaugcaugcguggaacucccggaaacauaugcagccugcucuguggaguagaaguguguuuguggauagguguguggccucuccacacagcagacuguccuggcuguccgugggccuuucagcucucagagaggccuggggucuuguuucuuagaagcaaggccuccucuuaucccccuuguauggaguguagcugacucccccgaccaguguccagguggcccuuggagcccucccuggggcuucccgugccccuugugaguggaggauguaaaggaacaguaacagaugaagcugcggggccuucgggagccuugacccagcugccagacccugcgccaugcguccauagaugcaucuccccauccucugcccaagauaggcuggguccuuguguccuccacugugcuguguagagcgcuggcuuuacucagccucagcuccucaaggggagggucucccucagcugugucugugcagccgcaaaguaccaggcaggagcuaggagcgcugccugugaggggggacaucagcccaccuuacugaggggccgauuaccugcacagcucuucuggacccagcucucagggguguaaaugucaccgcagauggaaggaaggagggguuuuccaagugccaccacccucuucugggggguguggcugcuguggaccgaaugcuugagaagccacugcaggugggagcagagcccccccgggacucaggggucucaccguccaucagagaggguccccuugccugcauggcagcugaugaacugaggauguuuuucuuuuggaaauuguauuuuguacagaauacacguccgcugauguccuguacacugagaccuaacaggcacuuguagggucgugucuggaggauggacuugccagguggcugaccauuccauuuagcauggaaauguagcaguugagagagguccuuuuccuugacucugucuaaauucagaguuugcuuccugggauggaaauuucagauaguuuccaucugugauuugugacuuuggcuugauuaaagcagguggcuccgcucuuuuuuuuuuccccugaagaagagguagguagguucuaacaugcccugaagcuaacuucaugugaccuugggccacauuccaguuccuaccucugccacauggaacccgugaggcaggcugcagggcuggggcugcagggaggcuggaugcugacucaggugcccccagcaggggaaauaccagcagcugcggauggugccuggccuggagacggcugacgugugcccuggugaggggccaucgaggauguugaggagacgccagcagauguucugcucccaggcggacccuucugugccccagccuggccuggcuuuucucucuaggccucagggagaugugucaaggaaccacagucagugcggcugggcgcccugcucagccaggaguuugucugcagagcaggccucuuccccagagcagcggcccagccuguuggagaggugggucguuuagggcucaggucccuagaguugucuuuggcucuuugcuuccaggcugugaaacuuuagauaaagucuuaagcagagaaagugacauccuugcuaauuaguccucuuaagacucucagauaaaggggcuucuaauucuaacugucuuacuaccaacuuggugagacagacuaaagaauuaggcuuuguugaacagggcgcgguggcucacaccuguaaucccagcacuuugggaggccgaggcagauggaucacuugagcccgggaguucgagagcagccugggccccauagugagaccuugucucuaaaauaaauaaauaaauaaauauuuuuuuaaaaaaagaauuaggcuuuguaaacgguaagcccaaccagcuagugcuggagaaaagcugaguccaucaauaacuauuuguggaauaaagaaaugcaauuguggcugggcgugguggcucacggcugucaucccagcacuuugggaggcugaggcaggaagaucacuugagaucagaaguucgagaccauccuggccaacauggugaaaccccaucuuuacuaaaaauacaaaauuagcugggugugguggcacaugccuguaaucccagcuacucaggaggcugaggcaggagaaucgcuugaacccgggaggcagagguuguggugagccgagaucaugccuuuggacuccagucugggcaauaagagugaaucuucgucucaaaaacaaaaacaaaaauuagcugggcgugguggcaggugccuguaaucccagcuacucgggaggcugaggcaugagaauugcuugaacucgggaggcggagguugcagugagcugagauugugccauugcacucuagccugggcaacagagcgagacucagucuccaaaaaaaagaaagaaagaaagaaaaagaaacccaauuguuuagggcacagagcagcucagaguuuacaaagacuuguaccuuauuucguaccuuauuucacuuaacucuugcaaaaaccccugggaaauauggggaucuuuacagcugcggaaacaguagcaaggaguccuguccauggucacacagcuggugagcaucaaggagggacuggaacccaggguggcaccuugaagacccgggcucaugcugguucauuccuguuuauuuggacacagcugcaaagagaagcaauguugguuucaucuucuaaaaaaauuuuuuuucccauugaaaacacauagggacagucaucuguuuauuccaggauaaaauguauauauauuuuaguaacaggcauauuagauaaagccuccaguagccugugacuuaugauaguuuauagaguaugugguuggcacacaccucuugucuuaccaggagucuuuggacaaagccuaacuccucagguguccuguaaguggaauguggacuuaguuuauuauucagaauuuuccccaacucuauuaugugcccaaaauagugcugggggagugggagagacccuguauuacaauccaguggggacugaagggauuuugacuuuggcuguagggauguuaauggcuguuuauuguguauuucaguaucaaaugggcaguaauacuuaauucauucaugcaccccaucauagcaagcagagagcuucgguagggugcugaagcucgacuccaguugcacuuuguuuuuuguuuugguuguuguuuuaauucagagccucacucucuugcccaggcuggagugcaauggcaugaucucagcucacugcaaccucugccuccuggguucaagcgauucuccugccucagccuccugaguaccugggauugcaggcccccgccaccaugccuggcuauguuuuuuuuuuguuuuuuuuuuuuuuguauuuuuaguagagacaggguuucaccauguuggccaagcuggucuugaacuccugaccucaagugauccgcccgccucggccucccaaagucuugggauuacagguguaagccaccacgcccaguuccaguugcacuuuggaagaaaguguguuuuguuuguuuccugccugauggaggcgagccaggccacuuaauuuugauccaggccuuagccauauggggaguuccaggauuucuguguucuugcaucuuuuuucuuuguuuuagaaguuuugaaguguucacuugacccaugugaaggcucuucuggccuaaaaacccaguuaauacagucuguguccuacuuaauaccccaggccugccaagucggaagugcuacgagacagcccuaagaguugccuuuguuacuguuucuccuaguucagaccagagugauggaagcugugguuuguagauguggagcccacuuuuuaaagagcacuguaccuggccaggcgugguggcucacgccuguaaucucagcacuuugggaggccgagaugggcagaucacgaggucaggagaucgagaccauccuggccaauauagugaaaccccgucucuacuaaaaacacacacaaauuagcugggcaugguggcgggcaccuguagucccagcuacucaggaggcuaaggcaggagaguggcgugaacgcgggaggcggagguugcaaugagccgagaucgcgccacugcacuccagccuaggcgacagagcgagacucugucucaaaaauaaaaauaaaauaaagagcacuguaccauggagccaagauuggggcucacagaaggugcccauuuucggguuucagugaccacucagugugcagggagucaguugugggugggucaagguagauucuucuccacggcucuuucaugaacaugugccuggcguacgccucucuaggcagacaccuugcaggugcccaaggguugugguucccacccugcuuuuagggcacaggguuggggguuagaggcuuccuucucuucauuuguuuuugguuuuguuuuuuuguuguuguuuuuuuaagacagagucucacucugucgcccaggcuggagugcagugcugcaaucuuggcucacugcaaccucucaccccuggguucaagcgauucucgugcaucaucaacuuccuaagcagcugggauuaugaugcccaccgccacggccagcuaauuuuuguauuuuuagaagagacaggguuuugucauuuuggacaggcuggucucaaacuccugggaauggaucugaccucagaugauccacccgccucggccucccaaagugcugggauuacagacaugaaccaccggacccgggcccuccucuucaucugggacaugaaacuuuggggugcucugaguucuggcaguucugauaugauuugaguguaguuaggaguagucguuuuuagauuucugugacauuaacuuuuccuuguuugggggcuuguauagcuguugagagcuugaagggacuuuggaaaucaggccacgcagagugucagagcugaaaggaacuuuccaucaucguuuuucucacugcggaccuuuaggcuuccucacacaccuacggaaucagaccuacuuggguugggcuuaagagucugcaauguuugcauuuccugggugcuucgauaccccaagugcuggagaaccacugcuuucuagaacauuuuugggccuccccuucauuuugcagcugagaaaacgaaaguucacagagggcaugugagccacuuccguaacacauguauuuaggggcagagccagcguuaggaccaagugcagccucuuccgagcucuccugcuguucccucagcgcccauguugcugcuaaaaaccacuagugcaguuuagaccugcucuuaagcaaacgagcccaacagcucaccaaagcucagaaccugaccucaggcuuucucuaaucauaauaucuuguacauaauagggcaaauuuugacucaucuggggucauuuuuuuccugcuuucuaucuuggccaucucauggaguuguuuggugcccugagacaugccucagauuuuucagauuuuuaaugcaaugcacaaacaagggggcagaauuagccaauucauuuuauaaauuaauauagugagauaagcagugagagucaggacugagccccugggcucuucuuuccuaauuggauuuuguauaauauguguuccugaugucuuuagccgagauaaggauaaugagcucugagcugcaggcgggcccugaugagguggccaugaggaucagcagucaucugcuuggucaccgugguugcaucccagucccugucccaugaucacacagagcuguccccccaacuuugaggaggcagauuccgagcucccgcuugaaucaggaaggggcacauaguaagccuuaucugagagaugcugguguaaccaagaggcauuaucuggaugugcuugaacuugaaaacacuuaguagacugaagagacauguuuuagucagauucuagaauuauaaauauuacacauuuuuucuuuugauucuuuuauuuacaaaauaucucucuuugcuagauuguguugaaaacaccauagaagagagaaagggcaauuuaacucuuccaggugguguuuuuugugugugugugagaguuuuuuuggcagaguuucacucuuguagcccaggcuagagugcaauggugugaucuuagcucacugcaaccuccgccuccagcuucaagcgauucuccugccucagccucccgaguagcugggauuacaggcacccgccaccacacacagcuaauuuuuguuuguguguguguguguguguguguguguguguguguauauauauauauauauauuuuuuuuuuuaguuggagucuugcucugucgcccaggcuggagugcaguggugcgaucucggcucacugcaagcuccaccucccggguucacgccauucuccugccucagccucccgaguagcugggacuacaggugccugccaccaugcccagcuaauuuuuuuuuuguauuuuuaguagagaugggguuucaccguguuagccaggauggucuccaucuccugaccucgugauccacccaccucagccugccaaagugcugggauuacaggcgugagccaccgcgcccagccuaauuuuuguauuuuuuuuagugaagaugggguuucaucacguuggccaggcuggucuugaacuccugaccucaggugauccacccgccucggccucccaaagugcugagaugacaggugugagccaccacgccuggcccaggugguguuuuuuacuuaguaaaagcggaagcauuugcuguugugacccuaaugauaguggaugggaacauuagaauguggcaucagcauuccuggcauagaccucauuacgggugggaguuucauuuuucauuggaauuauucauucauguagaaguguuuaauugccuauuuugugaaauucauguuuuuuuuauuuaaagcaauuuuuuguuguuguuguuuuuuuuuaaacaaaaccccaccagaguagaaggggagccuggaacgucuuuuagaugcagugcucacaaggagacacuugguuuuuuauuaaauggcaaaaaugggucauuaauucacccaagcccaggaauacagaccucgggacuguuggagaagcagccaggccgcccuugccuguccugaccgucucugcuuuccagcugugccggcaggcuuggccuguucaguggaccucacgcacgguggagaccuuuccccuuccccccacaugccucucauuuuucugggugcccuuuacccuccaggcccucugcccugcuuugugcucaucuccuccucccugacguccuucuucacuucccagcauguccuggcuucuccuuuccagucccucugucuugcugaggcaucuccugugaugguuggaacacucagaaggguggaccucagcccccacuuccagccuggccccuggucucuagccucaucucccucagcucagcacugacccccaagccugccccuugccacugcuucccaccacucuucugacaccacugccccugccugcagugaccacauuccuuccccguggaccaagccaugucucuggaaagguugaauauuggcuccagcaagcagucucugcugucacagucuugugugcagacagaguuguuuuuccuuccucccucucucuccugucuuauuccccuucucuuuuucaauggaggcacaaaaugugcucagcgagaugcacgaggugcucagcgagaugcacgaggugcucagcgagaugcaugaggugcucagcucguggcuggcucaagggcuuucuggauccaggggcuucccccaggaggagcugcaucuccucaaggccugucugaggacuccaagcccuggaagggucuggcuauaagggguugggaucagcagcucucccaguuaaaaccagagagugugggugggauguggcagagugggcaguguggggguuugauggaguuuuacacagccauacacccauuuaccacugcccagaaaaagagaauauucccaucaccucagaaagcucuuucgagacccuucccagccacuaccaucuccuccagaagugaccaccauucugguuucuagcaccaucgauucacuuuguacuucacuuuuucuuuuuuuucuucuuuuugagacaaagucuugcucuauugcccaggcuggaguacaguggcaugaucucagcucacugccaccucugccuccgggguucaggugauucuccugccucagccuccugaauagcagggacuacaggugccccccaccaugcccagcuaaucuuuguauuuuuaguagagaugggguuucaccauguugguuaggcuggucuugaacuccugaccucaggugaucugcccgccuuagccucccaaagugcugguauuacaggcuugagccaccgugccuggcccuauccuucacuuuugauuccuuugacacuuuggagucugaaaagcauaauuuugugcguauuuagggagaaacucacauuuauugccagucuuccgggcaucccucuugauaugcccuuauaaaaccucacaacauuucuccagggcagguguuggcuagcuccguuuucuagaaaaggaagcgaaggcuuacagagguaagagaauuacccaagcucacagaacuguuagaaauagagguacgaaucacacuuagacccuaccuagggcagcgucuacccuggaagagccugugccuuuccccaucccucagggccuccgugcuuuccaaguaauucugcuucuuguuuguuuccugcccccuuagcccaucuucuaagccccuguuggcagggagugccccuugcugguuugguaaccccauaggacuccucagcggguggcaggauguucccccaggugguggaugaggguuugcucacugcuggucccugcuguguggagugugcagaugguugaggcuuuugugcguggcugggaagaaacaaugagccccugggcagccagcaaaaaugacacugcaggacuaaugcaggcuccgauuucggcuggaaggaggaggaccucagugaguggacagaaugcccacaggcacguuaugacucaacacugaguagcagaggguuucuucagcgccucuugcuggcucccugucagggccaucucacggcaggaauucagcucugaaugugaggccuggaccugcuccugcucuugggugaccugagaguuaagcaggcuaauguaaugccgccgcccugagcacguggcuguucuaaucugagaaugccugucugcccauguccccaaggacacagugacacccaugccuuuccugugugcuggaggcccuccaagggcagggucucagcaggagggaggcaguugaugggccugaaagggcuaaaccagggucagccaccuggugcccacgccugcacacaaauagaaacaucacagaauuaauggucuguucucucaaagugcagagcagcccucaguaucuguccuuacuuuugauugauuccgcagcaguagagauuguccccugcaagcucauagauuguuagccuuuggcguuuguucgccgugcagacagcugccuucgucaggaaagaucacuccccuucuuaagaguugccuuacacagauauaugcaaaugacacuuaucaguagcuccccuccugggaaaggacccucggugcucggggacuguuaggacuucuguugcgcagcccagcuugcugagagauggcauugcccagugagugacuggccagccuuguugucugaaauaagaucuuuccugugguacaucuggaacuuggccuucucaagggucccaaaauagccaggccacugaagggagaacuucaagagaggacauaagagaaggaccccaacugcuccuugcccaagcaggcucuguugcguugaagaaaaaguucuucagugauacuuguuaaagcacagucaggaagauuuauucggggccaucaagauaggcacagggaccacggcaguggggucgugcagucauggguagagacugggcacaacuucaaauacaacacgggcgauugggaauuuauagucaaggagcaguguggauggaaaauuagaagaggaaacaucagggcuaaggguguuucuggcuaugcugaccaaacaggauucuugccgaagacaggccagggugauuagacagcaccuggaggcuguggaagcugaucagauagugaggcuggggaggggguuucuggcuaaacugacuuagcagugucuuuugcuaaaacuugacuuuacaaggaagugcacagaugggccuaggagaugcuucggaagccuaagauuuggucaagcagagaaucuuugucaguuggcaucguuaggcgacacaguuaacccugggugccccucucucccuaugcugccucugcaucccuguccuuccccuuccugcaaauuguucuaacaauacuccugaggaggcagcccucgcuccccagcccacuucucuguaaagauucccaaacuguguccuguguuugggcccaguacaagcucuauauugcugggaaaugugagggccuuuuuggaaacagagacgcuugcuguaauguagagguuggagcugaccccugcuccuggagcucaucuucugauccgggucucugaaaaugcgggcaugggcagcucuccuacacucaccgcuucccucagucacccagaaaagaaaccugucuuaccaguuuggagaauugggaccuuuccuuugcuuaacagauacuuuuggcuuucuccugaugccccuaauuccuaaacuguuggccaaauagcaaccucuauggggugggggguuuggaggguacaggggcugggagcuggcugacgcuuugaggcccaagucacucgggaagaucacaaugccaagcgccacaguguuuccucugccaggaggguucacuucccaguuucuaaccagccuguguuucuccacuuuuuauuucaggagacuccauccucugccaauggcccuucccgggagggcucuaggcugccgccugcuagggaaggccacccuguguacccccagcuccgaccaggcuacauucccauuccugugcuccaugaaggcgcugagaaccggcaggugcacccuuuccaugucuauccccagccugggaugcagcgauuccgaacugaggcggcagcagcggcuccucagaggucccagucaccucugcggggcaugccagaaaccacucagccagauaaacaguguggacagguggcagcggcggcggcagcccagcccccagccucccacggaccugagguaaggagaggccaggcucaccagccugcuggggagcaagccgcugugcuucccaggccgggcccauccccucaggacagugcccugggccaggcaccuguucacaugcagggcaucugggucuagccugcagcaucagaggucacccagcaaagacagggugauggccccacaucaucccccagcaucucauagggcuguucuucaguggggcagggcaggaaucauguggcuucuuuuuguagcuaaggaacggcucggaagggcacacugcagccugccugcuccagaugcacacagguggagggagcagagcugggaccggaagccuggccugccuucuggcgccuaauuuccaugcuccuuauucacacugggcuuucuauucagaagcacagagauagcugugcauuauuuuguucaguucaaugcuuauggauaaaucuuaaccgcuuguggagcuauguugacaggaaaaugagaccccaugccugcccucaccgugcaccacaguuucaaaagaaauaaggagucaggaaggcagcugcuuuaagacagcauuuuaauccugaagccaaacaucucagggauaugucaauggauucugugcauuaauagcuaaaaaauaguucuuaaucugguucuuagcugagauuugaggcauuccuaguaggauuccuaagcaguaaguccucucauuuuccugucugcacaucauccuguggugugugccagcguuguuccugggcacaaacucccguguccuaucugcacccugagucaugcuugccucucagcuccgucugaaucuguucagcuucacaccugcuugagagugaaaguuacaguuaaugugggauaccuuuuuucuuuucuuagagagguaguaccuggcugaggcagguggaucacuugaggccaggaauucaagaccagccuggcuaacacggugaaaccccgucucuacaaaaaauacaaaaauuagccgggcaugguggcacauuccuguaaucccagcuacucaggaggcugaggcaggagaauugcuuaaacccaggaggcagagguugcagugagccgagaucgcaccacugcacuccagccuaggugauagagcgagacugucucaaaaauaaaaaaauaaguaaugccuauauuuauaaugguuuugcugcaagaaaucaaagugacacauaaaugcgagacaucuucacaaauuuaggcuaacaaagcacuuagaagaggaaaugcucucaauuucgaggugaauagaagguggcccagcagggaaaggugcuugaccugccuugggccacacgggaugcuggcagcucccaguugcucagccgaguucucuguagauuggcagagaaaggguaguggggacaacacaucccuuguaugagcgcuuccugugugcuggccuggggcugaggcacaugcccaggugacugaccucaucuucagagcagcccagugagggaggggcacucuuccuauauuucaaaugaagcuuagaaaaugauugaauuacuaggaauuugaacauaggccccuugauuccaaagccuucagucuuuguuguguguguguguguuuuguuuuguuuuguuuuguuuugcuuuguuugagguggagucucucucuguugcccagacuggagugcaguggugugaucucaaaucacugcaaccucugccuccuagguucaagcaauuccccugccucagccuccugaguagcuggcacuacaggcaugcgccgccacacccagcuaauuuuuguauuuuugguagagaugggguuucaccauguuggccaggcugcucuugaacuccugaccucaggugguccacucaccuaggccucccaaagugcugggauuacaggugugagccaccgcgcccagccccagagcucucagucuuaaccgcacauuuugaaaauugaaaauuacagauaggaggucuuacaauauggauugcccugaggaggugcacagcagaaggcguggucaggaugccaagccaggggagucauuuguggggucaugcccucuacccugugucucuugcagcggucccagucuccagcugccucugacugcucauccucauccuccucggccagccugccuuccuccggcaggagcagccugggcagucaccagcucccgcggggguacaucuccauuccggugauacacgagcagaacguuacccggccagcagcccagcccuccuuccaccaagcccagaagacgcacuacccagcgcagcagggggaguaccagacccaccagccuguguaccacaagauccagggggaugacugggagccccggccccugcgggcggcauccccguucaggucaucuguccagggugcaucgagccgggagggcucaccagccaggagcagcacgccacuccacucccccucgcccauccgugugcacaccguggucgacaggccucagguacgggaaguuagucgucagcagacugguuauggugguaugucuccaggggugcaggagcucugugggugcccuggguucccccuucaucccugccuauuuaacaugcguguaccuacaggcaagugagauucgagaaauugcuagguauuaacagaaaugcaggacaguugcucaggcugugaacccuccgcacucugcagcuuuugcugggcugaucauugugcauugcggcugacuuagagcagacgaaacagcuuggcagaacuuacauaccugggaccagcuuccuuaguguccaccacacccuuucagggcucuucacacccccauccacaccgcagccacagccucaccuuggguguaggcagugugucaccuuccacucaguuacccacuccacucugcaggcccauucugcucauucccaccccugugccuuugcccaugcugaacccgcucccugaaaugcccgcacaguauagguucucccuguccucugagggacgagccagucuugucuccuccaugaagccuacucauccuucucaucucaugaugccucauaugagucccuuaaugagaacucccaacuuguaugaguucaacaugucauuauucggggcauuucagaaguguucauuuuaucucuucagcuuagggcugagccugaccacagggcccaugucuuaaccccccuccucccuuuguaaucagguaccauguggucuggcugaggcaucagccagcuauggcggauuggaagccgugcuggccuggggaagguuguaggcaggggucugguuaucuuccaguggagacacaaggugcagguuccuggaagaggaugucauuuaguuuaagcagcucacagcuuagcagcaggacagucagcagcccugggcccccuguggcugcaacuugagcagcugaaugcuacaguuuuuaaaaaggaaagccccccgugaacaaaugugggauauucuuucauuacaaauggucacacuggccagggcccuggaauagagcacccucaucuuaaaauguuguuuuauuuggaaauaauuucaaucucauagaagaguugugugaaucauacagagccccacauauacuucauccaguucacuguuugucaauaugucugcauucgccuugucauuucuucucucguauauuauugauguguuuuaacuguuugaaaauuaauugcagacaucaugucccuuuuccccugaauagcaaauauuuuccuaagaggaagacauucucguucauaaccaugguagacuuaccagauucaggaaauuucacauucuuacaacauuauuauccaguacauuuuugaaucuuuuuuauagcaguuugcccccacuuccaggaugucuuccaggacugaaacaaggaucaugagcaccgcauuuagaugcaacuucucuucagucuucccucagccuuucuuugcuuucacggccuugacgguuuugaagaacacaggcuguggaacacccucucuaaaguguuucuaaagucacuucuuacacagccauugcuguuagaaccuaggaggggugcgugguuggguugugagugguaagggccaaaguugcgaaugucugcauuggcgaaagagauuugauggaaaaggagguugcuggaguguagacagcuacaucgauccauacuuggguucagcaauccuaggagggucccauuuguagagagagggauauuuucuccacaucauucccauguguuucucaucaucagugaaaugauauuucauccuguucuuaccauuaaccguguuuguggugaccucccuuuuagagcugauucaaaguucccuuuugggaggcuuuccaggauuucaccaaacugaacguuauaguggaauugaguguuuuaagcugggaauaguuuagaaauaauauaguccaguuauuucccaguugaugaaauuagggugagauuuuaaaagaaguguuagauauucacuuacaugaauaagagccaagauaaggccaagcgcaguggcucacgccuguaauccuguaauccuagcacuuugggaggccgaggcggggguaucacuuaaggucaggaguucaagacuagccuggccaacauggugaaaccccaucucuacuaaaaauacaaaaaaaaaaguuaaccaggcauguuggugggcgccuguaaucccagcuacucgggaggcuggggugggaggauugcuugaacuugggaggcagagguugcagugaacugagaucacaccacugcacacuccagccugggugacagagcgaggcuccgucucaaaaacaaaaacaaaaacaaaaagcgucaagauauuuuugcuuugagcauagcucauuaaaaaauauauggcuuacuaggcgugguggcucacaccuauaauccuagcacuuugggaggccgaggugggcagauugcuugagcuuagaaauucaagaccagccugggcagcauggugaaacccugucucuacaaaaaaauagaaaaauuagccaggcaugaugguaugugccuguaguugcaacuaaucaugaagcuaaggugagaggaucacuugaggccagaagguugaggcugcauugagcugugauagccccgcugcacuccagccugggcaacagagugagacccugucccccacaaaaaucuauauaucuauauggcuguaguuuauagucacaggaaaaccugugcagccagagguuagcacagaggcgcugugucauugcugaauguuaggcuacagcacagcuauccugaagcaaaauuguucuggaguuaaccauuuagagcaucuuggcuaauccuaaaaaaauacauuggucugggcagaaacuacuaggcugucacgguuuuaaaaaaagaagaucguaucuuuucuaaaacaggagacaagaagaucacaccgugagcagacugucugcacaguguaaggaagaaggaccagaggcagcgacuccaaggcugcaacaccugagagcuggagucacucaggacucugcucugagucagccuaguucagcagucagcaugaguuuuugcuauuuuuuuccuucuuuccuuccuuccuucccuccuucccucccccucccuuccccccuuccccuuccccccuucccugcuuccuucccccuucccccuucccuccuuccuuccugcccccuucccccuugcccccuucuccccuuccuuccuuccuuccuuccccccuuccuuccuuccuuccucccucccucccuuccuucuuugagacaggaucucgcucugucacucaggcuggagugcaaugacauaaucguggcucacuacagccuugaauuccugggcucaagcgauucuuccgccucagccuucugaguagcugggacuacgagugcaagcucccacaccuggcuaauuuuuaaagauuuuuuguaggguuggggucuuacuauauugcccagguuagcuauuuucauuuuugaaaauuuuauuggguuucuuuucauugccauuaagaauaccaucuacagagaaauucagugagagguaauagacaaauagccuggggugaucaauggaagccugacuaaugauuggguuacauacaugauuaauaccauguuuuuauuuuguaacagccauugauugacuuugaaaaucuuuuauacuauuaaacuuuuuuuaaaaagccauuucucaguuuucuuucuaaucuguacuagcuacaaacaauuucugugacuuucagucaguuauuaaaaauauauuuuuguguccuuuuuucagcagcccaugacccaucgagaaacugcaccuguuucccagccugaaaacaaaccagaaaguaagccaggcccaguuggaccagaacucccuccuggacacaucccaauucaagugauccgcaaagagguggauucuaaaccuguuucccagaagcccccaccucccucugagaagguagaggugaaaguucccccugcuccaguuccuuguccuccucccagcccuggcccuucugcuguccccucuucccccaagaguguggcuacagaagagagggcagcccccagcacugccccugcagaagcuacaccuccaaaaccaggagaagccgaggcucccccaaaacauccaggagugcugaaaguggaagccauccuggagaagguacaggggcuggagcaggcuguagacaacuuugaaggcaagaagacugacaaaaaguaccugaugaucgaagaguauuugaccaaagagcugcuggcccuggauucaguggaccccgagggacgagccgaugugcgucaggccaggagagacggugucaggaagguucagaccaucuuggaaaaacuugaacagaaagccauugaugucccaggucaaguccaggucuaugaacuccagcccagcaaccuugaagcagaucagccacugcaggcaaucauggagaugggugccguggcagcagacaagggcaagaaaaaugcuggaaaugcagaagauccccacacagaaacccagcagccagaagccacagcagcagcgacuucaaaccccagcagcaugacagacaccccugguaacccagcagcaccguagccucugcccuguaaaaaucagacucggaaccgaugugugcuuuagggaauuuuaaguugcaugcauuucagagacuuuaagucaguugguuuuuauuagcugcuugguaugcaguaacuuggguggaggcaaaacacuaauaaaagggcuaaaaaggaaaaugaugcuuuucuucuauauucuuacucuguacaaauaaagaaguugcuuguuguuugagaaguuuaaccccguugcuuguuguucugcagcccugucuacuugggcacccccaccaccuguuagcugugguugugcacugucuuuuguagcucuggacuggagggguagauggggagucaauuacccaucacauaaauaugaaacauuuaucagaaauguugccauuuuaaugagaugauuuucuucaucucauaauuaaaauaccugacuuuagagagaguaaaaugugccaggagccauaggaauaucuguauguuggaugacuuuaaugcuacauuuuaaaaaaagaaaauaaaguaauaauauaacucaaaaugguuuuugugguuucuaaaucuuugaaagcaguggcaucauggagauu

SEQ ID NO: 15436 - RNA, 1526 nt, Homo sapiens
aaugccuguuaguccaguguuaaauauuuuagcagccugaugacucagauguagacugugaaaguguuucuuuuuccagggaaggcacuggaacaggucuaguuacugaugcucuuaaugcccuuuccuuuugcaagccuggccgaggguguuuaggaauaaaaacuugccugguugcugggcacgguggcucaugccuauaaucucagcacuuugagaggcugaggugggaggauugcuugagcccaggaguuagagaccagcuugggcaacauagugagacuccaucucuacaaaaagaaaaagaaaaauuagcgugguguggugguacaugccuguggucccagcuauucaggaggcugaggugggaggaucgcuugagcccaggaggucgaggcugcagugagccaaggucauaccacuguacuccuggguacagccugggugacagagugagguacugucucaaagaaaaggaggaagaagaaaaagaagaagaguuggaggaggagaaggaggagaaaagaagaaagaagaagaaacucaggggaagggagucuaugucccgagagagggcagggugcgccuagcaaggaccccaaugcacaguggauuugggucagcacucaguuuucaggccaggaguacacucggugggagaagagcggggcucugaaguggccccaggggacggggagggcccugggaguaggagggaggagaaaugaggcugaggaugagaucaagcuggaggcuaggguugguaggcggccggaguuuaaauccuggcucccacuggaggggugaugcugggugcuauuaggacugccccaagccucagcuucuuugcagguaaauggggcugacaaugucuccuggggguaaaggaggguuacaguggggagaagaugagaugagacacggcacacccgacacaaagucagcuugcaguggagacuucguggacaaggucccugagcugcaggggggcuucugggcaacuccauccccacagccagcucagcagccacccagcaaaugugcacccaagccaggcacuuggaaggagaagccgagggcucucucaccggggaagagcugagaugggcuuucaggacacgcuggguacacgcuccucugcuagaaagagguuugggguaaaugguuagguggguagguagguagguugauguggggcaggugagugacagaugugguuuguugacucccagcccagggcccagcacacacgugaggagucagcuguucacgggcuccugucugcucgcuauguacccuguaggaucaggaaguuggacaucaugauccuagguugucuuucuagaaauguuugcauggauauguuuguggccauuuugauagagagcuggucuuggccucuggcuaagagaauaagcuaugaucuuguuucuuggagaauguuagauuugcagggcauggcucuugguuacccagcaccugauaccuugcaugaggcaccuuaggcgcugcauacguguuugcua

SEQ ID NO: 15437 - RNA, 1283 nt, Homo sapiens
caggucuuuccucuagugggcaugccauagcuccuguccagaguucagcggcacagccccaggggaggcaugggaggcagcagaggccucuggcagggcaggaagagauggcagagccagcaggggaaucgugaccaccaacaacagggcagggaccucuaccuucccugcugaauucuuagcccacagccagcaaugcauuuacuggaaugaaugaaccaaggaagaggcccaggcccagaagccaaugaggcugauacaaugugaugcuuugcagccacgucaaagugcacauuugcccguuucaauuauaagcagcgcuugucacauuuugaagccaaauuuuuuaaagucccagacauuuuuuagauacuccugugaugccugggagccuucacagaugaagaaauaaaaugccauuccuccucccccuggagagguaggauagggcaggugauaggaggccagagcccggggccagacugcccaagccugaccccacuccagcaauaaagagcuguacaaccuugaaaaagauccucucggagccucaguauccucaucugucaaagauggcaaugacaguccuuccuggagagggaguggagaggaugccuugugaccagucaugcgaauguuucuguagcaaggugcccagcacacgcaaagugcuccacaaaugcuggcgucauuaagacaaacacuacaggauguacuguuucccaaacacaaaauacagaauguacuguuucaaaguacacaugacccucccucccgccucuccugcacauccaggugugagucucaggugcacaggcugcuccuucaggcaccccaggcucuaugugaauaucaacugggguguggauuaagaaugaauacagggccagguguggugguucacgccuguaaucccagcacuuugggagcccaaggagggcaaaucaccugaggucaggauuuuggccuggccaacaaggcgaaacccccucuguaccaaaaaaugcaaaaauuagcugggcaugguggcacgcaucuauaauccagcuacucgggaggcugaggcaggagaaucacuugaacccgggaagcggagguugcagugagcugagcugagaucgcgccacugcacuccagccuggacgacagagcaggacuccgucucaaaaaaaaaaagaaagaaagaaagaaugaauacagguggcaacaagugaagggaaucaauguuuaugagcaccuagcaugcgccaggcucuaugcaggcccuucaucacugugagcaa

SEQ ID NO: 15438 - RNA, 53431 nt, Homo sapiens
cgggcgccgugcccguccccaaggcggcucgucaccgcugcgaggccaaugggcugggccgcgcggccgcgcgcacucgcacccgcugcccccgaggcccuccugcacucuccccggcgccgcucuccggcccucgcccuguccgccgccaccgccgccgccgccagagucgccaugcagaucccgcgcgccgcucuucucccgcugcugcugcugcugcuggcggcgcccgccucggcgcagcugucccgggccggccgcucggcgccuuuggccgccgggugcccagaccgcugcgagccggcgcgcugcccgccgcagccggagcacugcgagggcggccgggcccgggacgcgugcggcugcugcgaggugugcggcgcgcccgagggcgccgcgugcggccugcaggagggcccgugcggcgaggggcugcagugcguggugcccuucggggugccagccucggccacggugcggcggcgcgcgcaggccggccucugugugugcgccagcagcgagccggugugcggcagcgacgccaacaccuacgccaaccugugccagcugcgcgccgccagccgccgcuccgagaggcugcaccggccgccggucaucguccugcagcgcggagccugcggccaagguacuccgccgcgcuccugggcagcuccccacucucuccaucccagcucggaccugcuucugcgggacuggugggcagguugaggggcagcgaagcguugugggguggccagggcaacucucggggacaggcaggugggccccgggguggcggauuuccgcgggcugccucggaaccgagcuucgcgcccagcccggggccgguucugcgcccagacgaugccaguacgcccggccugcacucuggggcucgagacgccgggcgaccggccauggagugcccugagggcaaccacacagcgcggggaccccaggacaaauaagaggaaugggggcauaaaggaaggagagaaguucaggacugggaauuggcgccucgcagagcggcuucaggaccacaagaagucauuucgguugcuuuuucuucuauuuacguccuccguccccuuuaaaauucacugcuuugaucacgggaccgcucagugaaaacuguauguaacucuuuuggaaaggaacaguguuugccggcccgccccggaguuucuccaaaaagucuaccccgagcagggaacgguuuggcaccgcucucguuucggcggcguugcugccugucuugcuuuccucguuuugagccagcccuacaaaaaugaaaguggcuccuuuugaauaagcugaaucgggcuuuggaucacgaaaucugcagaggcggagaagggaccggguuagugaugaggaagaagucuaccccucuguuccuacagccgcacacaggaccuguucuggcaggggagacgguggugaugggggaaggaguggaauggagcaaugucuaacucucucgcgggaccuuccggagagaugcuccucaucuucaggcagaggccauguggaaaaauaauaucgaguucagcagcggccagccccgcguuguaggaaccagacagcggggcuuggcagugcgcuugggcgcagccgugccgcugcugccggaccccagugcugccuccucaacacgggcagugccaggagaggggcauaggggagcacagugcagagggacuggucuagaguuuacuuuauaggaauaugguucggugugaccaacuagggcuuagcauaguuuggcuuacguggacgggaagaugccagagccgaacugggugaaauucgagauugcguauuucaccaacacaggagcacagcccucgggaaacucagccuagucaggcaguagagaguugucccggagagaagugauccugcagacucgagaaggggcaugaugauagcacacgucuguugagcacccagucugugugccggguguguuaccucugugaccucauuuggucaaacgaggaggcaguugcuccucucucucucuuuuuuuuucuuaagagacagggucucccucugucgcccaugcuggaguguaguggugugaucauggcucacugcagccuccgaccccugggcucaaugauucuccugcuucagccucccaaguggcugggacuacaggcggaugccaccacacccagcuucucauucccguuuuacagauagcggagcuaagguugaaaaacuugcccaaggucauucagcuggaauuuaaacccagacagccucauucagaggagucagcccagcacuuaacuccaagggugugggagaggggucaggugcuguaaauuuccuggugggcuggacgugcaucccccucagagcugggaacagcauacacaaagccuaagacuuguuuggaggugaauagaucaguguggcuggggaacguuuugggagggcagcaggagugagccaggcugguggcccagagucccagggcugaagaggcuggcugugccccgugcccugugcgcagauguucuugaacuggagcaacucaaagccuaguguaguguagggcugaccuagcaguggagugcggaaugcauccaggguggagaguuuagacuacugcaauaaucugggugugaggcgacaacauugaaaaagcauguuuuuguccaaaacaagccagcuguuacuggucucgcuguuuguggucucaucgcacgggguccugaguugcuggcaccaugcgagccgccuaauuuauugcuagugaggcaaguugcuuaacaaguuuuggaguuggcugagucccuguguggaggaaaacaggucccccauuggccaucgggcucacagcgggcccccgguguaccagugaggggacagccacagagggauaagcaugguggcuuugaaaggagggagagacagaguggguacaaugcuuuucuuaucccucccuccuucuuuugcaaauauuuauugagcucuguagggugucugacaccguuugcauguuugucugucuggcacaucggagguacuugguacgaguggauuagugaaugaauaaaugaaugaaugaagacaaacgggaggugcuugcgauacacagccauucuguuuuuccuuaguggaaggcacugcuuugcugcgcccccucucuggaucucacacuccacccuugacuuuucggagguguuuccgaggacaggcgccugggagccagcagacuucauucaguccaagccaggcuccaggacucaacagcuggugcccacgggcaggucacuugacgucacuguuaaaugaggugaauuggcugccugcucuggcuggaagauuggcgggagagucacuuuagcugccauggacaugagccuuuucuaggggugccacuugacuagaggccuggaguuggagcaagucauacacggaucuggagacagagcucucgaggcaggagcgggugcugcgauuucaaauauuauaagguggcuuugucuggggcagagcaugccaggggaugagagguagaaaugucaucagaucagggguccccagggaggugacuagcacuuugggucacaguagaucuuuggauagaggaacaugucaccauucaaaggaaagcacuuucaucuguaagcuguuuauugaauagaccucagagaacaucucugcucaccgcucuggaaaugaaggcaaaucaucuauuucagaagucaaugcacuggcaggguuuggaugggaaaguauacaauucagcuagagaacaaagaucugucaucuccagcuguacuggucagaugauuacaaaaaagaaaggaauugaaauacuaauaggguacuaauaaugagggcuaacauauauguugugcuuauucuaugccgggugcauacuaauucauuugauccuccggacaguccuaugagugagugcuguagucuucccuggguuacagcugggcagcuaagucacagagaaguaccuugcucaggacugguggucccacacaacuggauggagagccucguucauaaccaccaugcugugcuguugacagagcaacagagauuuuaaaccaaccccagcuaagccccagcuaauagcugaaauaaacagggcuccagauggcuguggcuuagagauggaacaggacagaucacagccuucacucugcaggcucaggagccugaagacaagguugccuccaguugccgucagugcagcccucacuaaagaaaagcaaaaagagccgagggacuguaggaaggcuguuuccaagccagagauccagacaaacugcucuugaagagagaaagcccuuccagauucccccaugucccaaaagaccagccgggauuccggaccucugcuaaaacauggacaagaagccaggaacgagaccugaaacagacuucccaaacagcagaagccucauccauuucuccugcuaguacauccuccaggaaagcccacccuacuccaugcagcagcccagacaagcuuggaggucugcaagcugcaggggugcccagaaacuccaccccuggagguuuuuaggaucgccugcuccuggucucaccccagagccucuaaaggcagaggcuguauguacauaccuggugaagaaccaagggcuuagaugguugcuuuacuucuuggagcccuggaauguuuguaaaauuuacuuuuuuuuuugagacagugucucguucugucgccuacgcuggagugcaguggcgcgaucucggcucacugcaagcuccaccucccggguucaugccauucuccugccuuagccuccagaguagcugggacuacaggcacccgccaccacgcccagcuaauuuuuuuguauuuuuugguagagacgggguuucaccguguuagccaggauggucuccaucuccugaccuugugauccgcccgcuuuggccucccaaagugcugggauuacaggagugagccacugcacccgugccaaaauguacuuuauuuaggugacucuuucgugggaaccucaaacaagcaaucauugcuagcugagugcugacccuguacugagcucuggggagacaggguugaauaaaacaaagucacugcccacagguaacuuauauucaauacaaugggggaaaauacaaucacugcuucccugggguuguauuuuuccauuguuaaagugggcaguuugcucgagagucauuuucacuauuggcaauucaaauacaccuuuugucaguuaaaaaacaagugugccagggaccugagcuucaucuuagggcaggguggguggaaacauuugugagucuccagcuuuuagucaccugaaacuuggaaacuuggaggucuuuugagcaguuuaugagucucugccugcucuggucggcugccuucuuuuauugcucuguugguuuugcuaaagaguuaaaauauuaaggcuucauaaaauuaggaaguuaacaagcucaaaaaccaaguguuugaguuacuucauuccacugagagagcuguaaauggguugcauuggaacuuaaaauaacugcauugaguaagugaugguggcgggcaccaugagcuaacuguggucagaagccugauggccuccgcuuuggggcuggauucuccguuuggagcugugugauccuggaugaguuucaugccuuggauucagaaaucagacuuuccaugagcuuauauuucaagugaauaaauagcucuggucaggcuuaauuugaagaagaaguaagcuuggcagugggugaggguuccuuggaaggccaacuggggcggaggggcugagggcaagcggcucuggcccuuccugggguguuaccugaccagguaacagcucccucgaccucucggagccucggcagugaggggauugggccaguugaucucugaggcuccuuuuaacuagaauggucugggauuuuucuaagaaaacaagucuuugaggagguuguggucaccucauuccuaauuuaaagccuggggaggcuuccuuaugagcuacuucuuuuuccuaaauuauugaugguuaaagccaaggcuggcaucgaauagaugugauccaucuugagccugguugcuuuguguuucagcuuuguacuggcugcugaaguccccgggagaccacaggggugacauguucaucuccaagagaugagcuuccacgagacucauaccccuugcuccuucccuggggcuccaaggccuuugggucaucugaagugagauacccuugugucauuucaucuuuuccuucuccaccuucucugccguuaaaaaaaaaagaagaaagagaaaaauccuauuaauagagaaaccgagaaguguagccauucugaauguguuuccaaaaggcuccuggaaguggcauggaaguuacagugauucagcacuacuuggugacgugugccuagaaccacagggggacauuagccaggacaacacgccucaggacagaaguaaguggcugcgaagaggcauguccaucacugccggaaagaugcagaguucaguuuuuggagucagugcugagaguuccauuucuaaauucauucagagcauuuauuuaacaccuacugugugcucagaaguguaucagguauggggacucagagguaagggcugguggccccugaucucaagguacucgugguagauaguaugaugcucagcuuaagggcugggcuucugaagucggauugccauuuucuggaugugugguguuucuugggugacuucaucucuaagucucaguuuccccaucaguaagauaagagaaguaauagcagauacauacguagcucuuagggcauugcagaauggaaggaccuccuuauaugaaacgcaaagcacugugccugaugcauugcuagaacucaggcaauauuagcguguugucauugucaucaucaucaucaucaucaucaucaucaucaucaucaucuucaaggcacugacaaaggagucagcugugugggaggagugcugggacacucuugucucccuggggaugagguggguggguggguuaggaaaucuucacagagaaggagggugaugugagacuucuguccgggagcugacucggaauuugccaucuaauauguuggaaaagguucucugggcagagguauccaaagucacuuugccugucacccuuugaggucccaguuguugccuauaucaugugaccaguguguggcuucucuugaauuaagagcugcaugucuggacugccugggauuuuacagaugucaucucguuaacucucccuggagcuugugacacccaggagauggcaguuuauagaagcccuggcaccuucuugaaugaugcuugguuugguuucuaugcacugggaauuccucacaaggaaagauuugucacaucuuaaggaaggaaaaaaaggcaaauuugggaguccauggauacccuauuauuuuagauuccaggacaaauugucgaauaagcacguuucauaaaaacaauccuccgcagcaucccgugacagcagcuggucccucgccacaggauaauuaugucuccuugugcacacaaaagucuccgagggcauauuguuguggcuggaguuucugauaauuuccaaauugaacaaccucaguccuaaugagucagaggcuugugcaauauuuucaaaccucaggaacaucuuuuucauuaguugugcaauaaagaugguaggccuaucucugugaugagcuguuuuuuuuucucaaaguuugaugagauucgccguagaauuccuucucacauagucuugggcaagauuuuacccgaucuuccaacacaugagucaucucauauccugugacuaagaagagcugucucuuuggugccaguuuucuaagugcagucaccacuugauggagacggauggacacaguugggauugcccaggcagaugggcaaucuugccagcuagacauaggggagggaagccucaauguucagcggucacaucugcuuuucuguggcacagagugagcuauacaggaauauuguauucuccaggacaguuagggcagugggaaaugucaucaaacagaacagugacccaaagagccacugccacugggugcucugugggagcugggcacugugcucauuguguuaugggccuugcuuuguucuuaccuuguagccacccagagaggcagggcauuauccuugcuuccuagcugaggccacagaagaggcuccuagagguuagcuguaacuuguccaaggccagccagugcaaggaggcagagccaggauuugagcccaugucuguuucacucccaaacuauucuucagauuucuuuaagucaaguguuauuuagaaauguuuuguuuauucaucaaauauuugguggguguuuccagcuaucuuucuguuauuaauuucuaguuuaauucuauugugggcugagaauauauuuuguaugauuucuauucuauuacguuuguuaggguguauuuucuggucuagaauguggucugucuuggugaguguucccugugugcuugagaggaauguguguucugucauuguugaauggaguguucuauaaaugucacuuaggucuaguggauugauagugcgguucaggucaacuguauccuuccugauuuucugccuacugaucuaucaauuccugaaagagaaguguugacgucuccugagucuauucugaaacacugaauugcggucuccaugaugaaccacuagaguuagaaaaccuggguccuagccccauuugggccuuugggaugacucccuucugccucaguuuccucaucuacaacagggggacaaugaugcugccuaggagacaucagcaggauacugugaaaguccaguggcauaagggguauggaggagcuucgucaacuccuaaagcuucagugcuaggaauccuaaagcauugaaauccaaagauauaaggaauaugaaggaguuuugucaauuccuaaugcuucagugcuaggaauccuaaagcauuaaaguccaaugauauaaggaauaugaaggagcuuugucaacuccuaaagcuucaaugcuaggaauccuaaagcauugaaguccagugauauaaggaauaugaaggaguuuuaucaacucccaaugcuucagugcuaggaauccuaaagcacugaaguccaaugauacaaggaauaugaaggagcuuugucaacuccuaaagcuucagugcuuuaggaguccuaaagcauugaagcuguaagagauuaggaccucuaguuggcaauuccagacucuuccaggacuccugauagagccaacaccaagaauagugaagccagaaggauggaaauaguaaaaugccuccugggugucaaagcaugggucuccucugggcauguucucuuguccuacugagacaugauagcucuuggccaaagugacugaacuugacccucuguuucaggaaggccaaaugcaggguucacuaccaucauguccaagggcagaugcguugguccagaacaucagcaucccaaucauuauaccaagcaaacagccgucucugccugcaccguggagagcacacgcuccuccugggguggccugcauccuguguucuucucaggccgacuuucuguuuaauguuugcuggucaggaaauggccugagcugagguucuucagaucccagucugaccuuucuccaccagcauuuguggcucugaaaaauauagcccagugugguuuagccccacuggaugaaacccaguaggaaaagucugauaauagcagaagacgcacaggaggaagagugaggauuugagagcaucugggaaggaccaugugccuggauaucguucugucugugggauucugugacacuugucauuuacagucuguucccauggaauucucaucauuggccaaacauauaguccuucuguccucugaaaaauaucauucugcuccgaccuuucacacccaucucugaccacaucaacucccuguuugcaugcaucuuguggaugaaggacaccacuuuaccuguaaagacacugguggcuucccaaagccaccaacugacuuguagagaagacagaaucccagaguaugaaaccugagggugaaggguccuggcagguccuagagcucaacccuucacuucacagguggggaaacugagggagccaaugggaacaugacucucacaagcugcacagcucaucuguaggggccaguguggagucuguuuguccugagacccagggcugagccuuugagcccuccgcaucucagccgcauccuccuguuggagcaguuagguguuugggagaggccacgguccaugcucaugguuuuccuguaaggcuggagaaacaggccuuguucccuuagucucucuaaucaaaaugagguugcagaaaacccuucucccuacuucucccuaaaauaauuuccuuggguuagaagaugacuaaaagacuauucauccgaugacugaugucucccuucaagaguuauaagcacauauaaaugccuuugaaugguaauuauaauaauuuugcugaagggaaaauaucaguauaaauaucaugguggacacauggaaugaggacugagaugcuuucaugucuuuucagcugugguuagauuuucuuuaagcagaauauacaaguuuuuccucuccuagcauaaggacucuuuuuuuuuguaucuuuucucucuacuuuuuagacaugauggaaaaugcauuuauacauuugaugacauauuguacuaucucaguuguuuaaaauuauaaauguaauuuaaucauaugaaaaauuaagaaaagaagauucauauuucaccaucaucuccccagaaauaucauuucuuuauuacuauuauuauuauuauuauuauuauuauuauuauuauuauuauuuugagacagggucuugcuccaucacccaggcuggaguaaggggcacgaucuugacucccugcaaccuccaccucccagguucaagcaguucucaugccucagccuccucaguagcugggauuacaggccugcaccaccacacccagcuaccuuuuauauuuuuaaguagagacaguuucgccauguuggccagacuggucucgaacuccuggccucaagugauuggccugcuucagccucccaaaguguggggauuacaggcaugagcuaccaugccuggccuaauuccaucauuucugucccaaguguugccaccguuugguuaacuguuccccuguucacauccauuugggccaagguugcaauguuaaacaauccugagauggacauuuucauguuuauggcuauuucuguaucuagggucauucucuuaggagagguacuaaggaguacaaaaacugggaagaaggauauggaauuuuuauggaucugguauaaauugccaaauuauuuuccagaaggguuguagccauauuuguugccaucagcucuagaauuucaaccucguaagucacugaaagaaauucucccaaaaucaauccuucaggaauaauggaagaagauggugccaaaccccagccauucugcucacuguuagauuccuuuuuuggucuuacagguuacuuuuauucucagguugauggcucuuagaguugagcaauguuugggguagaauaacgagcacuuuuaaaacuugguucuaccuggggagggggugaguugugaucacagacagucucaccugggaggggcuuggguguuugucggcuuguccuucuaacacucgugucucaggcgagcagccugggaccagugaggugaccugaaggcuggaggucacaagcuaagaggcgacagagaacccaggucucaggaagcccagcccagagcucgcugcacugagccucucggaugccagcucuguccaggaugcgggaggaggccagacugauuuggucuguuuugaaaagugaugaaaauauuuauucaaauguuuuguacucauaggcagaaguauaacaggagcugcauauacaaaauuauuuucuaguagucacauuaaaaaaguaaaaagaaagaacacgauuauuuuucuuuuuaaaacagcuuuauugagagauaauuuacauacuauaaaauuuaccccuuuaaaguguacaauuugcuguucuuauauauucacaaucaugcacguaucacuaccagcuccaggacacuuucaucaccguaaaaagaaaccccguauccauuaguagccaccccauacuucuccucugcccagcccuaggaaaccaccgguucauuuucuauuucuaugaauuugcuuauucuggacauuucauauaaauggaaucaaagaauacguaacgggcuucugucucuuagcauaauguuuucaagguuguccacauuguagcauggaucauuauuucauuccauuuuaugauuaaaaauaugccuuuuaagggauacagggagaccagacgucuauuuuaucuccccucccugauggggaauccuaauuucagccuggaaagucacugcgaaagucuaaacugcagaggugauacuguuuccacuggaagaaacuguagcaccugacucaggaagccagcauuaaaaccaagaauauucuauauggauggggauuacgcacugaaaggaaaacaugaggaaaugcacuuuucagauuuauuagaucauagaacuuuuuuggagcuggaaaggaugucggaaaccgucuagccuacccccucaucuuaccacugagguaacugaggcccaggaaggggaaguggcuuguuuuggguccgggaccacucuucauuucuuauuugagccaaagcuuccuucuggcgucugucucuguuucacaaguuccccucgcaugggggcuggguacugcuuggaagaacuggcuucuuccuugauacaggggcucguucaccaucaccucccucccucacgucucuucugccucucugcagccucaggcccuccuccugcaccaggggggcagacucaacccgggugggcacugccucccaguccguggccagaggcuggagggcuagggagacugaacagccccggcagcuccagacauaacaaccuauguugaggagucagggcaggaagcgaacccagcugagaaaucugcgaaggucaggaccagagccagacgcuuaucaagagcaaaguuaaugguuuuugugaaccgagcagucagcuguuuccccgaagauaauaauagacacaucauguugggcauucaggaggcaucugaaaaaaaaaaugugcaguggaauugauuggaagcuuuucccuaaugcauaaaauaggccagaaaagacuaucaaauguaacagcaccgaucaaacccaauagaucaagcaaggacugaaaaacacaauuuuuuuuuucuuugccagugagucugaaaagugauuuucaaugacaggcgccuuuaaacauagacaacauaaacaacaacauaguuguucuggaagaggcaucuuuucccaguaaagccaaagaugcagaucuaggcugugcuugugacugacagcacagugagggguucacagccagcuggccaggugccccccgaaagcacauuucgaaucuacucuauuugagagagacugccuuagccuuguuuggguaagucuuccuccuucacuucaccugccacagacuuuuccaggcaccaucugcugcagucuuggcccagccccugcaacaguuacugcucaaggcacccgggacaugcaggacgggggagcagccugaggucuggcguccggcgagcuuuucccacuuggagccgucugggagacugucccggaaagagaggggcugccaacacuuggaagugccaaugugugcugcaagucgaggccaggcucccggcucccccgccucuuccuccuugauucauuaaaaggaaagaaagaggccacacgaaacucuccugaauuucauuucuuuguuucuaugcaaaagacagagcguggucauucaucauucaaauuuuagccuuuuuaaacaaauaauaauuccugcuugugaauucaguguauuuuaacaagaguaggucugagggccguuggccgugucuuuccuuagauuugcagacagcggcccugauggugcauaggguuucagguuuccuuuagaccucagcuggcugccugggccaccacuuagcaaugccauuguccuuccugugcauuuucuuugcagaauucgaggaaauccagucgcacaggccccucugugcccauguccccggcgcccuggaaugugcaguaccagcagcagcgauuagaaugggggucugguuucccggaaugugcaaggucuggcuucuguuucugcugccuccaugccccagaccagugcugggccgggcucugggcuggagccguggcugacaaguuuccuuggaauuuaauggagcgggccagacagcaugcagccacucaaacugaaaaccugggaaagaaaugaguguuguggggcagcuuugcugcauucacugggucauauaugcuucuuuuucuuuuccucaggcaaccccucuugcagacaggaggcccccuccccuuucgcuucaugccucacuggccauuaggaaccuuuuaaaacugauuucucuccugacccucagagagaacauaguccaaguucccuggaggaggaggaagcgcucuguguuucucugcaguucacggcucaguuaaaugcagccuacgugcugucuuuccccacuccucugccugcucccguugugcuucucaugaucauucucaaauucagcgagaaaccucacaaagggagcuuuucuuagggaagagucauccuuggccucccgaauguggaccagccccucuccccagcugcacagcaucagguuaguuaaccaccugccuccaucuggguccugucuggacaggccuacucacaccugcugcaggcauccaacuugcccucaggugccuguggcucguccagagggguggagcccacauuccaguccugacagguaaaguucaguggcggggacccugcauuuaguguaaagaucaauauuccagguccucucuuccugccacccagcgacuggccguuugcaggcacucggucccaguuguccugggccugcagcccuugcauucucucugcuuugucucugcuauugcaccccugccccaucagaaaugcaggugggggggccuuccgcugggacagugagagacuggguaguaaggggagcgcuagagggaugguugcgcuugcauccagcccugacugcauucgcucucccccgccucucugugaaggugcugagcugugaguggaaccaaguggaugagaguggccuugggcaccugccgauaaauuucccggugugucuucuccuccugggagucccaucuggauuugggucuggauuuauuuauucagcaaguagccucuuuauaguuacuuuuuuuuuuuuuuuuuuuuugagauggaguuucacuuugucacccaggcuggagugcacuggcgcaaucuuggcucacugcaagcuccgccuuccagguucacgccauucuccugccucagccucccgaguagcugggaccacaggugccugccaccaugccuggcuaauuuuuuguauuuuuaguagagacuggguuucacuguguuagccaggacggucucgaucuccugaccucaugaucugcccaccuuggccucccaaagcgcugggauuacaggugugagccaccaugcccggccuguaguuacuuuuaauuuagccaugcucggggcugaaggggaugccaaagaaauauaagaugagccccucagacggcuaaagaugaagaugaggccuccaguauguaccucccacauacaccccaggaaauucugggugucacuggauucuggaccucccaaaagcugcuggcaccuggaggauggggccccgaggcuggaccucacuccugcuggguugcuggacugggaaaguacugauggcagcugaggagugugucccagacuucacugagccauucccaaagauuauuccaaguucuccugacacugcacuggaggccugcugugcuggccuucuuuauuuacaguuucugacuggugucuagcagcccugccagagagagcggcagugugucugcaggcgaccaggagaaaugucucaggcuuuagagcaggacuuugagcacauagcugugggggcccagcaggcugucuccugcacgguuacuucuccuuguccuuucauggucgagagguugcugccuggcccuucaagugaggaugggacaugcuauccauuggccuuaauuuccaaccucugcaugaugcauuuuaugcuccugccuuugaaagaacuuuuauuuucuugucauuuaugcccagaccccacauggcagaaggaagggaggcugggacaggggaggcggauaagcugccgcugacagaccugcccaguuucuuagcucaucccggccuccauccuggugagcagacacuggcccaauccagccauauuuuuggcugaguuucugucuucacaucucauccuuaacccugaauccuggccauaguugguacuggguuguauucuuauuuguaaucuuuaaaguaggaauaccuuugcugguauuuaaaguggaagaaaucaggugaagaaucacaagugauuugcaaacuggaagagacauuagaauguaaaugugaggaagcgucagcaugaggggcuugccugggcugcacagcuugccuuggcuggaguaugcacuguucuggcauugcagagaggauggguaccuugccucccugcaggugggggacuguaucagcccccgcagacugcuccugggcuccugaguuugacagauuuuuuuuuuuuuuuuuugagacggacucucacucuguugcccaggcuggagugcaguggugcgaucucggcucacugcaagcuccaccuccuggguucacgccauucuccugccucagccucccgaguagcugggacuacaggcgccugccaccacgccuggcuaauuuuuuguauuuuuaguagagacaggguuucaccguguuagccaggauggucucgauuuccugaccucaugaucugccugccuuggccucccaaagugcugggauuacaggcuugagccacucgcccggcugaguuugaccagauuaaggcagcaucuccaguggcaccugagcagcuccugagaugcuuuucugugcuaaaucuggauuugggguauuaaaucaaaugaauuugaaaugcaggcacagcuggccccaugggcauggaccugugcagucacaccuugccccguguucagaagggugcugugccuguuuuaaugcucugcuguugcucucuugagauucuuaauaauuuuugaacaaagggccccacauacucauuuuguacuggguacugcauauuauguagcuagucuugaaucuaggacagugcauuaaaaugccauugauuggaucaaucugcucuugcaacugauuugaauuuugggaacaugcuguuuccugugaauaaaggaggauucauuucuuuucccucgaauacacugcguucuguuuuccaaauuagcucuacguaucaacucagcugagaaauuggaagcggggauuguucuggcuggaagggaagguuagauuguuaauccugcauccuggcccugaucucaccgagugugaagcauguucccacaauggugugggcugcggggggcuggaggcuggcugagaagguggggaccaaggagggaggcuagccugggagccagacagaugggguuaggcucuugcuuuugccacucgccagcucugaggcuuagggcaacaugauuuaauucucugauccuuguuuuuuucaucuuucuguagacuggugaugagaugcacccugcaggcuugcaggcuugcaggaguaauuaaagguaauauuugugccuauuauugggcuugacauauaguagaugcucuacaauaaauagauccuauuauucuuauugauaauauuauuuuauugcuaacauugaagguugggugggauuugacuagcuggaggcgaggagaaugagaucauccaggccggaaggaaaagagacaugaaugcagggggaugggguggagcacuuuggagguguggggagaggucugcagggugggaguugugcauuaaggagucguggggagaguggaggaaucagugccacauggugaaugagaggggaucgugggcccgaggagauggcgauggcugcggggauccugcaggaaguuuaugugccccaaaguggcauuaucaguuagggggagacacugaagacagaggugaggccugccugaauuagcguagagugggauucuuggaagcuucagaagcuugagaagagccacuuggagguguugaaaugcaccugggagggacguggggacccagcucugggcugagagcugggagacggaaacgcaggugaccuuggccuugaagauggggcaugauauuuagugcuuuaugugcaaucucaccuaggacucccaagcccuuuggaguaggugauauuagcuccguguuacagaaagggagacugaggcugaagcagggacauucaugaucugaagucacacagcuguacggggcagaagugggcauggaggcauuaacuuagagccgaaaggugugaccuuucuuaguguggcuggccccacggggaacguguguggguuggaguacaacuugguguuccuacccaucccagaugcucugcguuugugaaccccaguugccacaucagggcgggcgagggcaggaagcucugcagggagaagggacaagggacagagccaagaacaggggcagugccccaggguccugcaggggcaaugaaggggguuggcacaccuggguuaguugcuggccaguguggggagagagcuggccugggagucuaaugggaaugccagggaaagcugccuugguccccuaaagugaagcccccaugcuggccauggaguguuggugauugagggucccugcuaguugucuggccgaggcagcauguccuauaggcauagcucugguguccugcuggcguggcgugagugccccucaugcugggagccagcccugugcucuggagggagguggugggaggacaagggacagugggaccugccaccugagcaggaauuggcaccuucucccacuggcagguccagguuuuauggaaucugaaacuuguacaauucaguauacccucuucaagaaaaacaccccucaaaauuaugaauauaacauuagguaugaaacuauuauugauauagauugaaaaaagaaaaugcccaaaaugacaaacuucagaaaauagacaaauacugcaaacaucacaaaaucagaaaaauaagauuaaaaaaagcuaacugcugaacacuccgucaucuugaaaaugccccucucuccuccucuauuuuuuggcugugaacucuuugcucaccuuuucaugugacaaugcuuuuguaauauuuccuacagagaaaauagaauaauuuauuauuacuuuuauuguuuuuggauuauuauuaugaucaauucaauauuuuucugcuacccacacacucacugucuucuguccaaccucuggccugcaccaggggaaccagcaguuuccccugccauagggugucccuggagaccacacauauagcaggauagauauagcaauuuaacuagacacagaagggacuucaaagccacaaauauaucucauuuaaccugaacaaaaugauuauccaguuuuacuuuucccuuagccucuucccccaaaugcuggcagccacccugaugggauagaugugugacagagggcaagagaccguggccccaaccagcugcagcuucacucuuucauuucuguauacucucuacaagcugugaugauagcacuuugcuagggccccucacagggcagauggagggcuccacgcugaagcuuuguggauguuugcugucuauccaccucugcuccuugugccuaugcagggauucaggcccaaccacugcagagagcccaagagcaucaggcagagguucccaaacugucaugauugguggcaccuuuaguaguugauacgguuugguuguguccucacccaaaucucaucuugaauucccacauguugugggagggacccgguuggugguaauugaaucaugggggcagaucuuucccgcacuguucucaugauagugaauaagucucccaagaucuguuggcuuuauaaaggggaguuucccugcacaagcucucucucugacugcugccauccauguaagacaugacaugcuccuccuugccucccaccaugauugugaggcuuccccagccacguggaacuggaaguccaauaaaaccuccuucuuuuguaaaucacccagucucagguaugucuuuaucagcagugugaaaauggacuaauacaguagugcagucauuuuuucaugguccccaguaaggccaaaaaauacccaacaguuccauuuaucaauuaguggaggccaaacaauuugauaaguauuugugucccuauaacacaguggucauuaaaaaaagacauuuuaauuucauuauucaauaagcaugauuacuuaugaaugggauaugugcaccuguugggugucacaugaccuuucaaaucuuggagucagauuggacaccaccaugcccauuuccaguucaacucugauuuuugugugguacaugcuuuuuaucacagugacugccagaaauccaacuucauauggaaucaugaaaagggauguagugugaucugauuucaaaacuaugaucaaucuagagcuaguuuacaaggugucuaacagugaucaaguaucacuguauuucccuagaaaaccugaaauaucgaugaauuuucuguggcacucuggggucccuuggggcacacuaugggaaccaugggauuaggaccauaaggauaugauuuuggcuucuuccugccucagaucuaaucuuuaccuggcauuuuugccuuaaagaugaaagaagcauacauuuugauguauuuaaagcacauauucggccaggugcgguggcucacaccuguagucccagcacuuuggguggcugaggcaggcagaucacaagguuggaaguuugagaccagccugaccaacauggugaaaccccaucucuacuaaaaauacaaaaaauagcugggugugguggcaugugccuguaaucccagcuacucaggaggcugaggcaggagaaucacuugaacccaggaggcagagguugcagugaaccaagauugcaccacugcacuccagccugggcuacagagcaagacucugucucaaaaaaaaaaaaaaaaaaaaaaaagcacauauucauuuugugcuuauucuuuugagagaaacacagauaaaagccuauccuuuaauucauacuccccauacugugauuuucauuuuuacugcaacaaauuuuguucagugugauaaugaaugucaaacacuuaaugccuugcucuuuucaguaacaugacauauuggagaauaaugacugaagcuuaucuacacugccuacgucuguuuucuuccaccuugaaagaaguuguugaaaguaauuaagaaguauuauguguaaaacuccagggaugaugugcuucaaggaagcaacauuuaugaaguugugugcuugacuaguaguuuauaaagaggaaagacgaaucauuuauugucuugggauugaaucuuggcaauuuuuaaacuauaaaguuacaggaaauguuggcugcucuuaaugggccauuuguuguguuaaaaaucaguaaugagaaauauuuacuagguaaguggaaagauccaucucuauaaauuguuguaacuuaccauuuuacaaaucuuaguuacucaguuuuucugcuuaaaaaugaaaucauguagcacuguauaagucauucaguuuuuuauuuuggagaauuacucuggauugucuaggcucugugcucuccacauauauuuuugaaauaguuugugaauuucuacaaaaacuccugcucagaauuuucacugagaguaugcuuaaucuauggguuaauuugugagaaauugauagcuuaacaauagugaaucuucugaucuacaagugugguauuucucuccauuuauuuaggucuucuuuauuuugauagcguuuuguagcuuucaauguacagaucuugcaaauaucuuguuaaauauuucccuaauuacuugauauuuauuuuugaugcuguuauaguuauauuuuaaaaauuuugauuccaauuguugcuaauacauagaaaugaaauuauuuauugaccucuuauccugugacauugauaaacgcagucauauauucguagauuucuagaauuuuucuauauagacuaucauauauaucaucugcaaauaaagacgguuuuacauuuuccuuuccaaucucuaugccuuuuguuucuuucucaugccucauugugugguccauuacugaacggcagccaguuccagcuuucuguucaauuaaggagcagguaaaauggccaggccuugaccuuucagggggcuucccguccucauugccuucugcugccucaguucuggcuuaacagaacaguguggggaggaggcaugguccuuaccuacuagggcguuacuuggccuucuucagguugguugcuucgucagguuuaagagcucaccugggcugcaguucaggcuagguuaucugcugaccuggcccugucucccuucuguagugucugugggguacccuuguaagcuagggagaagagacacacgugaaggccagaaaaaacagccugccacacagcuucccuggaucauaccuucgcagugacaugacgacgucguuaggaggcgccgagguggcugagugggucuccagacaccucccuuuaccucucugcugugccacugaugugugacuugcuuacaccuaugcagagcugccacugagcagcacuguggccaguccuuuggauuuucuucuuucuaaauuguaugccguggcuugaucaagcauuucauauacaguagaucaugaaaucagcauagaaaacacauugagguaggugguguuaccacauuuuauggaugagaggcuaacacuuggaggagucagguaacauguccaaggccacacagcuagugaguacccugcugagggucacacucugguccaucugaggccagagccugugccagccuucuccucaugcugauagacgaggaaacagaaagaaggagcaguggacgcccccacccucuguccccugaaccccuuggagaguaggcaguggcagagccagccugggcccaucuaugggaauucuccaucgggauugacuccucuggaaggaagacaguugacccacaguugagaucacagcagaugggccagccagggugucuguagaccaucaggcaguggccacuccauguaguuuaauggacaagcccuuuuaauggaacaggaaucuaacacugaaccaagcugcuuuuagacacacuuuuauuccucacucugaaauggcguuuggacaagccaaauauuucuucuucuuucaguugacauuuuguccaucuuugaacuguuaguugaugcuucuucuguuuaguuauuccuguucuauuuuccuguugccacuaguccacccagggaugguaagaauggaagucaaugguugcuuuuucaucugagaugcaccacgaaggcuugucagucagccuugucauauggucugugcucccacugcuccuucuuucuguuuccucaucugcagaauuuggagaguccuggaccugaucucaaauuucacauguuauuuaucuuccugcagcacgcuggggagaggaagagacagggacauagaagguuggagcuggaacagacuucacaucucauuccagaggcauuugguccaucuuacagaugaggaaauggaggcugcucaguggacugaggcuggaacugggccuuccaguggccaggccagauccuccuugaucucccuuguugcuuuccuggugggaagacccuggaaccacuuuaugugacugugugagaagggaacugccucucauuuuacccagcaaaauccaccuucaauccaucuucauuuuugccccuggugugggcaaauucucccauaccuaauucaggaagccagaaagaggaagugaguuaaugauccuuagugggaaggcgcugguaaugguccuucuugugagaguuucugaaacaccacgcugucucuguguucuggccuggcuggaguuaaaccucuucuuggccuuuccccaggaagcuggucugaggaagcccagaugcguuuguuuacagcugucuggugacauucgccaggcucuguuuucagaaggaacauuuccauucccuuauuuacaccucccauuggagugcucggggggacacaccaauuauuugcaacuaccuggaaaccuaggaggguagcagaucuguaggaggccaguguugaagugagaagcuguagaucuggugacacugugggcuugggagggcuugcccagaucuguuacuuauacucucuauuaagaaacuucaguguccauggagaaguuauuuaaagucugcgagccucaguuuccccauauauaauaugggaaggauaccugauuuuccuauuccacaugaagguagaaaaaauuaaauuaaggcagccaaugaaaggguuuugaaagcaaaaauaauaauaugauacuguucugaauuuguuaaauuauucuuccaaguaguugcagaucuuuuucuguaccuuagaaaaaaaccaugcuauguaaaaggagaugauuccaaucuuuaaauaaagcaacucagaggucaggggcuaggacagaaaacggcccuuuguucacagaagcgcucucacuuccaagaaagcaagcgugggagaggcaggugguccucccgaugucccugugccccauggugucaagcuggguuacuauggcccuucgugacccagugcagcagggaugugggaaccagugggugugaagcugugacgggucacaagagggcugggacgucucacagcuuuuacuuauagccuagagccuggggaaggguugccacucuagugaugagagaggcguguguguguguguguguaugcgucuguauguaugugugcauuugcauguauauaugugugacuguauguaugugcacaucugugaguauaugaauguguguggaaguguguauagguguuuaugugacaguuuguguguaaauguggguguauguguggguguguuuaugcauguacaucuguggguguguaugcauaguguguaugugugaguuugugugugugugugcauuugcaucucuguguauauaugcauguguguuaggggcaggcacacaggccuguugguaaaugagacacaaaauaccuacaaaauacaaaaugugagacaggaaauacaagccccaguuacucauuuuucagugcaacagacauaagauuaccaugugaaauugcuaugaaaguuuccgaaagcuuccugucaauucguagugagcagcuagcagaggagugcgggucccuggagccugcuugugcaacgcugagcuaguccaagggggaagaauggggugcauggcucucagcugcagaccagccuggaaccucuccagccugcuuuagcagagacuuguuaagagguagcagcagguggcaagauuaggagccggaguaguaggcuaaggcugcacuuccagggacacacugccucugccaccacccgugccacgaaaaugggagcccaggacccugaaucucuagcaguccguuucugaaucaguuaccuuggguaugugccucugguugauggaaacuaacuuguagcccugcugggugagagccucacaucgggacaugugacagcuuuguugaaaguagcuuuggaaacgcccaccacguggggccacucacuguaauauaaacggucaugcaucacugagcaacagggauacguucugagaaaugcgucguuaggcgauuucaucacugugggaauguuacagagugugccuacgcaaaccuagauggcagagcccacuccacaccuaggccagauggcagagccuguuguuucuaggaugcacgcccguacaguagguuacuguacugaauacuguaggcaguuguaacaauggugaguauuuguguauucaaacauagaaaagguauaguaaaaacaaugguguuaugguccgcggcuggcugaaacguuauguggugcaugacuguagguauaaagcauuacaguuguuugauuuuucucuuuuucucacccacagucuuaaggcaccucuuaugccuuuugucugggaugucccgggcaggguuggaacgugugguuaaggcauggcggaaacugcuuuggggacagacgauggccucagcuugccuuggggugucagugggaaagauaggagcugccccuuugccuucguguuucuucguaauaaucucagauguacccgucuggugggccucuccuagaaaaagccccggugcucuuugcuccugcgguguuucucaggaggguuguugcuucuuuguaaugguggggacucagggaagggacgcaggcagagggugaugccacaucaaaaagggacccuuggcugggugugguggcuuacgccuguaauccuagcacuuugggaggccgaggcagguggaucaccugaggucaggaguucgagaccagccuggccaacguggugaaacccggucccuaguaaaaauacaaaaauacaaagguggugggugccuguaaucccaguuacucaguaggcugaggcagaagaaucgcuugaaccggagagguggagguugugaugagccaagauugcgccauugcacuccagccugggugacagagugcgacuccaucuaaaaauaaacugaaaaaaaacaaaaaacaaacuugggccaucagcuucuuggaaaggcuggugugagguugaagcauuugcuggugccucugcucaacguuuuuguggugaaccugagcaaagagguuaucauuaguggauuuuacugccuuaccugggugggcacucccuugggagguggauggacauuugcagcugagcccaggugggggaauugcgcucacuccgccuucagaauuccaaaggcugggcaugcaucuuggcuuccucuaacccaugucuuucucuagguggccacagcagagugucauuaaguaucuauucuuugcuuuuguucucagggcaggaagaucccaacaguuugcgccauaaauauaacuuuaucgcggacgugguggagaagaucgccccugccgugguucauaucgaauuguuucgcaaguaaagagagccuuccuuuuuccuauaaccuccgaagcuuucaccgccacuagcaaaacaugagagcuauuuuugagauacauuaaagugucaaagugucacugaauaucuuccuacuuaagauaagugugucucccuuagaacauuuucccuauucgacuauauaaaucuacauucuugacccuucugaauguuuaaagaaccucgggcucugaagagauucucuaagaauauuuuguaaguggaaguuuuugaugcaugcaaaaaauuggcaggauguuuaguguuuaaaugcuaagcccgauauauaaaggagcgauggcuagguguguguggcuguugcacaacccauuaaucaaugcguugaagcguucauuuuaaggugcuacaggcuuaaguguguacuccuuuggauuuuaggcuuccguuuucuaaacgagaggugccgguggcuagugggucuggguuuauugugucggaagauggacugaucgugacaaaugcccacguggugaccaacaagcaccgggucaaaguugagcugaagaacggugccacuuacgaagccaaaaucaaggauguggaugagaaagcagacaucgcacucaucaaaauugaccaccagguaaggguguucucgccugcagaggugaguucucagaugccccggaacacccuuggcaaaggcaccagagcucucugauugcagcugauucucggggggcacugaagccagucugagccagucacaggagggccuugaggagaugcugaguauggccugggggugugggagaggaaggggcucaggaaaacuucuguaaggagccagauaaaaguuuuuaaaauaauguuuuaaauguuugucaaagaaagcaauagauuuguaaagaaauuaguagguaaguagugaaaauugauucuccuucccauucccaauccuguggcaacucuuguuacagauuuuauuuauccuccacagauacaucaugcguucacaaugaacauagaauuuacuggguuuuagacugagccauccuuaacuugucaacaguuacuuugaaaacaaaccagcucucccaaauugggguuuugcgggguuaugagauguguuucaaaagaauguuucguacuuuaaacaucuuggaaaacuugaauuaaaacagagcuaauggauuucuucuuuccagaccuucucagagcuuuuaguaugcuagugugcacguggcuugccuacaaaaggguguugacugaacuauuugcccaaauuauaaucauuugaguauacagcuuuuugugggggcaggcagaacugagacauaccaaaaucaguuugggaaaugcuguauuugaaaaugcuuucuauuuaaauauucucuuugcaaucauuuuugcucuguugauuugcuuagcaaagucuucaugucugggacaauauccauuucuuacugacucaucaaaaacccccacucgacacgucgaugagagagguuuuguuugcuguguggcauguucagugaaagcgugguuuccaguuucuucacauccuuauaauuuucuagacuucagauggagggaacaaucagaggaggcuggaauccugccucugaccaaggaaaagaccagaggcugagccagguggggucucuuguccagcccucugcuugccucgcuuuaccugggugugggcugaguaauuccagacaagcguggaauuaaucuggcuguuugugcuguucaguggcacgcugguuacaccuccuucuggaaacaacucugcgugugcuguuugggugguaggauuccgggucuccuucuccgucuuuuuauaacaucaaguugcugcccagcucaggcuccuuuacggccagucuucagaaaaccaccagcuaacacauuuacuacccuccuuccccgauguuccuguagcuucucuauggcuggguggccaggcauggccgaagaggcucuggguagauauaggcucugugcccgguguguguaacuggccuugagugaggcugcaguuguguguuauuucuauuaggucacuguggaauuucuagcgacaacuaaucuuucaaaguguguuuauuggucacaggauuauugggccagccucugccuucauucuuuuucaccuaaucugcauaauagcuguguuauccccauuuuagagaagaagaaacaggggcucagagaagucuaguaaccugugugaggccacacagcaaacaccucaugacccugcccuccuaaggcagcccauggcuacugcuggagggauagaggccggccccgugguuugaugggacagcuugaccuuaaacagcccaugggaaggcgggugcaucugguuuaggaacaggcugcuagaaagguauccaggaugugguagucucaccggaaggagccagucagaauagcacagccuguggccacgcgugggaccuguucagccucauggagcuuugggaggcagccagcagcagggcaugggcugugugcaggcgaggcgcuggccuggacgccgcccccacugcguaacuucguguuuggaaugcgugggcacauaccgugcggcugcuucuggccgggggauauucuuuuccaauuuugagccaagguggagacugucuccucgugccaucccuggcauguccuggcaagacgugaacgaucucaauagacgagcuuugcagagugugucugaccugacuccugcugucuugggaguuuagcucuucagccagcagcaugcuguuugacauguguuucaagccccccaagaaagggugcuugaaauuuaaaauugaacugauguggcuuuucaaaauggaauuggaaaugaaaggauauuaaauugcagacacccacacaaaagacugguuuccacugacuaaacugcuuuuuuuugcugauaguaguugaaaguagggagaguaacagcaucucuuccagcuuuuucucuuuuguucccuuguuuugaugauggguuauuucgggggaagcucuggcuggccuugcuuugugucaucuuagggauaacaaagaggaugaaagagaucaggaaaaccgagaaggcagaacagaaccagcagaaacugugcuugaggaaugaaaaucaccuacacggcuccuugucauaugagacuguggcccagccuccugcaaagccauuuaagaguaacccagugaagcuggugagacugccugccgcguccgugggcccagugacuaacucgguggcuuaucaucugggcccagcuccuccccuggcauccugauuucacuuggaggggcccccguuguccuucauaaacauguuuauuucauuuuauuuuuauguuuugagacagaguuuuacuguugcccaggcuggagugcaguggcgccaucuccgcucacugcaaccuccaccuccaggacucaagugauucuccugccucagccuccugaguggcugggacuacaggcgugcaccaccaugccuggcuacuuuuuguauuuuuaguagagaccggguuuugccauguuggccaggcuggucucaaacuccugaccucaggugauccaccugccucagccucccaaagugcugggauuacaggugugagccauugcgcguggcuguaaacgugauauucuugagacuuucagugaaauaagaauugccacggacaucuguggucauuguccacuugccacucaccuacccccuuuucuggcagcaacagccggcauuucacauguccaucaucggacagcguaggugggaccaucagucaugguguccuacccucuguggccaaggaguggacacaggacccaguuagggcaagcagaggcuccccuuggaaucgcaaagugaagcuggaugccacccacagagacuaacauggugaagcugcuguagccccugcuguugagcccccagcacugccugaguucuugcacuuugugaguccaguuuaauaucugcuuuuccucccauucuuggagcuccccucacaucuccaguggcuugaaguugccagagauguuucugggcuugugaccaaaugacuccuuuucugcuucucacugcugagcagacacaugugcgcucacuuugccugcugagucuugggacccggaagagcuuuugggagacaaucacggaccagcccccucuugccugcccugcugucucccuccaagcaggaggugagaagguguccaccugcagccccggccaggcaucccuuucugugcuucugcccaaaucugaaauuccccucuccuugggacccacgacuggggccagccugccuggggagggaaucccagcugcagaaagucgggacagugugcguguaaacauguuaauagaaagcagcuuugagggcagacuaguucagcuucaguuacaaacucuuuccaaaugcguuuaacaugagccacuggcugugcgcagcauaugucaagcuuucauccaaugguggcauuuugucccugcgggguuuuuuuuuccugagcaguuuggggcagggguggggacagggagagagaaaaguaaaaagagagcaguuugguuucuucaggcuggaguacaaggcagagguaaugggauguauugaagaagguaggagggaaaguuacuuuagcuacagcuauuuguccagcugugcugauuaagaaacuuggagaaaagcaucuuuggaaucauguccuucccaucuuauauacagccuuugcagauuuccugcuguucugagagagaucugaacuccuuaccaggaccuugagggccccaccugauugggcaccccucacucucucugccccuccuccccuuccccuccuccccuccuuucuccacccccaccugcucugcucagacaccccuuccuugguugcuucccacaggccagggcuguccccuggggccuuggcuguuccccucccaggagcgccccucuccagcuccucaugcagccaaccuuccuguccuucaggccucugauuaaauucugccuuagacaucucuccccaccccgcugugugagguagcgccccaugccccaguccccucaacuccacugccucacuuuggggacacaucaccccagggacaacugcauuccacucuugguuuuucccuccucgucuauuuaucacaauuuagagucgccucacucauuugucaaaugaaguucaucucugcagcuggacugcgggguugggggcacauccggcugucgguccucagguaggaggugcuuggcaaccuuguucagaguaggacguucacagcugucugccccggaggaagcaagggcacccgccacauggauggaauugaggggaaggcacccggggcuccugcaucgagcuucccuccuauauucaaugaggaaaugacccugcagaaggcuggcugcagaugccccugccucccggcuuugccugcuuggaguuugauggacacgugguccugucagggcuacagcaggucuauggucuuugguaacggaaagcgcuggugaaacagugagcuuucccgugggugcuuuucccugacgccaacaaccagguaaauauuuggaaacggccuuguugaggcuugugaggugguuuuccucccuccccuguaggccugcgccacccccccaaccccacggccaccuuugggccagauggcacccacagaccuguuugaaguggccacagagggagcccucugggcgcuggggccgcuguguuugcagaggguccucuuacugcugagcuggcuggugcagugagaaggaaggccgacaccccugauccucaucaaguucagacgggggucacugcgggugaggggccuggggccuuuuacaugucccgggagcugcugagcaggccacucuucuccaggccaccagaacuuggcccugcgcauggugaaucuucccugagucagcugagugaggggguucaggcagccccccgggacauggcaguggcggggaguggacugggguggugcuugccaugacucacgccgguucuccucaggcaaccggauggucagaugcgcugacucaguggccugagcucguccaaaagcgaaucagagaacacagggccugggcucacccgcugcccucuucuggagucaucugucacucauccucaugaaggaagcgccugggagccuggaaugcacaucgcacugccccagcuccccucuuguuucuguguuuuuccauuuuggauucuuucccccaacgccuucuguacugggcauuuuguggucucuucuuuuucuccgagaacucugagggcuaccauugcauuugcuaaugaugccacagacgguguugacguuaugaggcuucuauuacuguauugauuuuuaccauuuuuagggggacgggaaucaauauuucaugagggaaugugaagccagacagugaaguagaagcuggcuuuuauuuugugccaggcuuuguccagaggcggguggggacguggcuccuaagcucuugauugcagcuccuucuggcuugggaaacguuucaguuccccaaacucucagaacuggauccccuguguguucucuggcccggauucaagaacuuaguugauugucaaggaaauucuuuggcuauauuuuucucuuaauaugguaaugccuuuuuucacucuggcacucucuuuucagggaauuggauuaagacuauuauuuaugggucugacaaagcaguucccaaguuguugggacuggauuuguuuaggaaugucuccuguccucuucauugaggggggaauacaaauugcuuccauuugacaguuuaucaagugugugacagaguaucagaguccaggguuggccaacuacagccaguaguccaaagcuggcccucuguuguuguaaauaaaguuuuauugggacauggucaugcucacuuauuuagguagaguguauggcugcauucagucuacaccagcagaguuaaauaguugugaugaagaccacguggcccgugaagccaaaaauauuugcuuccuggcccuuuacaggaaaaaaauucccagccccaguggcaggcaauuaacaccuuguccucgaggagcugaaaguggcuggaggcaggaaugcuuauaagaaccaagcgaggugaagcacuagguggccgcggcgagcaggaagagaagcugauuuuguuugcccuuucguuugccagagauuguggguucuuuuuuuuuuuuuuuuuuuuuuuuuuuuuuugcagagaugaagcuuugaucuugucacaauagcagagggaggccuuauuuuugucuauuucucugugacauugguagaaaggacuuugucagaauuccaagcuauuuggcaauuauccaauuuugagauccuaauggaucuuucgaggucuaguuuguucauucuuuuagugauuccuuguuaauucccugauuuuauaaauguguguugaacaucugucuuggccaaauacuucuuaggugcugaggaugcagcaauagugggcaaagccauggggcuuaagaucuagugugggaaaugggugauguaaaguaaauauggcgauaaguacagugcacgaagcaaacaagugaagggguagaagguaucaggcugcaaagacagcagauaguguaggcagggaaucuuaucugagggggugacaucuaagcugagauggaaaggacagugagagccagccaaggaaacaaguugggugacaagaguugcagguggaguugcuuaauuucccacuucugcucagccugcagauccuggaucuuggacuaauugcaaacugucauuuccucgugaguuuauuagaacccuccagaacaaguuucugguuagcuaguuucucuguguguugucucauuucuuguugguucugguucuuugggguuccuacucauacucuggaaagcuccagugucuuaaguagucagucucccaagagucugaaagcacaaagauucacaaugauacgaucaccucucaaucauagcagcauugaugcaguuccguagcugguuuccuaaagccauccagaucucuuucuguggcaagagagaaauaagaccuucuggugaauugaggacuaauuauccuaauaaacaugcgaauuaacaguuccuuugguuaaacaaagcaccagaaucugauaaugggaacaugugacucaugguauuuccuucuuugcuuuaucuaccaggcagcucacagaaaccacuggccuucccuguguucccauuuuaugucauaaauauauauuuaauuaacuuauuauaaaaggcccuuuguucauugaccauaucaaauuauucuuauauagaagagguuauacauguuuuaaacauuuuaaaauaaaucugaaaagaaugcuacauccugggcaacuucccugcauuuggggcucaaagaagcucuaugugguuauggguaaugaggagccagagugccuucagggcaguucagcagaugcugaaaggcugcugugugcuguucgcugggcccaccaaauagaguaggacugagccccuguccaccaugacagccgggagauacaagcuguucccuuugccucccugagcccugagcuuuauagccuauagacagcugaaaagcaggcugcauccguuacccagucaguuacccagacccaaaugccaggccuuggcuaaccccaguuauuaccuaauuuuaauaucccaauggauguuuuaagaccuggcugguucauucuuucauuuauuuacuuauucauugauuuuguaaauauuucuggagcaucugccauggccacaugcuguuguagcagcaucagccacucugaaguugguggaugaaaggggaugcaucaaaggcgcugauguauggaggagacgcaaguuagacuugaccaagacaauauuauuccuccucuggaugccccgaauauauacagucauuagcugucgggcccccauguggcacuguugacauuuugugguuuaaacacugaagaguaagggaauauuggaaauggcaaacaucugauauaguguaaaggagacuaaauauuuugaugguguucauaaacaccgaggaggaaagucuuuucauuuuuuucauuugugugcucucucuuucucuguuuuugcacacuguccucuguucuccuucuccuucucuuuuuccuuuuuucucccuucaucuccccauuuaucugaucucucccaccugaaccccuucuacccugcugcccuccuguccauucuaccuucucuacuccccucccuagacaguaguaaucacaugucaguuggagaaacaugauggcaacuuggucacaccguucuucucagucuguauaugucggugaucucagugcccaucuggcagauccuuccugcccuggcucuucugcucacugcgaccacccuugacuuugugaucacugauaaccuucaccuucucuaaucuaaaucccaagcuucucacucuugguccaccaccucccagccuuguccguucugaacccugaacggaagcugaauggaacccugaacggaaggguucugaagcuguucagaacccugaauggaagcugaaauaucaaugggccauugcuuuucacaguccucugugaaagauuacuggccaagccagcaucuggagaauuccugguccaccaccucccugucuggagaagcuggaacagccagcugcaugagcaugugacccguguacucacaggcccugugcccugagcucgcuguuuuaauuuuaucuuugaauuuguauuuuugugaauaaagcccuaugagcuaauggagcaugcucagggaacuuggggcuuuagcucaggcuggauuccuccugcugccuccccagucccugguccccugagaacuccagccccaucugaccuucccuucccugucucuaugcaggggucauugcuacccucuaucccuggaaaggauguaggcacagggcaguucuagguuccagcuugggcaccgcuuaacaucuugguggugcagggaucaggcugaugauaccgugguuguucugugggcuacugggcagggucaagccacucccacccugauccagguaccuaaugcacccgacacagaagcggcaguguccuuggggucauccauuauccauguguuggaggagugggacccuagggaagaugcuuggcucgacuuccccaccccuagccagggcacaaucagagguccaggggcuggugggcacaaugccaagucgugaggccuccagugucugcgcucacugucccauaaauaaccacaguaauaacuagcaaaucaaaaacauugugauaggucgagagagacagcauguggaagaaaggaaaaagcuuucuauuuuaguaccuuuaacagugcuuucuguaugcuuuaugaacaaggagccugcauuuuuauuuugcacugggcucugcuaauuuuguagcugguccugcccccuaguagcucaagucagcaaaucuuugguucaucugaguccacaguccgcugacccgcccuuuuucacaguuccuccccugcccaugugcucacuucccuccuuacccagcuuggcgcacucccucaagcaagucuuuggaugcugacaucccccguaaacaacccuucugcggccugguuugauuuuccuuaggagacaugcaaguucuauagcacuguuucuugcuggguauggaggaugugcuauuuuguccauugcauauuuuuuaaagaaaaugaaagguuagcauaacuguuuccagaaggcacauugaaucacucaguugagucccagccaguugcugcaauguuagccuuugaagcaaacuugaaccaacacaggaccagccuagaagucccagccuccagaaaugaugcaguggauucugcagauucagcaacaacaauauuuuuguaacucaagagcacuuaguaauuuucaaaggagagaaagaaguaauugacuuggcuuauuagguugaaaaagaguugccaacuuuuucuuugguuuugauguuauugguuuuuuuuuauuuuucuuuucuccaagcuucagggaaugagauugaaugagcacucaagugcuacuaggcagaacccugaauggaaggaagcugaaauaccgaugggucauugcuuuucacaguccucuaugaaagauuacuggccaagccagcaucuggagaauucuaggaacgcccccuccucuugcagcaguauaaguuugcggggaucaucugaccccauuggggaguuguaugaaaaaggggauuuauuggggacccuguugccuguuuggaucuuacuuacauuuaacuauugucugcuaauggauuuuuuggaaagcaaccagguuuuccguaaagaauagcuaauugucagagcugagaugaccauuggagaucacugggcucaacucccuaauuuuagaggugcuaaaaccgcaauccagagaagcuaaucaagugguucaagguuguagacugaguucauauaggaccaagacccagcccagauguccuacugucugggacaguguucucucagcauacguggagccugaggggguaaugugugugcgugugugugcauguaugcauauacacauagguguuuugccuaaguuuucacuucugccccaccuugguugaucuuggagaaugagccugaggcgcgcugucaaccugggggccucauucagcacaggcccaacuuuucugcccugggggaguuccagcaguuaugguucaucugugguucaguuauggaacucacaccacacauagugcccccaaaaccgaggcugcgugcacagaccuccccucccuucccguggugggccccugcuuggguucuuccuaaacuuccccuuugcccugcucuguguuauacccucucugguccccugucccuguggagugauccggggcacaagggcagcuguuuccccgcugaccucugugugcccugagcaucugggagguggggagcaggcuggugagaagaacaccuggaguggagguuggggucagggagggucccagucccgguaccacccccaccugcugugggaccugcaguccccucaucagcagaacggcuaugaagccauccugcccauccacaggguggugggucgugaaggcugcauaccuggcagagcgggagaagcucugggaagaugccggacacgcgccgugggagugauuucccugccuugcccagauucugcucccaucaccugaaccugccugucaccaccauggaacugcugugaccauugcuuuccuuuuaagcagauuagcagacaucuccugcuccacccugccaaacaaacaaacaaacaagcaaacaaacaaacaaaaaugugcaugagggaguauggacuuguagagucuuuucuaaacauuguuaggugcuuguauugggauccucucuuaaaaugaaccauauuccccaggcuuuggaugacacucaugguugcccacccuccaacuuccuucccugcuggcagagcccuggguuuguuuuaguuccaacccugaccccaccgcauuccugacucaggcaaauucgcaggguccaaugcagucaggggagccacguucccuccuccaacgagugcugaggucgcugcuugauuggauacugccgaugaccuacgaggaggagggugccagggcgcuuuugggacuuugcuuuucuggagagaugcuuccacagcauggucauggacacagucacgucuugaugugaugucuggaauggugguggccgucuuguggcugugagaacaggcugagguugauuggauggagggaaggaaggagccuuguucuugaugcugucugugagccuuugaguuaucagccugguaccacccagcccuuggacagauaucuacucuacauacuccauuuggaguuuuuuuuuuuuuuuuuuuuuuuuuuuuuuuuugucacuugcaguugaaaacacccuaauugauacacacaaacuauuuuuagugcuggucuguguuuggcccuuauggaagacucugggcugagcugcccauggugagggagguggacuuuguguuuucuuacugcucuguguccugguggcuuguuugugucucugcccaugagacaaaagccgagagggcaagggcagauuuucuuaaucauauguucccugcaccaagcucauaggagacacucacugaaugguuguugagagaguucucuuucacggaggcaauguuuugugaaacgaugcugcuuguuguugucuguugguuguaauaugcaugaacacuaagagccaucuuuaaucaugcugugggccgccucuuccaagguguuagcauuacucccacuaccuggucagcauccugccuauggcuaggacuuugcaauuuacauagauaugguggggagaccuggagcccauggccaggacucugacacccucacuggaucuguuucuacaucuaccuggauggccgucuaggacauuagaggauuugugucuuccuaaagucccucuguugagagacuucuggcucuguuaagaggacacuauuuagcauugugagucccugcaggcugggggccagugggcguuuuucuucuagaugcccccucucuucuucuggccucccaggcuuccugcuccugagauugugagaacuggccugugcugggcucacugcagaaagacugucguccccaaagguuuugcaccaaacuugagcuacaagaucuuuuagggggaccugagaucuccgccugggcucuaugagagcaggcauggguuguuuuugccccgucacugcagucaugcccacacuugcauuuucuuuuccccccagcagugugaggaucuggcaugaggagugggacucgcgugcccucuuucuucuccucuucccucuggccuuuucauccgucagugggggacagauguuugcccuguuuacuucuaggcuuacuguggggcuccagggagauggugaaguggccaaggagaggagcugccaccuucaagacggccuguggccggugccgcuuuaaagggagacucagaggugcuuugcuguggguggcgcgggaaccagccuggggacagcagugcagaggccuuggacucagagugcgugggccccgcggggcuucacggcgccuguggcugugcacuuccagccauaucugugcugcaucucuuccacauucccccauggagcugaugucuagacagcuauggaauuaaaugcucaauuaccgaguaggaauuuggccagcagagguauagcugcugaguagacagacucgaggugaggcucacggcugagaacaggccccaucuggcuuuggaaugagcugaggugcccgaugcuccugcagccaguggcuccuguggggagcuggggccgugacccccaaaaggcagcuugaccucauggaccaccauaaaucuggccuggucaacaucucugccagacaucauucccuugcaaagauuucugccugugauuggaauucuggaugaacauguacugggcgugugggucugacagcugggaagcuuguucucuuguuuagccaggcugcccaucaucuguaagccucaguauccacaucuuuaaaauggggggaaaauauagcucaacuccuaauggugccaugagaauacuuugucaccugccaggcaaaagcuuauuccuuucacagaaauccaggguuuacaaugugagaccccuccccacuccgccgcaugugucugcuugcuuuuuucugucuuaggguugcccuucaugagcuaggaaaugucugaguggaugaaaaccuaaacgagaugaucacugguggugcccauuggugcagccuuugccuaaauggcuacuuacguagccacauuuccucgucuguguucaggugaggacugguuccugggcagacugccuggguuugcaucacggguguccaucuugucgaagcccauguggucacccaagugugacugagccaggcuugcccacggggugcucugggccccauuuucggcagcaggcagcguccccuggaggccuggcccuccccgggagcauggggaguagcgccuaugggcaagcagccugcagccuccaucccugccugggggcucccccgccccagccucacagcuucuccaaaaguguuugucuccuugccgcauccucuaggccugagcucagacgguggaaaagaagagcuggaaggagaguugccuuucagucucucugccuucugaggucuccugagacauagagccugggccugccucccuuucuaggaggcgccaaggggugguaagaauaggggaugagugagaugugaauuaggauccccacagcaagcccugccucguaacuuucugauggguuuucaauguguggugaagcagacgccugcugggcccccuuccugaguugaguuugaccuccugccuccugucuaucuccuugggcagccaggccaccccgcuccauuaaccugugccaccccaucccuuuaccugucgcaagcccagcccugaaggccucaaaggccuggucuuccagccaguccagggccugaagggauggcagugucccugguggaccuccccugguguggccuagugcacaucccagcccugccuccugccccgccugcacgccaugagugcugaagucaugccuggcaggggcugcuggcccaggcccagaguaaacacacugcgcugagcucgcuggugugcugcuggaugcugaugagcuugaggagugugggaagugagcauggggcugaguagagaugcggcaggccugcaccuccccgcagcugcccugcaugcuccagccucaggcagccacacagggaaagggucacccacugucagggcagaccuuuaccauggcugggugacacgggcuggcuguggaaagguguuuggugguucccgcuguuggauuugcacaggcccagaugcucacagcaaaaccaacaccuagauggugcuuacaggagccagcggguauucaaagagcuguucagaucuuaaguugcuucauucucacaguggaccauugagguagcuguacguuagucccauuuuccagaugagaaaacugaggaccugaguggucauaagcucaggcccucaucuaaaucacgcagccuggccccaggugugugcucuugaccauggacagugcucuccugguccucuugguaucugugaucugagggaccuuccuccuccucagucucguauagucaguuuuaggucuuggacucugucuucauaucccuuucucccuucgugagcuuucucacccagcaccuuccuuauuugguguguguugggggauauuugugguguggcguggcacuguguaguggaugagagagucuguuuuuccgaucccagucccagguuucaaacccugcucugucucgagucacccagaaucuuggacccucaguuuccucaucuguuaaaugggcaugguggucaccccaccucaucagcuagugucugcuccaucccugguggaggagaugacucaaguaaccccuggguuccaccugccccaccccacugguccccuggcucuuucuuuguugagauagacgaaugugaggcucuggaguugcaguucccacgagggcugggguggcugucugauuucugggccugguccauguuguucagggcagcugcucguucuaagugaauaaaggcugaaggaacucgggaggucugcucggcuccgaggaaggcagagagggaaagggccccgaugccuucccugauagagcuagggaggcccuucugugguuccccccagcuccuuggccugggugacccuggagcuggcuucuguuccauuuuguugugcagaguuguuugagacuccuggcuuugccuggccuuugugggacgcuggagaucagggcuucuggaguuggccaauuagccugcccagaccaggaagcacagguggcugacagagggccguuucaggagaggagagacagccuaccuauucggucuugcuguccccaugcuccaucccugccccugaccaguguggcccuguacucagcauaggcgugcaccugagucaguacaguucccugcccgcagagcaccccaaauauuccaggccucaggacggaugugcacaugaugagucggggcagguuucacugccuguagcuugggauccuucccuggggcuugguucucuagggccauccccagcagucucaccccaaacccuaaauucauguugucuuccucugucucuuggccucaagguuucagagugagucugugcugauagcuucaagaugugaugagaccccgacuuggccuccaguuaccuccccacgguuuccuugguguguguguggcuucaguguucacuggcucccgcacggcuugcaauguguggauuacgggugggagggaaauccaguccugcccgcagcaaagggauguuaguugugagcucaguuccccaccgggccugguguuuccaaauagcccgucacugucccugcuugguuuuccaugauaucugugccuuuaccuauuugguuaaauuaaaccaacucagcaacgccagccauugugguuucagggcaagcugccuguccugcugcuuggccgcuccucagagcugcggccgggagaguucguggucgccaucggaagcccguuuucccuucaaaacacagucaccaccgggaucgugagcaccacccagcgaggcggcaaagagcuggggcuccgcaacucagacauggacuacauccagaccgacgccaucaucaacgugagccucugucccucugcggguggggauuggggcagaguuuugccagggggagaggagucagcauaggucuuagccccugacuuuguuguagucugcgugaagggauggaacuagaccaagccauguggauucuagugccagcagcauggcaggggucacauggcggggacggugacaccggagcagguggacagccagccuccucccaggaggaagaaguuguauugggugcuuuagggugauugcaguuggcuucugggcuucagagagaaaaucucccuguuuacggcaccucuaaaacuuucugaaaauuguuaaggucauuuuuuuccggcaaaauauuagguuaaugggaaugaaucucagagaagaaucgugccccccacucuaggcaccgugcucaggaaacgaccaggcagggacauagauugaaccauguuaugacacgauuuguaaccuuuucauuucuguuuaauugcaguauggaaacucgggaggcccguuaguaaaccugguaaggucuuuuaaaccuauguuaggucauuuguuuuuaucuauguauacgcuguuuuuuguuuguuuguuuguuguuuguuuguuuuugaggcagggggucuuuucaaacauaagguugccaaaguguauuauaaauuccuuuaaaauggcucuguaaauguacugcgugcuugcaaaugacccuacggaucuuuucuggaaagaguaaggcaggccggaggugaggguuggaaauguuaugccagagaacacacuugugucucagaguuacagguaaacaccgugaaauucagggccaaugcaggaguaaggugaaggucacuaaaaaugcuggccagucaccgaaagcaccuccuccaaauuaaaucuccugggcugcugaaggagcuggcugggcucauacacauuuucucuuggccaggaauccucccuuaaggccuggcuggaaugaggaggaguuacccacccacaaagauaucacuuaagucuucccuuaaauacuugagcagaaaaagugaagccuuagaacacagaccagcagagcuagagggcagcucuggggccauuuauagagggcagcucuggggccauuuauagagggcagcucuggggccauuuauaggggcugucuuuagcaaggcccagugugauggcaccuccuagauggugccuuggcaucagguacugacaucucagcacuccugggaagugugcacuuggcagcuuucucuucccagcagaggggcagcugugcucccagcucuguccucugccuccccgcgcagcacuuggggauggaguggagauggcuuugcugguaaugaagcaugacagcccuaagcucuaggguuguuucccccugaagucagcagagucaucuuaagaucauuagacaugggagaagcaggaaggugugggcagccaccuaaaggaguuugagccuuuggaaacguauuccuugugaaacaggagcaaaucauaucgugcauuuugaaacuaucugugcuuaccgugaggugagcacccagugccgaccuggaguaugugcgauucuuccacagcugcgcguggcucgcgcugccuggguguccugaugccucucucccugcugccacggggauccccuccuugcaucuccccacuucgaucucugaaauagcucagggacuucuuucaggcauauucucucuggguguguaccugccgguaaagcuucacgauucaguaagccguguccuucuugcuuuucaggacggugaagugauuggaauuaacacuuugaaagugacagcuggaaucuccuuugcaaucccaucugauaagauuaaaaaguuccucacggagucccaugaccgacaggccaaagguaggcaaggcccacacagcccuggggacuccggagauggggccugaagcucagcugcccuuugggacuuggggaagggaaaagcggcagccccuaggacuagccaagccgucucugauccagaagugaacgggaaugcacauuacuaaaucccucgcagaaggucacagacauuucaccauuuuuguccucugaucauggcaaugucacuugagucagucuaauauguaccaggcaugauccuaggugacuuguguacauuauuucacuuucuuuauguaugucacuuaauucuuuugcccuaucaguuaggaauuacuagucccauuuugcugaugagaaaacgguucagggagaucauucugcaaacguuuauugccccaucugcucuaagucaagcagggagcuuggcaguggacagcucaacuggggccuggggcucaacaggggccuuugccggugugacuuuuauguucuguugggggaugggaaggcugacaguaaauaaucaaacacauaagauacuauuagugcucccaagaaaacggaucaggguggccgucaagggagcgacuggaggggcagcugguggagaugguguggccaggaaaugccuuccaagcugaggucugagugaggaggaaccagcgggcagggauguggggggaacacuccagaaggaaagacagaggacucagcauaguugagugagcacaaggccccugaaguggccugagggccggagcacagugacagcauggaguuccccgggguggaaagaggccaaggccgggcgagcaggcucacagcaggccguggugagggaccuggguugcauccuaacgacauuuaagaacagggaaguuuaugaucugauugaugucacugaaaggacacucugauggcugcggggagucugcuggagggguugcuggaaguuggggaccgguuaaggggcucucccagccaucuggaugagacaugcuggggucucagacaagggugguggcaguggaggugggacagaggggucacauuccagauauauaugggggguagagcaagcuuggggaagggccagcugucaggaugaggccaugaggaauuaagggucaugcccagguaccugaccauuaauugaaacaaugggacuuucccaaggucccccagaggggagggguccagaccaggauuugagccgcaaccucaguguacccuucuguggcccuuccugcaaccugggggauugggcccccggccccugguguccccagcacccccaccaacugggcugaccuucugcugucccuuuguugucucaccaggaaaagccaucaccaagaagaaguauauugguauccgaaugaugucacucacguccagguggguaaacaggaugcgugucugugucuuaaauuuuaauaaaccugaacuucagaaggugcucacgggcaccccugaaagagaaaccuuaugcugccuuaagacgucucaguuucugcuuauaaugaaguagcaucgggaaagaggacaggucauuagccuuggccccuuuguuugguuuuaaccuguguuuuugcauucugagcugguuuucuucacuggcagcaggcccuccgguguagaagguucugcccuccucuuugaaggcaggccugaacagugugugcgugguggggcuguugauucacucuggcucacgucuuccuuaccccacauucuguugaaacccacauuccaggagggccccaagccccucccgcagcucuaggcacucugcuuucguugcucugcagcucgugggccgcggcuccaggaaugccagggcagguccagcgcagggaagugaaugacugaugugcuuguuuuccccgagcugguggaauugcggccugugguuggcaggcucauggcauccugguguucuaaacuggaugaaaaauucugguguaaucucaugaguccugguaguagacucaccuggcauggcuaaaacugucagagguaaaguagguaaagacuagaauauaguaacagauagauuaauguguucauuacuaugaugaauuaaugauucacucacugugaaaguauuaauauauuuugauacauguuaugaaugguggucccuuucuuagcacuccagaagauggagccauuugucaagguuaaaguguccccucaguuguuugccuuuggaacuacgagguguagggaaagaugguaagcccuuggugcccagcuuccuggguuccugucccugcucugauauguccugccuugugaccuugggaacgauaugaccccugagugccucaguuuccuccucuucaggauagggaugacagcgcaggugcuucugauguguggccaggcucagaucagggagugguggcaggggucaccagccacagugaugccagccacuauguaucacacguacugggccaggugccuuacugggaugaucucaucugauccucacaacucauguuguaggguacuguuauuauccccauuuugcaggugaggaaaugaaggcacagagaaguuaagcaacuguccgaggucacacagcuagcaaauggccgagcuagggcugcaaaccaggccaaccacuguacuuuacugacuccuuaguaauagcuacuauuaauuaagaaauaauaacaaugaugauggcugggugcgguggcucacaucuguaaucccagcacuuugggaggccaaggcgggcagaucacuugaggccaggaguucgagaccagccuggccaauuugugaaacccuguuucuacuaaaaauauaaaaaauuagccgggcuugguggcaggcaccuguaaucccagcuacucggguggcugaggcaggagaauugcuugaacccgggauauguagguugcagugaacugagaucguaccacugcacuccagccugggcgacagagcaagacucugucucaaaaaaaaaaaaauaaauaaaaaaaauaaauaaauaauaaagcacuuuccuugcuguuaccaaguaaaucuuugacucugguagacaggcaauuuuaauuuuaaaauaggaucagaauuccuggaggaauuuuaccuuagaccuaaggagaagacgggaacuggugagagcugaguuuugcgugaggaaggccugguguuucuucacacuaacacgggugcuuuuucucuggagcagcaaagccaaagagcugaaggaccggcaccgggacuucccagacgugaucucaggagcguauauaauugaaguaauuccugauaccccagcagaagcgugaguuggagucguuuucucuuuucccaauauucuuguuguuccuguggggguagcaggaagagggagcgcuguuccuuuucuacuggcucagaugauuauguugauccuugacagacguggucggacguugcuugucauuccugcuggccaggccuuccgaccuggcucggcucgggacucauccauaggagggugccuucugucuucaaaaguccuugcuccacgaggacccuccagauggacagagcaauagcagacucguaaugagucucugagauggcccggcuggccagagagaggguuucaggaacaguguccccaagcccucacuuggugguccuuuucuaggcuucaggacccuucucuuccuggagucuuccagaaugucucugacaauuaggcccauaccugucaacaccuccagaaaaauaacccaagugauaucaaaguaacaugacaagaaguagcucaaccauccaucaggguuuguuaccuguauuggcggaauauccagagaaaagugcgagaccagggaccagcaaaugugccuugggggcuggaucuggcccacugccugcuuuuauauggagcugugggcuaagaauaguuuuugcauuuuauuuuuauuuuuacuuauuuuuuauuuucauagguuuuugggggaacaggugguauuugguuacaugaguaaguucuuugguggugauuugugagguuuuggugcacccaucacccaagcaguguacacugaacccaauuuguagucuuuuaucccucaucccugucccagccuuuccccuugaguccccagaguccauuguaucauucuuaugccuuuguguccucguagcuuaguucccacuuaugagaacauuuaaaugguugaaaaaauccugaaauaagaauaguauuuugugacauguuaaauuuguaugaaauucaaauuucaguguccacuguaauuugguuuaugacaucuaugguggcuuuugugcuggaacagcagaguugaguagcuucaacagagaccauauguacugcaaagccuaaaauauuuccuauggagcccuuuacagaaaaaguuugcagacccuugugcuagcccaugaaggaccaugacagcguuuugacgcugagcuauauaagagcuacaguuauaguggcaaccacacaaaggaagugccucuuaacagaaacauuccgcccaccccuauaggaacugcauucugaguugcaauacccauuauaagcaaguuggccagauaguggccaacuaucuggcagauaucuggccaacuacguggcagauaguaccugguacauccuuccccacuuuggggucaaucuugaccuuugaucuccuuggggucauaaagccacacaaguguuaguaggcauuucuacaguggacacaauggaugauuuagccuaaaaaucucaaaaggagcccagcauccuggcacaugcauguaaucccagcuacucaggaggcugaagcagaaggaucccuugagcccaggaguucgagacuagcuugggcaacaauugagaccccaucucaaaaaaaaaaaaaaaaaaaaaaaaagaguggggaaaaaagaacauuauuaaaaaaaaaaaccuuaaaaaguaauccaaucuaccgaugguuuauuuuuuauuuuauuuuauuuuuuuugagauggaaucccacucugucacccaggcuggagugcaguggcacaaucuuggcucacugcaaccuccaccuccuggguucaagugaaucucuugccucagccucugaguagcugggauuacaggugcccaccaccaaaccuggcucuuuuuuuuuuuuuuuuuguaauuuuaguagagacggggcuucaccauguuggccaggcuggucuugaacuccugaccucaggugauccaccugccucagccucccaaagugcugggauuacaggcaugagccaccgugccugacccacugaugguuugaauuauucuaaguucgccaccguccaauccuguuugcucugggcuuuuagguucuaagcugugccucuguccauguaaagucagaccaggaggaauggaaacacgaaacauugccauuguguuucccuuuguguugcagugguggucucaaggaaaacgacgucauaaucagcaucaauggacaguccguggucuccgccaaugaugucagcgacgucauuaaaagggaaagcacccugaacauggugguccgcagggguaaugaagauaucaugaucacagugauucccgaagaaauugacccauaggcagaggcaugagcuggacuucauguuucccucaaagacucucccguggaugacggaugaggacucugggcugcuggaauaggacacucaagacuuuugacugccauuuuguuuguucaguggagacucccuggccaacagaauccuucuugauaguuugcaggcaaaacaaauguaauguugcagauccgcaggcagaagcucugcccuucuguauccuauguaugcagugugcuuuuucuugccagcuugggccauucuugcuuagacagucagcauuugucuccuccuuuaacugagucaucaucuuaguccaacuaaugcagucgauacaaugcguagauagaagaagccccacgggagccaggaugggacuggucguguuugugcuuuucuccaagucagcacccaaaggucaaugcacagagaccccgggugggugagcgcuggcuucucaaacggccgaaguugccucuuuuaggaaucucuuuggaauugggagcacgaugacucugaguuugagcuauuaaaguacuucuuacacauugcu

SEQ ID NO: 15439 - RNA, 690 nt, Homo sapiens
acgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaag

SEQ ID NO: 15440 - RNA, 68385 nt, Homo sapiens
cggggccaaugacagggcggcgagcggcggggucuggccuugacguugugccgcucgccgcgggguuuauuuggcuccgggucccucggccgccgccauuaggguccgcagcgcccgcggccgccucccacaccucagugcccccgccccccggggcuccccagucuccgcgccuccucucugcuccucucccccggccuccggcagccgggagccgcgcgcggacccucggagaccauguccugacugaggggagagggcggaggcggcagcagcggggcgggcggcggcgcgaagggaggcggagaggggccgggcucgacucguagccgcgggcugcgcggggagucgccgcugccgccgccgccgccgccgccgccgccgccgccaagcgcccgucggacggggaggaggagcaggagcuggaggaggagccgccgccgccagguaaccgggccccggggggcgccccaccgcggccugccgggccccucgcucccaggcggcgcccagguugccgggccucacgggcuguccgcccgcccggcgccccaggggcgaccgcgucgcaggcgcggggagggcaggggcccgggccgccgcugucggcgcuuccaucuugggcgcuccgguugcggggacggcccgggggcugugggagggcggguccgcccagcuuguuuaccgaccgccggccgcccguggcuggacgcggugccggucccaccgccgcucuuccgccagauuuccccacaacuucuuuuccugccggagacggaucggcgagugggguuucgcucccacuccgcaauaggccguaaacacuuggguccaucgccacaaguugguucuggugucuccaaacuuguauuucagucccucggccgcuugcuuuccaccuccugcgguggccuccaguugccauuuguaggaaaauaaaggugggggacgacgaggcggguggggaggaggagcuggagcuaguggaaagauucgucuaccccuccugcucgcaguaacgaguguucagugcaaggaucuguuuuuucucugcuaugguuuggugcgggucauuucacagacaaaagaacuguagugaaugcuggcauuaagcgcaagggacaggcaguuuagguuaagccuggaaguuugaaccggcccauuaucuuugagauacacugguguuuugaaacucucuugcugaggauauuguauuucagucaguugauuacccuuuucuguaacuccguagacuaucgauuuaagcgccgccccaucuuaccaguauuuugguuucaccguguuuaugaugauguuaauaaaucuaaugugcaaaaauaccguuuuaggaacacaauuggagauaauuuuuuuuuguauuugagacggaguuucccccuuguuacccaggcuggagugcaguggcgcuaucucggcucaccgcaaccuccgccucccagguucaagcgauucuccugcuucugccucccgaguaguugggacuacaggcaugcgccaccacgcccggcuaauuuuguauuuuuaguagagaugggguuucuccauguuggucaggcuggucucgcaccucugaccucaggugaucugcccgccucggccuuccaaaguccuggauuauaggcaugugccaccgcgcuuggccugagagaaaucuuuaacucugggaccuauuauauaaugaguuauuucuuuaccuguguguuuuaguuaacuucuuuuaucacuugugcagcauccagcaguaccccuguuuuggucaaacauggaugacucaguguacaaaccauaagccaggggaaaccauaaggaauuuugaucuuggcuugugccaaggcucuugggaaagucaucugaacuaugggagaaauaaagcuggaucuugucuccuuguuauuauuuugaauuaaaugagggaauucuaaaaaaauuuagaauccuauugacuuuuggcucuaaagauaggcagucucuuuauacuaaaauuucauaacauuguuuuuauugggcuguuggggguuuacgagauaguaggacaguaaugacauuuugcucuuuugaggaggauguuaucugagugucaugagggauuuuauuucuguugcuguuucgauaccuuuuauuaaugccucagagcauugggacacccauuuauuuacucuugaaaugugcuugggugugaugaacucauucaugguaauauauuuuaagcucauggccuugauccaugucuguacacugauagggguuauggaugucacauuuaaagucugaggauuaacauaguuuuggaacucaugaucuaguuguacaauauaugaggcaaauugcuucauauguguaauugauacagugagagcuuguccaugugcuuuauaauaaauguaaacuuuaaaugugaauuacaaaaguaguccacuggccgggcccguggcucaugccuauaaucccagcacuuugggagguugaggcgggcggaucgccugaggucaguaguucgagaccagccuggccaacauggugaaaccccgucucuacuaaaaauacaagaaaauuugccggguaugguggcgugugccuguaaucccagcuacucgggaggcugaggcaagagaaucucuugaacgccggaggcggagguugcugcgagccgagauccagccacugcacuccagccugggcaacggagcaggacuccauuucaaaacaaaacaaaaguagaccacuauuaauuugguucagguuuuuuuuuuuuuccuccuccuccuccuuuuuuuuuuuuuuuugagauguagucucucucugucacccaggcugaauugcaguggcgcgauuuccgcucacugcaaccuccgccuuccguguucacgccauucuccugccucauccucccgaguagcugggacuacaggcaccugccaccacgcccggcuaauuuuuuguauuuuuaguggagacggaguuucaccguguuagccaggauggucucgaucuccugaccuugugauccacccgccucggccucccagacugcugggauuacaggcgugagccaccgcgcccggcccccccccccccuuuuuuuuuuuuugagaccuugucucaucacuguguugcccaggcuggagugccguggcaugaucucgguucacuacaaccuccgccucccggguucaagcgauucuucugccucagucucucgaguagcugcugggauuacaggcgcgugccaccacgccuggcuaauuuuuguauuuuuaguagagacaggguuucaccauguuggcuaggcuggucucgaacuccugaccucagaugaucaucugccugccucggccucccagaggcugggauuacaggcgugagccaccgcacucggccggauuugguucaguuuuauuauaugggcauugcugcuugccucuuccuuuccaauaauaaucucuugugucugggcuuugaauacuuauccucucauugauuugguauucgauuuggaauauuugugcuccacuuaugccuuaugccuugcacauuugaacacucuuaccuccucacaucacaacauaaagacuuagagaaaacuccuuuauacaggcaaaauaaaguucaagcuucuuggugugguguucaaguuucucuguagucuggaacugauccauucuucaguccuaacucuaauuuauuugugaaucccuaacucuagccacacuaacuugcuuguuguuccuaugaagucccuccucuuggccuugcuuuaugccauucuuucuguuugaaauccucuucugcuuguauucauggagacaauguucugggccaagagagguccugucucuagagaagccuuuuuugacuacuuuaacccaagggaucuauucagucuucucuugcgugagacuuucuuuucuuagaauaugcuagccuugauuucaguuaucuuuuuauguuucuauuuugcuucccaacuaguuuuuuaagacuucugccaaauggguauaucucuauacccuguaucuaucuauggagaccauauauucagcacugaaaauaugaauacauggucugacaaaguauuuuugguuauagagguauucuaggauaugcaguuuguacuguaguaaguauugguguuucugggacuuuaugguuuaugagacaaauacuugaaacuauggcugucucuuuaaaaauuugguugguauguuuauauguauuaucagcauacuucuuugcccuguagaggauguucagcauuuugauaguguuugugucauauuauuaaaauaaaaauuaaauauuauguuucucugguuuacuucagauuugugucuggggcaguuacuugggucuuggaugcuaaguuuggucauuccauauuguauggagguaacauuuagcaucaugggaaggagaaaauaaucuguagccucaguuuguauucuuaaccucagauguuggcagccugugucacugaugauaaggcagaugagacaggagaauaugugauucacuacugcuaccugucaaccgucuugaaugaaaaauaagcugguccacagaauuuuuguauaccaaggauaacacauguaauuauguaguacauaggugaaugcugaugcauuuggaaaauagguguguguguuucucuuguauuggaugaguaggagguaugguauuuuauggguacacagucucuuggcacuaaaccaucuugacuuaccuacuacaucuauguggaaaccuguccucuuucuccaguucaauaaaauauuuuuccccuugaaauucauuuuuagaaaguauauaaaaaguauuuuuuuucaagugucagaaaccuuuuagcaucauugaaguuaaaaugacuguccauaaacuuuucagaaauaguaggcauuuuaggcuacuagauuuguaaaagguauuuucauagaauuauaccagugauuucaccaccugaaaaaucuggauccguaagcauucuuugcuuuuuggaagggugguauuuugguuaauuccaugaaguuuuugacaggagccauaaguuugaauuuuaaaauggggguuggccagguaaauugaauauaaaauuaauauuuuuucugcugccuagugaauuaaauuaaaaaaaauuuuuuuugacacagggucuugcugugucucccaggccagagugcagugcugaucaugacucaacaaacuguccucccacuuuagccucccaaguagcuggaacuauagguguguaccauugugccuggcuuuuuaaaaaaauuuuuuguagagacaagaucucucuauauugcccccaggcuggucuugaauuccugggcucaaccaauccucuugccuuggccucccaaagugcugggauuauuggcaugaaccccugagcccaaauuauauauauauguaaaauauauauauauauauguaaaauauauauauauauguaaaauauauauauauauguaaaauauauguauauauauauuuuuuuuuuaauagggucucacuguguugcccaggcuggaguguauggcaugaucacaacucacugcagccuugacuucccaggcucaagcuauccucucacuucagccuccccaguagcugagacuacagaugcgugccaccacaccuggcuaauuuuuuuuuuuuuuuuuuaagauggagucucucccuguuacccaggcuggaguacaauggcacgaucucagcucacugcaaccuccaccacccggcuugaagugauucuccugccucagccuucugaguagcugggauuacaggcacgugccaccaugcccagcucauuuuuuuguaucuuuuaguagagauggggugucaccguguuggcccggcuggucucgaacugaccucgugaucugcccgccucugccucccaaagugcugggauuacaggcgugagccacugugcccagccuugccuggcuaauuuuuguauucagccgugguaagccacugcgccuggcccuaaauuuuuuaguaaugaaaaaaauaaacuacuacccaggcguggugucauguggcuguagucccagcuacaugggaggcucaggugggaggaucgcuugaucccaggaauucgaguccagucuggguguauuaguuuguuuucacauugcuauaaagaacuaucagccgggcgcaguggcucacuccugugaucccagcacauuaggaggccuaggcggguagaucacaaggucaggaguucaagaccauccuggccaacauggugaaaccucgucucuacuaaaaacacaaaaauuggcugggcaugguggugcacaccuguagucucaguuacucgggaggcugaggcaggagaauugcuugaacccaggaggcagagguugcagagagccgagcuacacuccagccugggcgacagagcaagacucugucucaaaaacaaacaaacaaaaaaaacaaacuagcugaugccaggugcuguggcucauaccuguaaucccagcacuuugggaggccaaggcagguggaucacgagaucaggaguucgagaccaaccugaccaacauggugaaaccgugucucuacuaaaaauucaaaaaaauuagcugggcgugguggugcgcaccuguaaucccagcacuuugggaggccaaggcaggagaaucuugaacccaggagguggagguugcagugagccgagauugugccacugcgcuucagccugccucggaagaaaagaaaaagaacuaccugagauugguaauuuauaaagaaaagggguuuaacugacuaacaguuucucaugacuggggaggcuucaugaaacuuaugguagaaggugaagagaaaaaaagcaccuucacaaggcaggagagagagagugagcaggggaagugccacgcuuuuaaacuaucagaucuccugagaacucacucaguaucucaagaacagcauaggggaaaccgcccccaugauccggucacuucccaccgggucccucccuugacacauggggauuacaguuggcaaugagauuuggguggggacacagagccaaaccauauaacugggcaaaguagcaagacccuaucucuuaccaaaaaaaaagaauuuuuguuauuuuuauuguucauauauugagggcaaacugucccucucacuccugaacucacacaccgcaguuuugguuuuucauccuuugucaagucaauuuuuaauguggguggucucuuucuuuuuuuuuugagauggggucuugguacguuacucaggcuggugucaaacuccugaguucaagugaucugcccgccuuggccucccaaagugcugggacugcaggcuugaugagccuccgcaccuggccauaaugugggugguuuuaauucauauaaauaaaaaauauuugaaugcgugauauuaauuggaaucaguugcaaaucuuuccaguuuuuucuaaaaaaaaaaaaaagcagcuucauugagguguauuucauauaccauaaaauucaccccuuuaaaguauacaauucaguaguuuuuaguauacuuaacagaguuguacagccauuaccaaccacuauauaauccuggaacauuuucaugaccccaaaaagaaacucuguacucauuaaggagucauuuccgccuugccucagcuccuggcaaccacuaaucuacuuugucucucuagauuugccuauucuggauaugucguaaauggaauuguacaauauaugaccguuuauguggcuuuuuucucuuauaauacuuccaagguuuauguuguggcaugugucaguacuucauuccuuuuuguggcuggcugauacuccauuguauaaacagcauuuuguuuauccauucauugauugaugggcauuuggauuuuuuccacuuuuuggcuauuauacugcugugaacauuuguguacaaguuuuuguucagauguaaguuuuuacuucucuuggguauauaccuacagauggaauugcugggucaugugcuaauuauguuuaaccuuugaggaacuuucugccuguuuuccaaagugguugcaucauuuugcuguuuuuuuuuuuuuugagacagcgucucaguuugucugcccaggcuggagugcaguggcgugaucucggcucacugcaaccuccgccucccggguucaggcgauucucaugucucagcuuccugaguagcugggacuacaggcacgcaccaccaugccuggcuaauuuuuguauuuuuuuaguagagaugagguuucauuauguugaccaggcuggucucgaacuccugaccucaagugauccacccgccucggccucccaaaaugcugggauuacaggcgugagccacugcucccugcccauuuuacauuucugccagcaauauauguuccguuucucuacauccuaaucaacacuuguuauugucuguuuuuuuuuuaaauugucauucuaguggaauggcaucuccuaguuuuuauuugcauuucccuaaugacuaaugaugagcaucuuuucaugugcuucuuggccauuugcauaucuuguuuagagugguguuuauuucaguguuuugcccauuuuucauuuggguuauuugucuuuuuguuggugauuuuuugcaagaguucuuuauguauucuggauacaauucccuuccuguauuugcaaauacuuucuucugucuguggguuguguuuucaccuucuuuaugguguucuuugaagcacaaaaguuuuuaauuugauuaaguuaccuauguuuucuuuugucacuugugcuuuugccuaacccagggucaugacaauuuauguuuucuucuaagaguuucuuaguuuuagcucucaaauuuaggucucugaucauuuugaguugagcuuuguguauaauuugaggcagagguccaacugaguuuuuuugcauguggcugucugguuaucccugcaucauuuguugaaacacacuuaguuuuagcagugcacagucacgcguugcuuaaauguucugagcaaugcauuuuuaggugauuuugucguugugcgaacaucauagagucuacuuagacaaaaccuagauaguauagccuacugcacaguaggccauggguuauagccuguuguuccuaggccauaaacgcuguauagcauguuacuguauugaauacugugguguuuuucuaacacaaagauaaguauucaugaguguaaacauaaacauagaaaaagcacaguagaaauaugguguaaaagauaaaaaaugguacaccuguauaggggaauggagcuugcaaaacuggaaguugcucuggguaagucagugagugagugaugaaugaaugucaaggacauuacuauacaccacuguagacuucauagacagugaacacuuuggcuacacuaaguuuauuuaaaaaauuuucuucaaaaauaaauuaaucuuagcuuauuguaacuuuuuaacuuuauaaauuuuuaauuuuuaaaaaaacuuuagacuuuuguaguaacacuuaaaacacaaacacauuguguagcugcacaaaaauauuuugguucuuuagauccuuaccuuauaagcuuuuuuugccaaaaacuaggacacacguuagcuuaggccuacacagggccaggaucaucaguaucacugucuuccaccuguacaucuugucccacuggaaggucuucgggggcaauaacaugcguagagcuaucaucugugauaacaaugccuucuagaauaccuccugaaggaccugccuagggcuucuuuacaguagacuuuuuuuuuuaaaggaaguaggaguaacauuguaaaaugacaauaaaaaguauaguaaacaaacugguaacauacuuauuaucaugaucagauauuacguacuguauauaauuuuacaugcuacacauagcuagacugccagcgcaguagguuuguuuacaccagcaucacuacaaacgugaguaaugaauguauugugccaugacauuaugguggcuuugacgucacaaggcaaauuuuucagcuuuguuauauaaucuuauggggacuacugucacauauacagucugucuucgauugacacaugguuaugcaggcuaucacuguaauucucuuuuuuucuuuuuuugagauggagucucgcugucgcccaggcuggagugcaguggcgcgaucucggcucacugcaggcuccgcccccugggguucacgccauccucuugccucagccuccugaguagcugggacuacaggcgcccgccaccucgcccggcuaauuuuuuguauuuuuaguggagaugggguuucaccguguuagccagaauggucucgaucuccugaucucgugauccgcccgccucggccucccaaagugcugggauuacaggcgugagccaccgcgcccggcccuguaauucucaacuguaaguugauuuauugcaaggcaggauucccuggauauaugaagaaauuaucccuauucugcagcagaaggaaaggaucucucuuaguguugcacaguaaaaguugaaacaauacacuugugaguggaauucugaagacaucacuucugugauuuuuaaaccacuucuaaauccuuuccucuuuuguuugugguggguaauuaacuucacuuuuugguauuuaauggagcuaaaguuuauuuuuaaacgggaacuaguucaguuuuccgaacuaacuaaacuuuuuguggaauacuaucuuuugauaccagcagaauauuaaguuucuuuuuauuaacuaaaugauuaauaagcaauguuuacauggagauacuguuuagggacauaaugaguuuuucacaguucaguguuagaaacaaaucauaauucaguaaacuaagaacuauuuuagaaguuuguuuugaagugguaaagaagggauuaaaggccuggcgcggugggucauuccuguaaucccagcacuuugggaggcugaggcgggcagaucacuugaggccaggaguuggagaccagccuggccaacauggcgaaaccccaucucuaccaaaaacacaaaaauuagcugggcgugguggcacaugcccauaaucccagcuucuugggaggcugaggcauaagaauugcuugaaccugggagauggagguugcagugagcugagaucgcaucacugcacuacagccugggugauagagcaagacugucugaaaaaaagaaaaaauaaauaaaagaacuaaguuuauucaguaacaugagauugggguuggucaggaugggcuuuaccgaggugggaacauuuaagcugguccuugaaggagcaguaccagauuucuagguauauaaaacgggguaagaaggggaauaggaguaggcaagcauccuguuacgagugaaggcauggagacaugaaaauuacaugucaucuuuagggacuagcagaggcuacggugucgccgaagcaugcggaugagguuggaaaggcacucuuagcacuugauccucaccuuccccuggggcugggaauuagaagggaggagugaucuccuuaaguguggaucaucuuuacagaugugaagagccauuacccaccccuccccaacugugcaacugugaguguguauugggaagauaugucagggauauuugugguauauauuagaaguguugaaggcauuguuuuuauagaaauuauuuuaguaaauucuuuuuuauuauugggcaccuccuaugugauuugaaguugcuuaggauuuucuaaaagauuacauaaaauacuguugaaaagaugauugcauacaaaacauaaucuguucauuguuaaacguauacgaaauguugggauacaucugugaacaagacaaagucuuugcuaauuguguucuauuuacgcucuaguguggagagacaaaugaagaaagaaaugucagauagugauaagugcugugcagaaaauuaaaguagggugaugugauggagaaugccugaguggucagagaaaaucuuucugaagaggugacauuuaaacugauaucucaaugacaagaaugauguggaaaaucuggggaaauaacauucuaggcagaggagauuucuaauacaaagcaccuaaagggagaaucaucuugacuuguaaaaggaacagaaagucacuuuauguaaaaauuuguaaguaaggcuggggaguuuuaauuuuauucuguguaaggaugguggauagaguggaagugcuagaucacuuagucucugcaguaauccaagugacaaauaaugguggcuuggaauagggguauagcaggggagucuggaaugaagcaaacuuuuggggacuuguuuaggagguaguaucagugguagcuagcuaaucuguuuuguagccugauaaucuuggacaauguguuuauaaucauggaagguuguggugcauuagcaagaggguacuggagucagaacugggguucacuuccuagccuugugacccuggacgagauguuucaccucuccugaaggcacagauucuuuuuuuuuuuuuuguaacggagucucuguugcccaggcuggagugcaguggcgagaucucggcucacugcaacguccgucuacaguauucaagcaauucuccugccucagccuccugaguagcugggauuacaggugcgcaccaccacaccuggcuaauuuuuuuuugucuuuuuaguagagacgggguuucaccauguuggucagguuggucucgaucuccugaccucgugaucugcccaccucugccucccaaagugcugggauuacaagugugagccaccgcgccuggccaacacagauucuuauucauaaaaauggaggcugggcgccguggcucaugccuguaaucccagcacugugggaggccgaggcggguggaucaugaggucaggaguucgagaccagccuggccaacauagugaaacccugucucuaucaaaaauacaaaaaguagcuggguuugguggcacacgccuguagucccagcuacuuaggaggcugaggcaggagaaucacuugaaccugggaggcagagguugcagugaggugagaucugccaucgcacuccagccugggcaacagagcgagacucugucucaaaaaaaaaaaaaaaaaaaagauaugggguacuuuaagagggaagguaccugaggauucaaugaaguuacuguucuuuaccuaaagcuccguacaaaacuuaaguugauguuacaucaagcuggcgaguguucgugauguuaauggguuuugaagugaucaguuuuagcccuccacuuaaagauagguaagccauuaugguccccauuuuuucagaugugaggcuuggguucuaaggcuuuggcuaguauuucagauguaagagagggagagggacucaaacucacauuuugaaagugcaguacauuuccuuccuuccuuuccuucugucuuucuuucuuucauggauucucacucugucgcccaggcuggagugcaguggugcaaccuuggcucacugcagccuccuccuccuggguucaagcaauucuccugccucagccuccugaguagcugggauuauagguacccaccaccauauccagcuaauuuuuguauuuuuaguagagacaggguuucaccauguuggccaggcuggucucaaacuccugaccuuaggugauccgccugccuuggccucccaaagugcugggauuacaggcaugagccacgguaccugaccugguacauuuucauauaugugagagaacuagguauaaauaucaagagaugaaagugguuuuuccauaguaaaguacauuucuaugcuuuagugaaagauaauaaauuauuaaagggaaauauuauaggauauucuugacguauauauuuggaagaguagcugagaagauacuuaaaagauuaaucauggcuaugugcaguggcucaugccuguaaacccagcacuuuggaaggcugagucgagaagauugaggccuggaguucgagauuagccuggacaauguaugagaccuugucucuaauaaaaauuuaaaaaauagcucgguguaauggugugcgccuguaggcccagcuacucuggaggcugaggugggaggaucacuugagucugggaggucgagguugcagugagccaugaucaugcugcucuagcuuaggccacagaguaagacccucucuguuaaaaaccaaaaaucaguuagucaugaagggcuuuuuaugcccucuuaaggauauaaauguauuuuuuggagacaagauuuugcuuuuucucuuggcuguagugcaguggugugaucauagcucacugcagcauugaccuuccgggcucaagugauccucucaccucagccuagcugggacuacaggcgugugccaccauaccgggcuaacuuuauaacgauuuuuuguagagauggagucucacuauguugcccaggcugaucuugaacuccuaggccucccaaggugcuaggauuacagcagugguuccuacugcuccagcccugugucauuuuaaauacucuccguuauuauuauuuuuugagacagagucuugcucuguugcccaggcuggagugcaguaguguggucucggcucacugcagccuuugccuccuagguucaagugauucuccugccucagccuccccaguagcugggauuacaggugcccaccacgacucccggcuaauuuuuguauuuuugguagagacaagguuucaccauguugaccaggcuggucuugagcuccugaucucuggugaucugcccaccucagccucccaaaaugcugggauuacaggcgugagccacugcgccuggccuaaaaauacuuuauuuuuuagagcaguguuaaguucacaacaaaauugagcagaaaauacagagaguucccauacaccugcugcccccauguuucccccacugucuacauccuuccacagagugguauauuuguuaacaauuaaugaaccaacauugacacauaaucacccaaaguacauaauuuacaguaggauucacucuguagauucuaugggcuuugacaaauuuauaaugaaaaguaucuaucauaauagcacacagugauuucacugcucuaaaacuccucugugcucuuccuauucaucccuucccucuaacucuugcaauccccugaucuuuuuacugucuucauguuuugccuuuucuagaaugucauauaguuggaaucauacauuauguaacuguuucagguugucugucacuuaguaguaugcauuuaagguucauccaugucuuucuguagcuuuauagcccauuuguuuuuagagcuguauaauauuccauugucuggauguaccacaguuuauccauucacccacugaaggacaucuugguucuuuccaacuuuuugcaauuagaaaaaaauucccacacuauacggguguaaagauuuuuuuuuuuuuuuuuuuuuuuuuugagauggagucucacucuguugcccaggcuggaguguaguggugcguucuuggcucacugcaaccucugccuccuggguucaagugauucuugugcuucagccucccaaguagcuggaacuacagguacccgccaccgcaccuggcuaguuuuuuauaauuuuaguagagaugggguuuuaccauguuggccaggcuggucuugaacuccugaccucaaguaauccacccaccucggccucccagagugcugggauuacagguaugauuuugaauucccaccagcaaugaaugagaguuccuguugcuccacauucuugauagcauuuguuagugucaguguuuuggauuuuagccauucuaguaaguauguggugguaucuaauuguuuuaauuuguaauuaccuaaugauguaugguguauuuuuguauuuuuaguagagacaggguuucaccauguuggccaggcuggucuugaacuccugaccucaggugaucagcccaccuuggccucccaaagugcugggauuauaggcgcgagccaccccccugcauuugaaaagauguucaacaucuuuucauaugcuuauuuaccaccuauauauauucuucggugaggugucuguucagaucuuuugcccauuuuucaguuaagugguuuucuuacugaguuuuaagaguucuucguguauuuuggauaauagucacuuaucuuuugcaaauuuuuuuucugguuuuugguauucuuauucucuugacagugucuuucacagagcagaaguuuuaaauaaucagugaaguccagcuuaaucaguuuacuuucuuuucuuucuuuuuuuuuuuuuuugagauggaauuuugcucuuguugcccaggcuggagagcaauggcgcgaucucggcucacugcaacguccaccucccagguucaagcgauucuccugccucagccuccugaguagcugggguuacaggugcgcgccaccaugcccagcuaauuuuuucguauuuuuaauagagacaggguuucaccauguuggucaggcuggucucaaacuccugaccucgugauccaccugccucagccucccaaagugcuggguuuacaggcgugagccacugugccuggcugacagaaauuaaauucugaaugaaguagcauguucauaguucuugcaaaaguuguuuuauuauuauuuaaaugcuggauugcuguguauuuuuggaguuaauuguuccauuuccauacauguuuaagaaaacuguggucuuucauccaguuagauugcagguucucugagcacagggacaguguuuugucuaguuauaucucuccauauuucugagugcaugguaaaccuuugguaaauguugucauagguuguuacauuaguuuuguuugggauugugauuuaagguacgugauugaccugggaugucucaaacuguguaaaggaacuaugcucuaagauagguucugcugaagcucaagacauaccuguauuacacccgcucacuuucuuguuacgauugaggaacugaaguguucagauagaguaaguauguaaagagcuagaaauccuccugagaugacaagaugaacagaaagagcauuaauauuguuucaugcuagauuugacacaauguaaguuaacuuuuugucuuuaagaucuucuuucauucuagucaguggauugcuaauugucuagugguuuaaaagaaaacaagaccauuagaguuguaacuuuuauuacaguuuuuucuaauguauccuugacagauuaaaauguaacauuuaaauucguuacauuuugaagauuuagguuugguuggaaugaaguuaguuguaguuguagaggguaaucaccucaguuaauuaaggcauagugcugauaaggccaaggucacccuggcagguguuauuuaauuuuaccuuguccaacuuauccacaaauuccugggaagaguacaguguguuuaguucagaucuacucauuugauacagaugccauagauaauagugaccucuuuuuauaggaaugccagcucauuuuugagaucuaauuauugauuauuuacauacaauuucacacuaauuuaggacuuuuagaagauacuuaaugauugcaaaaguuuuguacuugugucauugucauagcaagauuugaauaguuaaccagcuuauggguugccacagugcucuggaugguagacuuucagagcagugacgaaaggaacaaacauuuauugaacaauuuugcggcuuuuaguagucuaaucccuuuaauuuguagaugggaaaacugaggcucagaaauaggaaauucugauuacgaauugaguuuuggacauguuaagugugagaaacuuguuaaaccuucaaauugagaugucaggugggcaacugguuuuacaaaucuugaguuaggggagagauccaacuuggagauacaaauuuuuaaauuaucaugaaguagaugauauuuaaagcccagggauugucuaagauccccaaaguaguuagagguuagagagaagaggaccaaagcuuggggcacuuggcucuuuaauucagaaagauaaggaagccaacaaagaaguuugaggaagaaaagcuacugagauuggaggaaaaccaggagaaugucuuggaagccaugugagaacaguauguuuaauuguggauuauagaaccagagagcuucagacuaagccauuuaacaaauaauuuagugauuguuguauuuugccuaagaguucuuuuuauuucaaaugccgaaguugcagaggcaaaaguguuuaauaauuucguggauucaauuacauguuacaaauuuuuuaauggggcuagaaugugaaggugcugaagucauggcuugcuguguaauauucuagcuauuuguugauguaguuguauacuuaaguauggaccuaacugguguguuaugaaaugagagaaaaacauguaauagguuuugcucaguuuauaaucuggucaaggauauaggaagacauaacaaguguaucaaacaugaaucuuaguccaaaaacucagauagaaagaagguaccacauuugcuuucuuuaaauuaacuugauuugacuucuacuucuuuggcaagaaauucaaccucagucauccuugggguccccucuccucauguuauuggaaggccuggugucauaugguucagauuuugccugcauugguuaugauacugucuuccauugccuuccacaagguuccaucagguucuguggcucugccaccaacugugggcccuagugccuguggcuugacaccuaguuuauaucuagcagacacuuuuuacugaggucuugcugccuguucaguugcugccauggaguugauuccauccucucuagaauuucuucugagauugcucacaaggucuacuccuuucuuucaucaagucauucaacauggccucuucuuggguuuuacuaaacacaaggugcuggucuaccuuccgugccacuggaaucucugaacaaagguuuuugaaagccuggcuguuugacuggaaaucgaagggagggauggaaauagaaggaugugagugacauaggaaaaacauauaugaauuagcguuccaaaaacuagccccaagaggaaauauaaagugccaaaugucaauaaaaguaugguugcuuggaguguacuuggagugaguugaaaacuucaugaagaugagacuugaacugagccuuaaaggauggguagaguucauuauaaaugagggugucuauugugcuucuguaucuaaggcaguaccuucauguguauguugggugguggugacacaugcaugagucgggcguguguggcauguuugggagugagugguguguguguuugugacaggaaggaguugagaguuuauacuguugcagaagagccucagaaagagaauuguggaacagucagcuggauggauuuagaaagggaagaugcuuagaaggcuuuuaugguaguucugaccugaacuggaaaaggauugauggcagugggaaugagaagacaguaauuagauagaaaccacuagaaagaaucuguggggagaaggcagaauuuaaggugauucugaguucucugcugggugcagagguauuaauagugucauuaauggaaacuggagaagucaagauaggaguuuguugugagaagaaaauaagggguuuaauggaggauuugauaaccuggugaagcccugaaaugagguuagauuuguagauaaaggguuuuaccauaucaucgaucuucacgauccuggucuagaccgguuguuuuuccuguugacuauugcgaagaagacagugaugaaagaauauacugaugagaaaagagaugaguaugugcgauacuuuggcuuaagaguuaaguaguuugaaguuuuuuauuuacagaaauuuuauaguucaaaauugcuuuguaauauuuuaagagccugaaaauuuagcaugcuuggaaaauccguuuuaguuuuagcuuucgucuuuauaucccuaagauguucucugagcauuuguaaaucuccgcagauuuauauuaauaagcuaauaauuauuuauauuaguaaguauaaauuuguauuaauaaagcuaauaaaaaucuuuaaggcugcuuuuuguuguuguuguuguuugagacagagucucgccgggccgcccgggcuggagugcaguggcgcaaucucugcucacuacaaccuacaccucccagguucaagcaauucuccugccucagccuccugaguagcugaguaguauaacuucucaucauuugaaacuacuggcaauugagcuuaucucaguuuguuuccugaguuugcacuugaagagaauuauuuguguguauuuuuuuuuuuuuuuuuuuugagauggaguuucgcucuuguugcccagacuggagugcagugcugcagucucggcucgcugcaaccuccaccuccuggguucaagugauuaucuugccucagccucccgaguagcugggauuauaggcaccugccaccacgcccagcaaguuuuguguuuuugguagagacgggguuucgccauguugaccaggcuggucuugaacuccugaccucaagugauccacccgccucggccucccaaagugcugggauuauaggcaucagccauugcgccccaccgagaauuauuucauuucuucaguucucuaugauuguuuaguaggugguuggggaaauuuguaguguagcuacaauuuugaggaauugacuucaauauaaauauaauucuuguacaguguuuaguaaugcuucacaaauauuaaacaugacaguauaaaaaauguuccauuauguaagucccuuucccccgccugcuauuaguacauauaccauauuucugcacuuuuauuaucugaauuggaaaguauauaauuaaaaacaguuacgaauuuaguacuugucaauuuaguaguaguaaaugguugauauauuuagagacauuauucauucuacaggcagagcuugaugcacaaauggauuccuggucuccuugguccacaggaugggaacuguugguauugcauuugaaccaaggaauauuugucuuaagaguagcaguuuugucccguucuccuuaaagaaggccuagauuauguugauuuuauugugguuuuauuuuaccaauuaauugaaguuugaguccuuggauagaauuugcaaaucugcuuugcaugcaaaauuaaacuuguaaacuaaauuuacuugggcguaugaauauauuuaauacuuaaagugauauuugguaaguuuuauuucaagguagaguauuaacuuuuagagcuggcuacuuuggaaauaauuuuauguacuuuuuggaauguuuugacaucuggaaaaaguguacucuguuaauuucuuuguaauacugcaaaaaaacacauaguucaguugauguuauccuuacuguucagugcuguuuacuaauuaccacagguagaaauggcugucucagauaaucuucaaugaauuuuuucuuuucuuuuuuuuuuuugagacaaagucucacucugagugcaauggugugaucauggcucacugcagccucaaguccccugggcugaagcgauccuccugccucagccuccugaguagcugggacuacaggcaugugccaccacccugggcuaauuuuuguauuuuuugaagagaugugguuuugccauguugcccaggcuggucucgaacucuuggauucaagcaauccaccuaccuaggccuccugugcugggauuacaggcgugagcaccuagccacucuucaaugaauuuuaccuugcaguuacuaaacaacauuccugcaauguuucaaguucucucagagugaacacuguacaucauuacguuuuuuuuuuuuuuuccuugagacagccuugcucugucaucccaggcugaagcacaguagcacaaucauaacucacuguagucuugaacuccuguacucaaaugauacuccuuccuuggccuccugaguagcugggacuauaggcacaggcgacugcaccuggcuaauuaaaaaaaaguuuuuuuuuuggucgggcauaguggcucgcgccuguaaugccagcucuuugggacgcugaggcagguggaucacuugaggccaggaguuugagaccagccuggccaacacagugaaacuccgucucuacuaaaaauaaaaaaauuggcugggcauggugggaugcgccuguggucccagcuacucuggaggcugaggcaggagauucacuugaaccugggagugaaggcugcagugagccaagauugugccacugcacuccagcuugggugacaaagugagacugucucaacaacaacaaaaaucguguuuuuuuuuuuuuuuccuuuuuuguagugauggagucuugcuguguugcccagguuggucuugaauccuggacucaagugauccucccaccucauucucccaaagugcugggauuaaagacuugagccacugugcuuauuaucuaauauaaggcacaucucaaaacucuugagcuugguuuugguauugcuuaguuaccuggauuuucagagguuggugggcuaauuaggcagcugucuguccauuauuuuaccaggcauuuaugacagugauuauuuuuuaugacaguuuuuuguuuguuuuuuaaaucagccuggacauuuaaauauauugugccagcauauuaguuacaugaagauuagcuaagauaacauaagguuacgggcuguuuaguugcaccuacaaacauaguaagacuuaucaaaacaaguauggauuuugaaugugaauauuuuaaaagauauauugaaauuacuuagaguagcccuggauauauguucauuauggcauuuaucuuguuaauaaguuucuacaugcucauuuuaauuuccaguagcaugagcaaguaacuuauauuucauucccgagaaacuaaaagaaucugccuaaagaguaugaaaauugccauuaaaucuguauugucuacuuucuggaugguuauaucauuauaguucucugcucuuccacacauuuuugggcugcuaucaguuuguaaguaaucauuauacaaacuaaauuuaaaaauuuaaacaagauaauuuuauauuacuuggaucagggaaaaaaaugcaguugcugaaggugguuucauagcuaaauauaagcaauuauuuugcuuuuucuacuuuuuuggauuuuaucaucuuuucccuuuuaguaauagaguaauacagguaggaauuaacuuagcacugccaaauuaauaguaauauuagaacuguguacacagcacaggguuaagguuauauagaaaaaugucucauccauguuuaauuuggcugaccagcccaguugauuagccaauuuuauuguuuuguuaaauuaaaauucuaaauauaguuguccauuguuaaaauaagugaguaggguuaaaauagagaauugauaaaaauaaagccuuaaaaaucuuuuagcuaaaguagcaggcuucaagugaaauucaguuuuggucuccuuuacaggaauagcuauucagucagacagaaccacuuaucacguuuugcaguaucuccugaggaagucagaauucugagccagcaugaagacggaaucuugucuuugaucugauuugcaaaccguacuuuuauucuaaucaugugcaagguggagguuauagcgugggaacuaaaaucuuaguaagugugguuuuuauuuuagcuauuaaguaguauacuuucuuauagugauuuuuuuuucuucuuagcagaguucacacuauaaaugguguauggacuuggcaggcaggaacauaauacaguauacuucaaaagugaaagauuuaggccaggcguggugguucaugccuguaauccuagcacuuugggaggucgagguggguggaucacgaggucaggaguucaucaagagaagcccggccaagaugcugaaacccuaucucuacuaaaaauacaaaaauuagccgggcaugguggcaugcaccuguaaucucggcuacuugggaggcugaggcaggagaaucgcuugaaccugggagguggagguugcagugagcuuagauugcaccacuccacugcauuccagccugggcaaaacauagcaagacuccaucucaaaaaaacaaaaaugaaaacaacaacaacaaaaaaacaaacaaacaaaagauuuaacccucuagguucaggaaaaaucccugagaaagagagagcaaagcuucuauacucugccuaggauuucuuucucuuuccgggugaaaaauagguguugggaugauacugaguugauaaaaguauuuaggaaaaguggccagugucuaaauucaagccauuaaaaaaaaaaaaauuaaauuuguuauguaaguugcuucauuuaugaauuaguugccauuaaauuaugaagucuuucuucauuauaguguaguguuagcccauuguugaauccuagaaaucuuuuaaguagugugaauaucuuuuaaauaugaauuggauuuuuuggggggcaggggauggagucucacucugucacccaggcuagagugcaguggugcgaucuuagcucacugcaaccucugccugccggguucaagcaguucucugccucagccuccugaguagcugggauuacaggcaccuaccaccaugcacggcuaauuuuuguauuuuuauagagacggggcuuuaccaucuuggccaggcuggucuugaacuccugaccuugugaucuacccgccucagccucccaaaaugcugggauuauaggcuugagcuacugcccccggccaugaauuagauuuugaguauauuuuaaauauucaaaauuuaaaauauuuuaauuaugaacauucacaauuauauuggaaugauuaugcuacugguuauuucagugaccuuccacagauuuaauuuuccccaguacagucuucuuuuuuuuacuccagauagaacuagauuuugaggcuacagauuaucaaggaacuaccuauuucauaauguuacuuuguuaauuguagccauuacuucucaacauguuucuuuacuaccugugcuaauuaagaacaguggauaauuagcauuuuaaguugcuuuucucccuuagcgagaaugauaaaauagacguugcuugaucuucugaauucaugaaucauaaucuguguucauaauuugagaaugguuauguguuuaagcuauuuuuuaguuuguguuguuuccucuaccuuugucucuuuaaacuauugguuacuuuucuaaauugaugugauggccucccugaaauuaaacauuucuauuaguggcuucccguuaaucucauccuucuuagaucaaaccucguuauaucuccugccuaucucuuuugcauuccaaaguucaguuuuauuaaaucccagggucuaagauuuuuucuuugagaauuuaucuccaguguuucuauggaaauuaaaaaagaaaauuaggauaauucaaugucgaaauguugcaugcaucuuuugagaaauuuauauuuuguagguugaaggacuugcuuuuugggcagcguauuuuuggagguggaauguaguuauuuuaauaaccauguccuaauuauuuauagcuuccugccugacacagcucacuucaagaagugcacaaugucagaacguggaauuaagugggcuugugaauauuguacguaugaaaacuggccaucugcaaucaaguguacuaugugucgugcccaaagaccuaguggaacaauuauuacagaagauccauuuaaaagugguucaagugauguugguagagauugggauccuuccagcaccgaaggaggaaguaguccuuugauauguccagacucuagugcaagaccaagggugaaaucuucguauagcauggaaaaugcaaauaaguggucaugccacauguguacauauuugaacuggccaagagcaaucagauguacccagugcuuaucccaacguaggaccaggaguccuacagaaucuccucaguccucaggaucuggcucaagaccaguugcuuuuucuguugauccuugugaggaauacaaugauagaaauaaacugaacacuaggacacagcacuggacuugcucuguuugcacauaugaaaacugggccaaggcuaaaagauguguuguuugugaucaucccagaccuaauaacauugaagcaauagaauuggcagagacugaagaggcuucuucaauaauaaaugagcaagacagagcucgauggaggggaaguugcaguagugguaauagccaaaggagaucaccuccugcuacgaagcgggacucugaagugaaaauggauuuucagaggauugaauuggcuggugcugugggaagcaaggaggaacuugaaguagacuuuaaaaaacuaaagcaaauuaaaaacaggaugaaaaagacugauuggcucuuccucaaugcuuguguggguaaguuucuguauucugcauuuuuugcgugggaugggaaaagguaguaaaaaugauaugaaaagagcugggugcgcugacacacguuuguggucuuagccacuugcuugaaaccaggaguuugaggcuguaguaugccaugaucggucugugaauagcacuugcacuccagcuuggguaacauagugagacugugucuccacgcacaugcaaaaaugugaguguguguguguguguguauauauauaugcgcaaagucacuagcauuugauucauucagcacgauagcuguacuuucaaguaugcauacauaaaaauuuguguauuugugaucuugucguaacuuuguacuaaauugcccacaauuaauuguguucaugucucuccauuacugggggcaguggaaacguuuaaguuaaagcaaaguuuuuacacaucagcaguaaaauauauaccuggacuuuaaaacugcuacucuguuuauuguaacaagauguaacugaggaacaccagcugcuguuuccaaguauuuguaaacagugugagcaucuugugaugauagaagcuuuagucagauguuaaaaauaccacaaaaaugugugacuccaagaaguugaacaaacauauugaccuugaaaauacugguguuaauuuaacaugaaugucauguaguaaauguuugcaaacuuuauggaacugauuacauguagccagcugauuccauacuucaaguuaugguucauauguauugugacauuuuccucaggaaaugcuguuaaaggacagagacauaggagagcagaguuuuucuucaguucuugaccuugugaguuaauugugauguaauucacaaaagcagugacuugagucuucaguauuuuuuuuuugaguagauuagauguuugauuuuuauuaaauuauuuggaugggcugcuugcuuugacauuuggucuuaugagggaaauuuugaaugauuacuaaguuuaaacuuuguguggaacaauagcuaagcuuuaacuauaccuuagcuguauguuuucccucaguaccaauuucuuuuauuuaucccucuggguacagcccaagaauauggaaaguuuagguguaugaaccugugaguccuaggaauugauuuccaagaaaucgugaguuuuaaaauuaaauuauauauaucauuccccccccccccccgccccaagaugggaucucacucugucacccaggcuagagggcagugaugcaaucauggcucacugcagccucaaccuccuggguucaagugaccugccaucucagccuccccaguagcugggacuccccauuagcauguaccacuaugcccugcuauuguuuuaaauuauuauuuguaaagaugggggucuaccuauguugcccaggauggucuugaacuccugggcucaagcgauucucccaccucagccuccuaaaguguugggauuauaggcauaauuugcugugcccagcugaaauccugaguuuucaauuuuagcuuuguucuggcaaaaaagaauaucccagcagaugaauccuucugaccuccagacuuaguaggcacuuagcaagucuuaguucuaguuuccucccauccugaggaugaggggaugaaaacauaccgggcuaucuucugucuguguugucccauuuuauuccucugauuuuucugcuccaaauugaggggcaacauacaguaugauugucaguuaaaaaaauuuaaacaggagauacaaaaggguuuuguuauuaguuuccuuagagaucaaauugauuuaacauaaaaauucaccguuuugcaagugaacaacucauuuggcauuuagugcauucacauuguguaaccacuaccucuguguuguuccagaacauuuucaucaucccaaaaggaaacuauguacccauuaagcaguuacugcccccuaccccuacccgcuaacccuugauaacugccagucugcuuuuggugucuguggauuuaccuauucuggauauucauauaaauggaaucuuuacauaucugugagcuuuuauguugggugugauugucuuuuaauugcuuguaugccuuuggaacagucuuaaaaucauuuuuuuuuuuuuuuuuuuuuuuuucagggaguaguguacuaugaauacuuggacuacaaggugguguuauaguacauguagguuuauagaugaaaaugaacuagacuucauugugacgguucuuaaccucacagugaaggucacuaaaccucacuaaaggucauagaauccuuuaggaaucagggcuucauuucaacccccgguugcuucaagucaguggaucucaggauaagaacaccugauuugaaauauuuucuuuccuugaaacacacaaguuagaugaaucaacauguuugucuuuaugacauuauuucuucuugguccugccuuuuucuacauauccuuacuacuuuugacuagacgacuagccauccuuguaccucuuugcauuuuauuuauuuuuuugagacagggucgcgaggcuggagugcagugcugcaaucauggcucacugcagccuugacuuccuaagcucaagccauccgcccaccucagccuccuggguagcugggacuacaggcgcauaccaccacgccuggcaaauuuuuguauuuuuuuuggagagacgggguuuuaccuuguuacccaggcuggcaucuuauuccugugcucaagugauccacccaccucagccucccagagugccaggauuacagggguaagccacuggguccggcccaucucuuugcauuuuaaucacugaguucaauuuaaaaguggaacaaggccaggcacaguggcucaggucuguuaaucccagcacuuugggagauugaguugggcgggucaccugaggucgggaguucgagaccagccugaccaacaugaagaaaccccgucucuacuaaaaauacaaaauuagccgggcaugguggcacaugccuguagucccagcuaccugggaggcugaggcaggagaaucgcuugaaccugggagguggagguugcagugagccaagacugcaccauugcacugcagccugggcaacaagagcaaaacccugucucaaaaaaaaaaaaaaaaagaaaagaaaaguggaacaaaaacuucuaccaauaggaccaguauuggauuugacguuguuuuauuuauaaaaugauuugucauuaaguugcuguuucuaccugcaaaguuucuagauucuuaggggcaaggguugauuguauuugguucuugguaauguggacuaugucuuuccuauuggcaaauaauuuuuacuauuaacucuacaaugucauucugaacuguuauacguaagguuauaauuauaggccuguuucuaugggauagccauauucugauguguaaacauaacugaaauauguuaaauacuuuuuuuaaacuuguuuacauuguguuggguuaauuuaaaaaaaggcuugagcaguaagacuaacagaaguucacauguacucaaaauuaaucuuuacgucccuuuucugccugccuuauguuccccagauuucauuagauacaguguauuuuggguuauugauguuaaguguuuuuuaaaaaauacaucucuaaaguaguauauacacugaguauaaaaugugagacuuuuccauuuaaaguuggaaaaaaauugcaaccucaggucagcuuuguagcugauaaacuaggaaugaggaagauucaguuguugagagggcagaugucaacuaacacaucagcaguaucgagcaaacauauugacauagcuguuggguguuaaguuucacauaagucauauuaucuuauguggugagaggauguuggggacagcugugccaaaaccugauaucaguaguagagccugagguugagaaccagggugguaaagguagaggugugaauguaaauguacaguugucucuggaaugucugcaguugguacuagauguuuuuagguacaucagguuuuuagggcggucaugugagcacucaccauagacugcuuuucucacuggguagacaauaauguaucuagagaauagagcagcacuaccuaaugcccugcuuuuguucugcuauuguauugaaucaguugccuuaugaaauugcacuucaauuuguguacauagauacguccuuaaaaagacacaggguuagauaagaacaccauauuaaaucugugcuguaauguguauuccugaauccuagacucauauauccagcugccuauucagcaucuuuccuggaguguuuaaaaacucaagcucauuucaagcucaguaaugcuaaaacagaacugaucucuccuucaaaucuauuuuuucccaggcucucaucuugguugauggcaaauuucucauuccauugcuugugccaaaagccuuggcccuccuugauucuucuuucucuuaugccccacuucuauuucugagaagauucuuuggcucuaccuucaaaauauaucuguacucugaccacuucucacuauucuuguccaaaccaugaucuacccuugccuuugcccuccguacaaucugcugucaucagaggagcuaauucuucucagaacccucuagugaucaccuguuuuacuuggauuaaaagccagagucccucaaaaacucuacaaggccaucuacaugcucuguauugcacacuucagcuucccuccauauacuuuugacccuugaauaacacaggucugaacugugcgcguccacuuauacgugaguuuucuaccagcucugccaccccugagacagcaagaauaaugccucuucuuccuccucccccuccucagccuacucaaggugaagaugaugaugaugaagaccuuuaugaugagccacuuugacuuaaugaguugguaaauguauuuucucuuccuuaugauuuucuuaauaacauuuucuuuucucuaauguauuacaagaauacaguguauaauacauauacaaauauguguucgacuguuuaugcuauuaguaaggcuuccggucaacaguaggcuaucaguauuuuggggggaguuaaaaguuauacauggauuuucuacugugugggagauuggucccccuaaucuccauguuguucaagggccaaauauaguuuaucucugaacuaaucuguuuuccaccuuuuccauuucauuccagccacucuugccaccuuuuuuuuuuuuccuauaaauaagccucaagccuuuuacuugcuguuugcucugccuggauugcucuccaccuucgcuucuuuucucauguauugccuucucaaugagguccuccaugacugccguaucuaaaauuucaucccuguccauuaucccuccccacagcauuaauuuucuucauaacacuucuaauaugcuucaucaucuuguuuauuauuugucucucucuacucuagaauuuaagcuuccugagggccaguaauuuuauguuuuguucaaagcuguaucuuaguauguacaacagugccugcuacauacauacuaggcacucagguauuuuuauaucaaugaacgaaugaauauuuuugggaacuagggucugggcaaaccuuuauccuacuccuccuaugaauuucuagauucuuugccugcuuccuagcucucuauguuuuucaauaguuggggcucaacccaggagagccaguuuuacuucucacugguugucaggaagacugagguaaguaguggguaugaaagggucuuacaggaaaggguauagaggcuucaguuuaucaccaggcagucuauggacaugaaaagucuaaagucagguuuauguuuaauuucucuaccucccuacuuucacucauggcaauauuuguuuuuucaaaaaaaucauucuauguguuugcuauaacuaucaaaugagauuuuuacuugaaauauuuuauucaguugucauuggaccugcugcuuccuaguuggcguuuaucuuacuuccuaaacaauagcugcaucuuucuuaaguuuaggagcugagauuugguuggggcuguugaagguauagggggaaaaaaaucaaacuuaaguaacaaguucacauugaaacuauguauacacauauauauguauauauauauguuuacacacauauguauauauauauguuuacacacacauauauguauauauauucacguauacacacacacacacacacacacacacauuuuuuuuuuuuuuuugagacaggaucuugcucuguugcccaugcuggagugcaguggugcgaucacagcucacugcagccuugaccuccugggcuuaagcaguccucccaccucagcuucccuaguagcugggcguacagguguauaccaccaugccccgccaauuuuaaaaaugauuuguagagauggggucucucuguguugcccaggcugguuucagacuccuggacucaaguacugggacugcaguugugagccaccaccuggccugaaacuggaauuuuuaugcugaaauacucaguugcccaauagcagugguaugaacagcuuucacuauagggaauaugugaaucaguaaugccucccggugcucugaaguuuuggggugacgugaagugcacaugcagugguguucccuguugaaaaucaaugacuuacggacugaaccagaaucucuucuuuaucaaguagcaggaugaaguggcaucaugaggauuauaauucugaugguuucugagcaaaauuugucccacuuucagaauuuugacaugucuguaaagacuuagaugauuuuuauuguuuuauuuuuuaauuaauuaacuaauuaacuuuuuugaggcaagguggucucacugucucccaggcuagagugcaguggugugugaucuuggcucacuucaaucucugccuccugggcucaagcaauucuccuaccucagccacccagguagaugggacuacagacgugcaccaccacgccuggcuaauuuugcauuuuuuguagagaugagguuuccccuuguugcccaggcuggucucaaacuccuggguucaagcagcccgcccgccucggucucccaaagugcugggauuacaggugugagccacugugccuggucuuacaugauuuuuaaaacauagaacauguauugguaacguuuucuuauauuaguugucugcaaaaauauuguuauauuuaaucuauuauuuucccuuuucucauaacuuaauuguguugagaaucaauguuugaggcaaauccauuuggauucuaauuguauuugggccucuugccagaaauccguauaacgugucauauggugucuguccacucuagagugccaaguguaacucuagaaauaucuaaauauuuccacaguuucuggaugggucuggauaugguggcucaguccuguaaucccagcacugugggagguugagaagaggggaggaucguuucagccuaggacucuaaaaccaaccugggcaacuuggcgagaccucgucucuauaaaaaauaaaaaaaauuagcaggacauggugguguucccaugugguccccaccuaugcaggaggcugggaugggaggaacacuugcgcccaggcugcagcgggccaugauugugucacugcauugcagccugggugacagagcaagaccaugucuuaaaacuugcaugguauuaaauaugucagaagguauuuguccauuugguuuuacuuacacaccuuguuuaaaaaaaaaaauagcaaaguguaggcguauuacauuuuaaaauauucuuuucaauuuguuuugguauugauauuaagaauuacguauauagauggacauuuacaauuugucagagguuuuucucaaguaaauuauuaaauuaguauuacuuuuuucucuggagaaacaaaaccguugcaaaauguaaucuucuauaaugauuuuuuuaaaaaaaguuucuacuguugaaauaugugccugguguaaugaaagggagguuguacaauaauccaaacaaaauuaaauuaacuucugugaaggaaaagucauuuaguuuuugagagauuauauuccuuugaacuggaaugauuuuaaagugauuuauauuaccaagaaaauuaccaugucaaaacggaaaaggaaauccuugcauuggacacuggugauuuugcccauuuaagacaucuuuggggugacuuuuuaacuugagagaaaacucagggcauacaaacgauugugaagaaaaaaauagaagaggcuucuauucucuaguucauuacuccuuagcuuuaaaaauuauuucuuucacaaggauauuuuauugaugacuuaccugaaggcacaaaacauuugguguuuuuaaaaacacaccaucugcuggucgcgguggcucaugccuguaaucccagcacuuugggagagcggggcggucggaucacuugaggucaggaguucaagaccagccuggccaacauggugaaaccucgucucuacugaaaauacaaaaauuagcugggugugguggcgggcaucuguaaucccagcuacuugggaggcugaggcagaagaaucucuuggaccugggaggcggagguugcagugagcugagaucaugccaccgcacuccagcccgggcaacaaagugaaacucugucucaaaauaaauaaauaaauaaaaacaaaaaaauaaaaacaguauugaugaaauaaguuauaauguccaaauuuacauuuuuaacuugcccauugacuuccuuauagguucaucucccucuacccccucuuugggcuuuuugggugauuugcaugaccaauauaaauagaguggcaggcaagauaauguccacaccccaccuccccaugcgugcgucccaguccccaggauuugugaguaugccaccuuacguggcaaaagagauuuuacagaagugauuaaagguugcuuaaauggcaggguuaucugggugggugguguaaucacaagcguccuuguaaaucacagcgggagacaggagagugaagauuauagaugggaccaugagaagagaagcggaggcuugagagaguugcagggcccugaggcaaggaaugccagcagccucuaggagaaaaggcaaggcuuuucuagagccucaugaaggagcacagccuucccaacaccuugauuuuagcucagugagagccuugcugaacuucugaccuccugaauucuaagacagaaaguuuguguuguuuuaagucacuaagguuguaaucauuguuugagcagcaauaagaaauuaauacaaauagcuuuuuuaaaaacaaauaauaucuuuuuuuuuuuggagauggaguuuucgcucuuguugccuaggcuggaguguaauggcguggucuuggcucacugcauccucugccuccugaguucaagugauucuccugccucaaccucucaaguagcuggaauuauaggcgcccgccaacauucccagcuaauuuuuguauuuuuaguagagacggguuucaccauguuggccaggcuagucucgaacuccuaaccucaggugaucuguccaccuuggcuucccaaagugcugggauuacaggcgugagccaccacgcccagcccuaaacaaauaguauuuuuuuaaauuuuauuuugagauggagucuugcucugucacccagccuggagugcaguggcgugaucucggcugacugcaaccucugccucccagguucaaguaauucuccugccucagccucccaaguagcugggauuacaggugcacaccacugugccuggcuaauuuuuuuuuuuuuuuuuuuaaguagagacaggguuucaccauauuggccaggcuggucucaaauuccugaccuugccuccugccuuggccucccaaagugcugggauuacaggcgugagccacuguguccagccaacaaauaauaccuuaauuugacaauuucagaaaaauuuuacuuaauuuucaccaguuccuagaggaggucagagccauuguuaauaaugaaagaaguugagguacagagggacugacuaguaugggaaguagcuguccuuuccaagacacaaaugguaacggguuucuuucugcuggauauguuuggggguuauuacuggagcuuuugaauuauguuugaugccugggaauauuaauguuuucagcccugccuuuuuucaggucagcgaaauaaauaugccuguaugaagcugauugcuguggcccaggguaaucugcuacuugcuaauauuuuacagcauuccaugguuagguuacauuauuuggacuugacguuuugugugcgguguuucuguaguguguguucuguuugcucugcucauguuggccuguuuuuggcuugguauaccaaagguguuuggacaguccuucaguguuuagaacuuuuccuguucuguggauugcuuugcagucaucauuacuucuguguugauagcucaguugcagaucuguguucuaauaugucauuuuuugagaucaacaucugugaguuuagagaggaaacucgugaaguuguucacaguuauggcuacuuuuuaagugcuggguuaugaacucugauuguaugcugaugccaaacuaguguucuacugaaagauacucuucugauuuaguguccuuuuuuuuuuucuuuucucuuucuuuucuuuuuuuucuggagacaggauuuugcucuguugcccaggcuggagugcaguggcguugaucacagcucacugcagccucgaaugcccaggcucaagugauucucccacuuucagccuccugaguagcugguuccagaauagugcaccaccauccccagcuaauuccuguuuuuuuuuuuuuuuuuuuuuuuuuuguagaggcgggguuucaccauguugcccaggcuggucucaaacucauggggucaagugaucagcccgauucagccucccaaagcucugggauuacaggcgugagccacggugccuggccccuuuuuucuuaauacauuguuuuacguaugaauggaggcagaaccaguaaacaggucuugcaucauauuaauaguuuugaacauuuaaaaccaucuaauugcccuuuuauuaaagacaacaacacaaaaaugguuugaguuaaaaaugguacauuaaaaguuuuuuuuuuuuuuuuuuggaaacagggucuugcucuguuguccaggcuggaguguagugguguaaccucagcucacugcaaccucuaccuucuggguucacacaauccuccugccucagcuucccuaguagcugggauuacaggugugugccaccaugcccgucuaauuuuuguauuuuuaguagagaugggguuucaccauguuggccaggcuggucucgaacuccugaccucagguaaucagcccaccuuggccucccagagugcugggauuacaggcgugagucacaguaccuggccccuuuuuacuuaauacauuguuuuacauaugaauggaggcagaaccaguaaacaggucuugcaucuuauuaauaguuuugaacuuuaaaaccgucuaauuggccgggcacgguuucucacgccuguaaucccagcacuuugggaggccgaggugggcagaucacgaggucaggagaucgagaccauccuggcuaacauggugaaaccccaucucuacuaaaaauacaaaaaauuagccgggcgugguggcaggcgcccguagucccagcuacucuggaggccgaggcaggagaauggcgugaacccgggagguggagcuugcagugagccgagauugcgccacugcacuccagccugggccacggagacucugucucaaaaaaacaaacaaaaacgaacaaccaaaacccaccuaauuguccuuuuauuaaagacaaaacaaaaaugguucgaguuaaaaauguuacauuaaaagguuuuuuuuuguuuuuuuuuuguuuguuuuugaaacagggucuuacuguguugcgcaggcuagagugcagugguauaaucucggcucacugcaaccuccaccuccuggguucaagugauccuccugccucagcuucccuaguagcugugauuacaggcaugagcuaccaugccuggacacauuaaaagcuuuuaauaggauccaaaauguacacagacuucuguagcgucuuuuggccugcauccguaaaaggaaagugagugcuagaguacuggcaaugcuuuguaguccuuggcuaacuuugcgugauacucuuaagugugaugcguguguagcuaugaagacugugaucauuucacuccacaaacguuugugauuguggguuuacuuccuguccaagguaguucauauagguaauagaguuauuuuuagcaacaugaaauaaguauuaucuucagguaguuuuuguuuuucaaguuuuuaaggauuuccuguuuugaucuuggaacacuggauauaaaauaacauuuuaugucaugauuuuuaagugaauugugagaauuuccagcaacauaaaauauucucaucuguagggaacacacaugccugugugcacacucacacuuuucaccucuucccuuucuacuauuaaaugaugcuggcccguuugguccgggauuugaaaguacuuccugacaccugugauaaaaagaaagcuuccaggaaugaauguuucuauuaaggcaaaugggcggugauggcagaaauaaagcgccaguauucuucuugguugccuuuaguaugucugagacguaguucucggcuuucagaaaugauugauuacacaggguugccaacuaguaaugugccuuuuuaugcugagaaagggacuaugucgcgugauucuugauuaugugauaacugacauuugaauaugcagcauugauucaguaacggcuuucauuuaaaaaagaaaguacuauauuaaacgaacacauugaaauaugaaauccagauguauccuuuaaauaucaaguauaaaaggauguguuuugacucuagagaauuguugggaucuaaacuaacuuuaaaaaguugcguuaaacuaggcacacgguuuaaaaaaacccaggcagcacagaaaugcaaauauaaagaaaugcaauaguuucuucuucucucuaccuccaguccugcugugcauagacaaccacuauuuucccugucauucuuuuauuuuacuuuuauuuauuuuuauuuuuuugagacggagucuugcucugucgcccaggcuggagugcaguggugcuaucugggcucacugcaaucucugccucccaggcuccagcgauucuugugccucagccucccaaguagcugggacuauaggcaagcucgccaccacgcccagcucauauuuguguuuuuuaguaauggcgggguuucaccauguuggcuaggcuggucucgaacuccugaccucaagugauccaccugccuuggcaucccaaagugcuuggauuacaggcaugaaccaccaugccuggccccugucauuauuuuauaaugagaaauuucaaaaccuguauaaagguuacaaguguaauauauugaacaccacaugccuuugaccuagauuuuccaguucuuugcuguauuuggugucucuguaugucuuucucguguguauucucugaacuguuugagaguuagcugaagacaucaugacacuuuaccccuaaauauuucagcauguguuuccuaagaacaaggacauuuuuuccuacacaaccacacaguauaauuauccaagaaauuuaauacugaaagucuauauuuaguuucaccaauaguuucaguaauugcuguugccccaccuuguucaguuaaggauuauacauuguguguaguuuugucucuucagucuucucuaaucuagaacagcaccuguuuuuuuuuuuuuauuucaugauugacauuuuugaagauuccacuuuugcagaaugaucuucaauuuagauuuguggauuuccuuaugauuagauucaguuuaaacauuuaucuuuuuuagaggagggaggaauacuauauaggugauauuauuugaggcagcaccuccgauaccucugaauaauguccuuguaucauuguuccuuuuuuuugcaauuuauuuugagguaaaauauacguaagauaaaauuuauaccauuuuacucauuaaguguauauuauuagcauuggguacauucuuauuguuguguaaccauuucuaccauucucucuagagcuuuuuuacaucuuggaaaacugaaacucuguauccauuaaauagcuccauucccccuuccuccagccccugacaacugucauucuacuuccugucaaucaauuugacugucguaauaaccucaugaauggaaucauacaguaucuguccuuuugcuuauuucacuuaguauaaugucuuuaagguucaucuguguugugaucugggucagaauuuccuuccuuuuuuuuuuuucgagaggaaguuucgcucuguugcccaggcuggagugcuguggugcaaucugcgcuugcugcacccucugccucccagguucaagggauucuccugcuucagccucccaaguagcugggacuauaggcgugugugccaccaugugugucuaauuuuuguauuuuuaauagagucggggguuucaccauguuggccaggcuggucucgaacuccuggccucaagugauccaccugccucggccucccaaaguguugggauuacaggcgugagccacugcgccuagccagaauuuccuuccuuuuugagacugaauaauauuucauuguauguguauaccacauuuuguuuauccuuuccucaguugaugaaaauauauuauuucuuuuucaccaaauuuagacauuuguacugacuucuuguaacgaucuuugauaguuuaguucauuuuugaauaauaaaggcagacaacuugcgacuagcaugugcaacguagcgggaccucuucucuauuaaaaauaaaaaacuuagcugggugugguggcagggugccuguagucccagguaugugaggcugaggugggaggauugcuugaggcaagaguuugaugcugcagggagcuaugaucagucauugcauucuagucuaagcgacagagcaaggcuccaucucaaagaaaagcagacuauaugcauuguagacuauuucagagauaagaaaagcuaugaaaaaauaaaaauaguuuguaaucucacugccuagaggaagucugucagauuuuuuguguauuuucagucuuuuuuuuugcauuuauuuacuuuuacauaguugagauuauauuguauauccuuuuucauugaacuuuauauuuugaaucaacauguuaccuuuuaaaaaugaauguguaauaugacauugaauugcugcaccuuaaauuaaccuguucuuuauuagcaacaguuugggagucccuguggagcugucuuugcugauguuuguuguuaagaauggcaugcugucucauuuuauuaaucauuuguauuuuuuucugugaguuguugauucaugucuuuuguucacuuucguucacuuucuuuggugauuuuaucaaguuacaugaaaucuauaugaaaaauacacaucuccagucccagucugggcaacauaaaaucauuuuuggccucggccuccccaaauugcugggauuacagcggcgagccuuggcaccuggccucaguuacuuugaaaaauugucuuagcuuuuaccuuuucuuuguucauucauucaugcauucagguacucccugagugugcucccaagcacuuugaaagaagucaugucucucaaagaguuuauagggcaaauagaauuuagcaagccaggauagcucagcagaggaaguacaggguccuagaaggagcauagaaccuaaucucauuaggagauuuggagaggacuuuuggugacaucuaagcugaaacuugaaagagaagaaggaauaguguuucuauuagugagaauuuuauguguuaaaaauccaggguggagagaccaaggcaugucaaauaacccgagagaagucaguugguuggaguguagaaugaggacugugagagagaaccuguagggaauauugggacuauuuaaccugguuaaauagguuaauuccuuaaccugguuaaggaauuuagcuguuaaccugagggcagugguaaacuuuuuuuuuuuuucccccugagaugagaucucacuuugucacccaggcuggguggagugcagugacaugaucacggcucacugcagccucaaccuucuugggcucaagggauccucucaccucagucucccaaguagcugggacuacaggugcaugccagcacgccuggcuuauucuuuaaauuuuuuguggagauuggguuucucccaggcuggucuugaacugcugagcucaagcagucugcccuccuugggcuuccaaagugcucagauuacaggugugagccacugcgcccagccuaguggucaacuuuugaaaagggaaugccguaauuaaauuuguaguuuaagaagaccacacucacccuaguguagagggagcaacacuugagauggcagaccaguagaguaaaugauagcaacuuagguauagccagguauagcugggguagagucaguggagauggggaaagggagauuuauuugaaaaagacugaaguagaauuggcaaaacuuggaagaauugauacugggcugagaugaggaggaguuuagaaagccagauuuuugguuuggacaucuggguuggcuaacaguaucauuuuuccuggacauaggagagggaaaguuuagguuuuuuaagagguuuuguggugaggaugccugauggauuauuggauacauggggucugaaacuuuuggggauggaugcuuguggggcugugagugucuacagaagccaugaacuuucuuuuucaguggcaaauuauaggagcuuucuuguuuaguguuucuaauuggagaccuuaguaagauugacuggguuacuuuugaacauuucuuccaauuugaugauuuucugucuuaauucugucuacuuuugucuagaagaauuaaauguauauaauaugaacaguauaaaguuauaauaaauuaugaaaguuuuuccuuuuauccuuucuuccuugccccugcuucguuuuuuaaacagagacagggucucacucuguuacccagguuggagugcaauggcgugaucauagcucauugcagccucgaauuccugggcucaggugauccucacaaguagcugggacuacaggcaugcgucacuaugccugacuaauuuuaaaaaauuuuuguaaagaugagaucuuaccaucuugcccaggcuggucuugaaauccugggcucuaagcgauucuccugccuuggccucccaaagugcugagauuauaggugugaaccacugcacccagccucccauuuccacuuuuaaaauguucauuuacccucuaguaaaaaaaaggugggcuagacuauucaguuucucucggccuaccugagauauaguguaauuauaaaaaucuaaaauuuaguuucaaauucagccaggguaacuuggcaguguggcaauugaaauuuuuauuuugaagucagaaaaaccuuuggaugugauuucaguggugaaugugguuuuggcauacacuauuuuaugaguuucaaaaucuacuuuuggaaccuaagaguuuuuguuuuguuuuuuguuuuuuuuuuuuagacagaguuucgcucuuuguuguccaggcuggagugcaguggcgcaaucucggcucacugcaaccuccgccaccuggguucaagcgauucuccugccucagccucccgaguagcugagaugacaggcgcacgcccccacgcccggcuaauuuuuuuuuguauuuugaguagagacaggguuucaccauguuggccagacuggucuugaacuccugaccucagguguuccacccaccucggccucccaaagugcuaggauuacaggcgugagccacugagcccagcuggaaccuaagauuuuuaagaaccguaauuuccuuucaguugaauauuuucaguaauguuuuaagugacucaugaugugaacucauguucaucuguuucagcccuguuaacauuuguccccaucucugaucacuugucccaaagauaacuuuguggcauguuuccuuuaaguccugccauguugcuuucagcagcaauucuuccugcuuggcaggaucuucuuucuuacgaaguuaucuguuagguuagguauuuuuucaugacuuuggggacuuauauuuucacaagaguggguuguuaacacucugaucaaagauguaaggagaaaagagcucaguaguauagacuauauuugacauaguuugucacaacuuacagauaauuuagaaagcuuuaauuagugacuauuugacuuccuucucucauugaaucuuuuauuuuucuaaagaggauguuuuaguaauggacagugagauuguugaauagaagcuagucuugauauguuauagauuaaauuuaagaauuuguuuauaauuuugauuuucaucugauuuuuugaauaggcuguuguuuuguagcacuguuacuaggaauagaaauaguggaucuuaacuuguugcuauuauuauguggaaaauacaaccaggagguguuuuggccugcucaaauuauuucugagauuguuccugugcuuuugccuacuugaagguacacuuuaaaaaauauugaagucauuuuauuuaaaaaacagcucauuaguuuugaaagaguuugcugugaauaucuccagguucaggauuaaacuauagccaaaugcuuaugauauaaaaaaguauuacugggugguauaguuuccuuuuaauaugaaaaccgguuaaaugaguuaaacucuggcuagaggaaaaccacaucugcaucuuucucugaccaugguaaaggacauucugaacauuaccacuuaaaacuaacuuuucucuuuaaggguuccugaaauugugccagccgacuccagguccacccugaccccacagcauaaaccaugcugugaugucacagcuaccauagaacuccaggguaguguugggcuggcccaugugggcucagguaaguccuggcuuuuuuuuuaccauuuggcauucuuuucaaaguuaauaaccauuauaauuuuaugucauaaaggaaaauaaggcaaaacuuugaaaacugugccauauaugggggaaaaaauaagucuguuuucuaaauaucuaugagccagcucuaaauucuaaccaguggaguuccauaguagcugugaaguccccagugagucauugaccuguggcuucaaaauacguaaacuguacuccuggcccagcuuacggaauaauauauguuugcuuuuuauuuuuuuuaacgguuuagcuaguaauauauaauauaguggcuuucauucuuaggccuucauguuuuaagaaguguauuaacacuuuaucuguaauuauguuucacuauuaggcuaauugugcauuucauucaauuuugaauguauggugauacuacagauuaguuuuauaaaauuaaucgucccagaguggcuucagcuguccuuuuauuugucuucaugaaggagaaagggacagaaggcauaauacacguuuguuaaauuuucaaaaaaaguacuaagagaaagaugcuuuggcugggcgugguggcucacgccuguaaucccagcacuuugggaggccgagguggguggaucaccugaggucaggaguucgagaucaaccugaucaauauggugaaaccccgucucuacuaaaaauacaaaaauuagcuaggugugguggugugcgccaguagucccagcugcucaggaggcugagacaggagaauugcuugaacucggaagguggagguugcagugagcuaagaucgcgucacugcauuccagccugggugacagagcaagacucugucucaaaaaaaaaaaaaaaaaaaaaaaaugcuucaguuacucuuggaggcauugugagaugucaguaaccuagaaaacauguauauguugauuaucuucucuuggaacuuuucauuuuuuccuggccuuucucccauaaagugagauuuuaacacuugcauuuauuugucuuucccugucuaccaacucuucuaccuuauucuuacguucuuuuuauccccugacauuaaaaggugcucaaaguguaauuaugugaagaacucagauauuguaagguuuuuuuuuuuuguuuguuuuuuuuuuuuuuuuuuuuuuugggcauguauuaugaugcuuuuucccugcacuucacuuuaaguagaaaacaugcgguggcuaaaacuuuaaauuauaugcguaugggccaaauccuguugaaccaaccacgucuacaacaaaaacgugucuaugaaguaaugucuaaacuuucagaaguucucuuugagcagugugcaauaaagacguagcaaaaauugggacaguucagugacauuuucaugaaauuugauuuguaauuuacuaaucuuuguagcugaaaaugugcaauucuuaaugaaaagaaugaaauuacguauuccccaaacacuagauaauaaaauaauuuucuuuuagauauuauuuuuuaccuauauuuaagugauguguguuuuucaugcucugggaaguuuggagaauuucgugcugucaaaaacugagaauagucuguucuccucaucuucuguaugucugccaugcuggggaaugggcaguaugcccguuuguaguuuaaugcagagcauggaguaggagggacuaauuaaguguuuuugauaauuuuguauuaggucaaauagaaauccuaguuguguuuguguauaucggcuuuauugagacauaauuucacauaccaugcauuucaacauuguaaguucugguuauauuuuuaaaaagcacuuaaugaaagcagaauuggugauauuauuguacauuauaguuccaaaguacagucugcugauuuuguugugcuauguagucugcaccccaccccccagugcucauuaacuucuaauuacagaaaucucucagagacauuagagaggaaaucuuaagaauuucuaagaugagauucuucuagacuucagcuauauggugaguuagcuaaaaacaauaaagcgauuugaagaucuccccuucuuccaagcaaaagaaggaaguuauuuggugcuuagcuuuagauuaccucaucucugucuuugagaaauaagaaauaaacaugaacacauauaguacaaaacaccuacauacaugcauacacguauauacacauaaauuguacagaucuuccucuuugcuuuuucagcuaaauugaucagacucuuggguuguuuuuggaaguguuuggaacauuuuuuauguaauacgaaaaaauuuguaaguagauaauauuuuuagauuagaacuaaagacuauaaaaggugccuugaugcuauguauaccugagaauagucaagggcuuugauaggucugaagggaaaggucguugccuucauacagaaaugcuaugaagugaaaggagauggugugggcauggucaguccuaaauaaaauaaaacugcauugaauuaucuuaaaaguuaugggcccuaccagacuauacuuaauuguucauuaaauaauuuaagcagaaguuucagaguucuuucuguauuugaacauaauaauuggaaacagaaaacucuucgaucauagaguuguuuuuaguucaaguagcacuuucuggucuauuugaaaggcuugccccuuugggaagauuuauagccuuuaucucaugccauccuugauuaagcuuuagcuuugacuucucuaggguacacuguuccucagaaggauguguaagguggguggagguggggcauuuguagcugaacuuguauaugcauggugaggaauuuaucaagcuacauugcugugaaaauaagaauuccuguaagaaggcauucuuaauauaauggguuuucaaccugaagaauguauaugucuguguucggggcagggggucauuuuuuugaggagaggaucgaaauuugcagaaaggacuguuuugaauauuggagucauguuuucacugucuuuguacuucucauauugccuggcaaggcguuccuguauaugaugaggauucaguaaaugugggaauuauuuugaagccuuguuaucuuuacuaaugguagaaaauuguugcauuuuaucaaucuguuauauucuaaggaauaugucugaucuaauuccuaguucaagauggcaauuaaaauacucuuuuaaaaguacacuaagaauauuuuuuuaccuaguauuaguguucuguccagcaaacacauuugucuugauguaauuuaggaaacacuuaaaaguauuuggucccauaaauaauuuuuuaaaaauuguuuuaaacacuuuuugugguaaauuggaagcuaaucuacuguuucuuugcccaggcugauacccauacuuuaccagacugcuuaguagacaguauuacuguguuuaccuaacauuaauuuguguuaagauuaauaaaaugguucagugguaauggaauguucuuuauagauuuggcagaagugauauuucuguuuccccccuacucuaacuggauuguaauguuuuauuuuagcguauuuuauaugaaaucaucugguccaauuuuuacguuauuaauaauucuuaauggauauaaggaagacuuggcuaugagaaucugaaaucaaaauguugccaacguuuacuuacacugaagaugguuucaguugcucuaaguuguuucaaagcuaaagagcaguauggaaagcucagcauuuguuuugauucugcuuuaagaaugcaguguaaagggcaggaggagcucaacaccagcuggaagcacaucccugucuccuugguuucugcagagucaggaugaacgcaggaccggaaccaggggcucagugucucuuguuacgucugguuucucauacuagauuauugaucuucgauccaauucaugcagccuaauaguuccucuaaaucucaccagagccuggagccugcacugaugguaagguaaaugucuaggcaguucuaguucuggaaggaaaauuuuuaaagggaaaggaaaaaacuuauuuuccuuacucuuauaggacauuuaaaugaugcaucaggauccaggaagcacagagaaacacuuaaaagauuuuggagugauugcuacgguuuguguuuuuugaagaaaaugagaauuaaaugcuuuucuaucuugaugcuuguuuuagggguuguagaaggugauuuagcugccauagaagcauacaagucaucaggaggagacauugcacgucagcucaccgcagaugaaguacgcuugcugaaucguccuucugccuuugauguuggcuauacucuuguacacuuggcuauacguuuucagaggcaggauaugcuagcaauauugcuuacagagguaaguuuggcguuuugguuaaauguucuuuuauauuaaagaaaccuguucuuuaguuuucauuuuugauuuuauaauguuucucuaagcagcuuuaaaauguuuugaauucuuuuacccccuuuuaaaaauaacauuaaacuuaagagacuuaauuuuuaaggguauaugcuuucaaauauuugaauagucacaacaauguuugacucaucauguuugguucauacaaaccugggauguaucugucauucuuuagucauucaauuaacagauauuuauugugcauuuacugugugccaugcacuaggcugagaagggauacaauuguaaagauacuggcucuuucuucauuaaaucuccagcaaaguagagaaaugaacagguaauucugugcagccugugcccugguagauguaaaugccaaguguuaugccaguacuugaagaguuuugaggugucuugucgucuuucuuauagcagguaauguuuuugcugcaauuugaagagaaagaguuaggaguuagccacaugaaguggauaagggagagaagggaaguugaggaaagcauuuuuacagggggcagagaugguggaauuuguggugaaucuagggacuugcagguaacuaagcauggcugagauggugauugggaauggagagaagggaagucugaaagauaagcagaggcuggauuacgaaggaucuucugugucaaggaauuugaagauuaucccuaggcacuggaugguguuagguaugggcgcaggggagugagcagagcagauuguguuuuggcugcugcacacuggagaggggugagccugguuaggagggaguugcagaggugcuggcaagaacuucugccagaagggcagaaggguagccauagaaggguacccagaaggguagccuuagaaaugggaagaggguuagaggguuggagagacugagacaggcccucagucugaagaaguagacugauuggauaugggaagauacaguguggauguaaguugauucuucaguuucuggcuuacauaacuagguacaugcuaccaaugauagagauuguguaugaauuauucagaaugugacuacauuauccagguuuuuuuuuucuuucuuuuuuuuuuuaagcuggagucucacucuguugcccaggcuguaguauaguggcacgaucuuggcuuacugcagccucugccuccuggguucaagcgagucuccuuugucagccuccuaaguaacugggauuguaggcacaugccaccaugccuggcuaauuuuguauuuuuagaaaggugggguuucaccauguuggcuaggcuggucuugaacuccugaccucaagugaucugcccgccucggccccccaaagugcugggauuauaggcaugagccaccgugucuggccaagguaacauuuuuuaaugguaagagaaauagaguaaaagugcagagagucauauuaauuguggauucaaauuuugucaguauacaucuuucauauauacuuuugcauauuuguuuauucaaauuugccaauauuugggaaccacugcagggcacuguauggggauuaaaaaauuugaagguuagauggaaacaugauuguaguagcuaaccccuguguccaguuugguaagauuccagugaagccgggguggggggcuugagagacugaaggccaugaugaaaacaaaagggcaggcuuauugaguauaagggagaagggaacuuuucagauagagggauccagguuuuggaacaugagauagaagaauuggaguuuuucuagugucgaaggccuggcugcauuuguguuguggugccuaguuguguugucuauuguauauuggaagggcugucaauguggaguuguaguugcugguggugacaggagccaggauaaagaaggugguugugaacuagggugaaagucuuaaggggcuccccuaaagguagguagaagauuauuacaagguuuuagaggggccauugugagucauugagcuccugagacagucugaggaguaacagugggaugaugaucgaacaucaguauauuuauugcaguaucacagauugucuggaaacuuagcagcuaagacaacaaauguauguuaucucacagaguuugugaggguuagaauccaggagcugcuuagcugaauaguuuuggcucaugaugucaugagguugcagucaagugguccagggcuguaguugucaaaagacucaacuggggcuagaguaucuguuccuaagcccacucagguggcuuuuggcaggaggcuucaauacugugccaugcaggccugucuacagggaugcucaugauacagcagcugguuuuacccccaacaagugauccaagagaggcacagaguacaagagagugauccagugucuuugaaaccugcagugucuuuuauaaauugauuuaggaagcaacauaccauuacuuuugcuguauuccgugggacguguagaacaacccuggaacagcgugggagagguggaggggauuuguuccaggcaaagagcaaaauuggucauggauucagucuccauggaguaaauacuccaaaggacagaauuaaaggggccaguagggagacuggaagugggggagucuggacuaagucuagacuaaggggguguguugcagagaaugcucagccaaguucuuuuggaaugagaacaggagaacauuagaguuggggauauguauguggggcaggaauuuucaucgguuucugugucauggaccauguugguaguuucaugaaacuuauggacuccuucccagaauacuguuuuuaaauacaaaaaauaagaaguaaaugagauuacaaaggaaaucaguuguauugaaguaauagcuaccaaaauacuaaacuaaauuugugauauauaagaaaauacauuuuaauauagguaaaaaguuggggauaauugauuuaacuugaauuaaaaccaaauucccauuaaaguacauggaccauucccaagaucauggacccuaaguuaagaacucccagccuacggagaugguugagaaccauaagguugaaggaggugagaaggugaguggcaggcuucaggggcacauccugcuuaaggauggugguggaagggguuguuugggggcuaaguuucuuuuagaauguuugugguagucaggguccaguccaggugguuuuuggaaaggucuuuccagguuuuuggaaagggccugagagcuagcugaugggaauaagcuauuuuugaauuuacuuugggggagccauuuuaacuauguuacuugagaaauagucaauuauauucugaaaauauuuaauauuugguuuuccauguuugaguguugacuaaugguugggcucauggaguuaagauauagugagaauuuucaugguuaaugguaaucuuggccaauaaagucuaguugaacugaauuuccacguaggaguuuuuaaauuuuuuauuuuuuucuuuucuuuugagacagacuuucucucuguugcccaggggagugaucauggcucacugcagccuugaccucccuggcucaagugauccucucaccuuucagccuccccaguagcugggacuacuggugcaugccacuaaugccuagcuaauauuuugggguuuuuuguagaggcagaguuucauuauguugcccaggcuggucuugaauuccugagcucaaaugauccuccugccuuggccucacacagugcugggauuacaggugugagccacugcaccaagcugcaguuucagaauagggagucagguaacugugcuggguaugcaggguuuuugaaauauuauuucuuuaauagcaauagcaguuaguugucugcauauaugauguagauaacauuaucauuaaaccuuacucuuugagaagaagaagaaggggcuggaagaccuguugcuucacaccccacuguggcuggaaggcuaccuuugggauaaucguccagguuggugacaucagggaacaggcucacuguggguucccacgguauucucuuugggguuuuuuuuuuuuuuuuuuuuuuuuggcagagucucucucugucacccuggcuggagugcaguggcgcguucucagcucauuucaacuuccuccucccggguucaagugauucucaugccucagccuuccaaauagcugagacuacagcuaauuuuuguaguaguauuuuuaguagagacaggguuucaucauguuggccaggcuggucucaaacugcugagccgaagcaauccacccgccucggccucccagaguuggugggaucacaggcgugagccauugugccuggccuugaauucuguuuguuacucgcagaugcucaacugugauuuuagaauucuguguauguauuuuuauuuagcuccacaaacuagauaugacugaaaugugagguuaaauuaaaucuuugcaacauuuguugcuauuuagcauuuuaaaaagaauaaaaaaauaacaaaagaaaguucuagccuucuuugguuuguuguuuucuugcuuagaggccugugcaguagugcucccaucucacuccugucaggcugagcuucagagguuggcagucuguguuuaaacuugcagaugccaaaugcuuuuuuaaaaacucaagagugguaacaaauggagaggaagaaagggcuugaggucagugggaacuaacccuuuaaauaccgugcuuuuuuuaaguccaaguuaggguacuugaaacuuguggugugggagaagaguauuugcaguuucccuuuaucagcugugauucucugcuucuaaagaauguuuuuauugugugcacgaugguuagucuacugagguuuucuguccucucuccucuuccugugaugugucuaugaacaacacccuuuuccauacauuuuuaugugcaucuuugaguauuuccuugugauaaauucuuaaagagaauuacugaaucagaggauaaaacauuuuugugacuguuacugaaaacuuauucugguauauacuuucauugguaaggaaauaauaccaguguauuuuaagauuaaagaaaaccuugaguuauugggaaauuuugcugauuucuuuuaaauacuguuguuuucugcuuccacuuaugauacaugagaugagaggaagguuucuuuuguauuuaaggugucucaacaagcagcaaaguguauuccagcaaugguguguccugaacugacagaacaaauccggagagagauagcugccucucuucaucagagaaagggggauuuugcuugcuauuuucugacugaccuuguaacauuuacauugccagcagguaacuccaaaaucuaacguaaaaagacuuuuuuauuuuauuauaguuacauuuguguauguaggugaaaaauguuucuguuagaaagcacauaacauagcuacuguaugugcaucuuaaauuacuugacugucuuauauaugcuggaagugagcauacagaggauuacuuguuaggaaaugcgucugcuaucugagaggaagacagcaguugauaguaacggauuucuuuguggaccucagauuauuuuuuaaaaaucuguuguacucuuuuauuuuucucuuugguuuuauuuuagaauauccuuuaaaaaaaucuccuuugaaaaauuuucccuuuucaugcuuguguguuauuugaaauuagauagcuauauugguuaccugguauuaagagaugggauuagaacaugagcuuuugauggguagagucagguuauuugaauugaacacacugcauccucuugaauaugucauuccuuuuuuacucauuuauuucuacuauguuugugaaggaacuuuucauuuuucaauucauugacaguugaaaacauccuccagaaugcguuuugucaguuggcauugaauaaauacaccaaacaccaaacguuucuaaaaucuuucaucugagauucugagaucuguuuguuuuguugcuguuuuuuuuuuuuuuagauugaaacggggucuugcucuguugcccaggcuagagugcaaugggcgugaucauagcuuacugcgccuucaacuucugggcucaagugaucuccugccuugaccuccugaguagcuaggacuauaggcacaugccacccaccccuggcuaauuuuuaauuuuuuuguagagauggagucucgcaguauuacucaggcuagaucucaguguuuuuaauuuuuauguucagacaaacggauuuuuacaaauuguaggagauaguaacuaaguuuucugaaacuggaggaaguuucauuugaaaugcacuuguucugaguauuuaagcuuaccccagaaugauuagauuuuuaaaaauuuauuuuuuauuuuuauuuuuugagacagggucuuacucuaucgccuaggcuggagugcgguggcaggaucacggcucauugcagccuuggccuccccaggcucaaacaguucucucaccguagccuccugaguagcugggacacaggugucugcugccuugucugauuaauuuuuguauauuuuuuguauagagacaggguuuugccguguugcccaggcugggcucagaauccugaguucaagcaguaugcuggccucagccucccaaagugcuggaauuauaggcgugagccauugcacccggcccagaaaagaaauauuuuauaucacacauguuacacugguauauuaagaaaaagcuaucugauaaccuucaauggaaagggaguuauuuuagagaaaguuacuaguagguaauuaauaaguguaauuaaguauaaguuaaguguaaguuaugaaacaaaagaucuuuuaaguuugcauuuucuuuguagauauugaagauuugcccccaacaguccaagaaaaauuauuugaugaggugcuugauagagacguucaaaaagguaagcauggaauuaaugaguauaauuuaccuuucaucugaucaaguaaguuuuguuuaguaaggcaugguguaguuugguguguagucaacuugcuuuauuuuuauuuuaaauuaaagacguaaaguccugaaguucaguguuauauuguaugguucacuguuacagagugaacaaauaaagauacaaaaauuuuaaaaccuugguucuccgcuuccuguuccagaauguauauauuucuauaugaaacacuuuuuagaaaauaaaacuguaaagaauuuaaaaguuuauuaaauuauucuagagacagaagauguuucaaguacucaaaaguuuauauuucaauuggucaauuuuauuuagguguuuauugguaaauuacauauaaaccauuuuauagcuagaaaauagguucuucuccccaugaguauucucuaaugacauagguauggaaaugaacauguauuuaaauccaucguacagaauuagaagaagaaucuccaauuauuaacugguccuuggaauuggcuacacguuuggacagucgacuguaugcacuuuggaaccggacugcaggagacugccuacuugauucaguucuacaagcuaccuggggcaucuaugacaaggacucagugcuucggaaagcccugcaugacagccugcaugacuguucacauuggugagcuggcauucugcccuguuucaacccaggagugcauuugcuggauuauuuccuuguaguggugggauacuuuuuaugucaguuauauuuucuauggaaacuggaggaaaaacaguucauuuuggacauuaaaauacuuugaacacguccaugguuucuguuuuuguuuuucccccaagaaaugagauaaaagcaagaaucaaugguuuuuauacauuuuuuugcuaaauuuuaaaauagaaacauuugaagcuuuaaaaugcaagcauuuauuguuucuauaagacacaggcaguauauuugaacauuucaaaugcagcauuucaaguuauauauaguagccuuaaauauugauaaggccguugcucaucuuuuuagggauugauugacugauugauugauugauccaucgauggaagcagggucuggcucaauugcugugcuggagugcaguggugcagucuuggcccacugcauccuccaccuccugggcucaagccauccauccaccucagccuccugaguagcuagaacuacaggugcucaucaccaugccuggcuguuuuauguauuuuugguagagauggaguuuugccaucuuucccaggguggcuuugauaauccugaucucaagcgauccgccugccuggggcccccaaagugcuuggaugacaggccugagcugccgcacccagccuuauugaauauuuguguucacauaagagguuaucuugacauuguguuacaaguuuuuuuccuuccugagggagucuuaagaucacauuuuuuauuuugcaaauuuucaaacccauggaauaauuuuaaaaaaauucagugcaauagauccugguauuuucuucauucaguugagcaguuauuaacauuuugccacaccugcuccaugucuccauacagaaagacucgugggucaauucguuguagacaucaugaugcuuuacccuucaaaauaucaacauacaucuuuccagaauaagaauauuguccuacucacccacauccccauuccuacaucuaaguaauucaacauugauucuguuaucuaacaguucauaaucacauuucuucaauuguaucaaaguguucuuuauauauauauuuuuuaacagcaugcaaucacuggaaaaauaauuguuuuugugaaugaauaguucagucuuuacauuuguuugacuuaugugguauuuuuuugguucuuugaacauuaucucauuuaguuauuacaggcaugagccaccgugcccggccuauaaauuacuuucuugagagcuaaauuguagaucaaagcauaaugcaguauggcugggguuuguggcucaugccugcaauccuauugcuuugggaggcugaggcaggcagaucauuugaggccaggaguucaagaccagccuggccaacuuguugaaacccugucucuacuaaaaauacaaaaauuagccaggugugguggugcaugccuauaaucccagcuauucaggaagcugaggcacgagaauugcuuaaauccaggaggaagaggagguugcagcgagccaagaucgugccacagcacuccagccugggugacagagugagacugucuuguggggagcggagggggaagcauaacguaauagaguaacaauuugugggcacauuagagaaauaaaauaacuuccuggaugaccugacuggauguauaauaaagcuaaagaaugaaugugucacuccgguaguuuuagucaauuaguaauuguccuggagagagggcucuuuugugccucuuaguggagauggcugucugguaguaugaaguagguucaucgggcuggguaagccugaugcuggucagugcucugccggucuggcccucuugaucagauccuguggucaccaagcagcuuccuguugcugauuuucuuagcuuccuacugcugauuuucuugaccacugcuaugggccugucuaugucaagaggaugaaccugguuugguuccuaagacaguggguucuuggcauugugguuucacaggucugccuuguaguuuugguuaaugucacucugcccuguaagauggaaagccagguuugaacugugguaaaucuaccacuuugcagguucucucuaaaaaggcagccaguaaucuuuucuuuggugguaauuuccuuuuuuuuuuuuuuuuuuuuuuuugaggcagagucuuacucugucgcccaggcuggagugcaguggcaugaucucggcucacugcaaccucugccucccggguucaagcaauucucgugccucagccuucgaaguagcugggauuacagguggcgccaccauaccuggcuaauuuuuuguauuuuuaguagagaugggguuucaccauguugcccaggcuggucucgaacuccugagcucaggcaguccgcccaccucgaccucccaaagugcuaggauuacaggcgugagccaccgcgccuggccuuuucuuuggugguaauuuccugaucuguugaaaggccaaaaguacacuguggauuuuagaagugaugucuuuuuuuuagugaugaggguuuuugguggugguguuuguuuuuugagaaagggucuugcucugucacccaggcugaaaugcaggggcacgaucuuggcucacugcauccuucacuuucuugggcucaggugauccucccaccucagcuuccuaugaguggcugggacuguaggagugugccaccacacguggcuaauuuuaaaauuuuucuguagagaugagguccucacuguauugcccaggcuggucuugaacucccggacucgaguguuucuucugccuuagccucccaaagugcugagauuacaggcaugagcuacuacugcaccuggccuuuuuuuuuuuuuuuuucuuuuuuuaaaaagacauuuguggugaguaagaauugcuuugggguuuaugcccaccuguuccucagagcuggcuauggaugaucuuaugagugaguugucacuaauguuuguaucgggacuggaauucucagaugguugcaagucauuugaggucccagaaguccagcauagagauagggagauugugggcagaucucuugagccuaggaguucaagacaagccuuggcaacauagugaaacccugucuccaccaaaaaauacaaaauuuagccaggcgugguagugugugccuguaguuccagcuaccugggaggcugagguggaaggauuguuugagccuggaagguugaggcugcacugagccaagaucaugccacugcacuccagccuaggugacagagugagacccugcuaagaaaaaaaaaaaaaaaaaaaaaaaaagaugguuugguggagaaauacagucugauguuguaaauaggcuagauagggaguggcuacuagggugagaaggaacuaggcuguuuguuuacagccacuggcaagaguuguugcagcagaacuuuuaguccauaguccugacucuuaaaggaugcuucaggagugagcaccuagggcuggcauauggacaggugucccagaacagcaugguuuggcaucaccuccuccagucccugccaccggggagcuuugcccgaugguuuacaguucaggcauaggaagcugcauugauuacagugaucacacagacauccuuacaguauugggggguggguuggggugaaaauuagugguuagauaguaaguguuguugccauggauucgggagaucagauauacuagcccuaaggaauaacccauacauaguucuuguguugaguugcauuagguuuguccacugggccugucaugugaccaguagagaguagagugagcagccguggguuuucuaggccaggagaggaggagccagcauguagcuuguguagucuccuuuuaaagaugcucuuugcugaggugccuuuugcacuuaauugaaaucagcuggagugagauguuuucuuaagucauauaagauacauaguaagaacugagaaagcaauuuucuuuuauuugaaccccuccacccgucacuucaagauaggcuauuuguguuuguagcuagcugugcuguucucuuggauacccgugauuuuagcugacucagguucucaagucugaauauauuguacuugccuuucagugacaugccaacccaauuucccacggggcagguggaggcguuuaauguuaauuggggaaaaaaaucaauauaagucuuuuagaauuauuccuuuuuuucuuuuuggagacagggucuuggucuguugccuggacuggagugcaguggugcgaucuuggcucacuguaaccuuauaccuugugggcucaagcaauucucccaccucagccucccaaguagcugggacuacaggcacaugccaacauucccagcuaauuuuuuuuuuuuuuuuuuuuuuguauuuuuuuguagagacgggguuucgcuauguugcccaggcuggucucagacucccaccucggccuccuaaagugacuguuuuuguuaugaagaauuaucggccgggccuggugguucaggccaauaauuccagcgccuugggaagcugaggcuggaggauugcuugagcucaggaguucaagaccagccugggcaacauaaugagacccugucugaaaacaaagaaaaacacaaugagauacuacuucacaugcacauaaauggccauaaccaaaaagacaaaugauaacaguguuguugagaauuugaagaaauuggaaucuucauacauugcugauagcaacgaaaaauguucuaggucuugaacuccugggcucaggugaucuucuagccucagccucccaguuagcugggauugcaggcacaugggcuccuugugauuuugauuugcauuucccuauuuaaugaugauacugagugucuuuucaugugcuuauugcucauuccuauagcgucuuugguuuaauaucuuuccacgucuuuugcucauuuuuaaauggauugucuuaauauugauuugcagauguuguuuguaucaggucccuuauuggauaucugcuuugcagauauuuuuuucuauucuguggcuugucuuuucacuucauuagcagugucuuuugaaaucacgagucuuuaauuugaucaaguucaguuuaucaauguuuuucuguuauugcucaugcuuuugcuguuguaucugaagagauuuuugucuagcccaaggucacgaagauuuacuccuguguuuucauagaagaauuuuauaguuuuaacuuuuacauuuaggucauuuuuguuuuacauuuugaggucauuuuuguuuaaagugugagauguccuaaauucaccuuuuugcauguggauacccaguuguuucgguaccuuuaauugaaaaaaacccuuucuacauucuauugccuuggcaauuuugucgaaaauuaguugaccauaaaaguaaggguuuguuucuggacucuuaauauuuuucuauugauuuauuuuuccacugggcuaucguuaugucauuaccagacugucuggaugaucauaucuuuguaauacauuuugaaaucuggacuguaagucauuugacuuuguauuucuuuuucaacauuguuuugacuauuuugaguccuuuggauuuccauauacauuuuaggauacagcuuuaucgauuuuuguaaaaaagacagcugggauuaugauugggauugcauugaaucuguagauuuaauuggggugauggugguauugccagcuugacaauauugagccuuccaauccaugaacauggaauugaguuuugaauguuaaaccaaacugguauuccuguaccauuuggucauauauugcuggauuugguuugcuugucuguucuuauggagacucugguaguaucagaguuuaggucuugggguggugaggaugaacauuuuaacauguuuaguuuuaaaguauauuucauugaaccucccuucuucaguggucuuugaagaguuuugagugcaaucaccauugaauuucuggcuggcuuagcugucuuauuuauaaaguuauuuuaggcaccaagaaauuucuaacugcauauaacuuucaguauugacaauuucucugauauuucuccuugaacuuuucaaaacaauguauuucaucacuguugccaaaauuuucaagacacauuuaucuuagcgauuauaaaagaauauacauauuuuaauuuuaaaacauuuggaauuaugauuaaacauccucaguuacguggaguaugaaaaauguuuuaaacugaguuaaaccucuggaacauuauauuuuaauuucuuuaggaaauauauuuacucucuaaggagcccuucauuaaauuacuguaaaguuacuugugacaccacccauuuaacuuuuuuuuuccccccgcaauauagccggggucucacuauguuggccagguuguuuugaauucuggaccucaggcaauccuccuccuucagcuucccaaagugcuagaauuacaggugugaguuaccacacguguucacguuuaacuuuaauaugcugaaacuuuuuaacaacaggaacagauuggucuuuuguuucuuuuaccuagaauucagauguauagaagauaaaugugauguuauaaacagauuaaaugucugucugcauuuuagaggucuuaguuggcuuguuuuuauaagacagugaaccauaauuuugagcauaauuauuucugaauuuuuauauuugauagacaaagaaucgauguguuuucaguaauucaguguuaagcauaaagaaggaauguuuucugucauugcaguggguuucuuuuugguugcuuuugaauuauuaggugaucaucagagaaauuauuuauggaaagaaaucucagggagaugaucuugauacuaugaacacacggaauauuucccaccuguuguuuauacaagugaucaaguaggugguguacuauacauugauagagaaauguagugucuuuguauacaacauuucagaugacuuuuuuuuuuuuuuuuuguaaacuaauuguggacaguggaaaauaaccagucucaucauuagcguuugaaguuugaaaauuugguugucgguaaaucaaauucugacuaaagauguuaaaggauguuacaagguaucugcuaguggaagagggaggcauuuuucauuagaaaaauacauuaccaaccagacaaaauaaaauuauuaauuguuucacagacugcuuaaagacugcauuaaauaaaaaugaucagaacuuuaaauguuuuauuuauagaagacuauuuauuuauuuuuuuacuauccugcuuuuuuagguuuuacacacgcuggaaagauugggaaucaugguauucucagagcuuugguuuacauuuuuccuugagagaagaacaguggcaagaagacugggcauuuauacucucucuugcuagucaggugaggaugcuucaagucuuguugcuucuaugagaaaaguaagcauguagucuaaacugguuuauuugagcaaaccauguugggggcaauguggucaaagaaaagaaugcuugacgugguaucaucagucaacuuggguucuagugaugacugcuguguaucaaauaaauagcaucgcaaguauagaugagcaucgcaaguauagauuagcaucgcaaguccucacugcagagcaggaagaguaacguguuuuuauaucgaaugauuaaaaacaucaaaaagugaaagcugugcuaugacgguuacauacaguagauagucuugggauugcucuccguuccugcagcauaggcuugaugccuaugguaccuauccaggugagcucuguucugucucuggggacacuuaagauuacugguguagguacuugcauugcuguugcugaucugucaggcccugaggaaccaguugucaaucuucauaaugcucccuguggugaggcaauaccugugucauguaggcaaaggaaaaggguaguuuagcuuacucugaacuaauuaccaucaauaggaaugauuucugauuaaugugggaaugaaguuuugcaaguuugcuaacgucuuuuuauuaaugaaggcugcuugugacacagaacuguguaggguugucccuuagacucuugguuucaugcuuuauuuugugaagcacuucaguauaccaaacuguaaaguacaaauauauauacaacuacuccuuuuuuuuugcagaaagcaccaugguucauuugaacuuagagaaggagguacccgaucuuugggcaauuugggcaggauucauagugguugauuuacaugagacauguaucucacaccaugcauuguagcucgaugauggacccauuuaauauuaguauucacgaguuaguugauacugccauuuacauuugcaugaaacaggcucacuuauuuauuucaggaggacuuuguuguagguagugcuuucacaguaacuuaacgagaaugugauaauaaagcauccuuaguuaucugaaucucugguuccugagguuggagaguuaguagugagggauauuucaaaguauguaugcacaucuguauaauuugugaguuuggaugguaaaugauauuugcauguagccuuuauagauuucuuuuacaguuuuacuggauuuauuauuugaggaaucaaaugcugcuuugacaaucuuuucuuucuuaaaaaccaacugcgauaguauacugaaggggagguaguauuguuuuuuacacaucaguuuuccaggagugguaauaaauguuuuaaguuuuuguuuuguuucguacagccuggagcaagcuuggagcagacgcacauuuuuguacuggcacauauucuuagacgaccaauuauaguuuauggaguaaaauauuacaagaguuuccggggagaaacuuuaggauauacucgguuucaagguaagccauuauucaggaacguuuuacaaguuucuuugaacggaauggcucagaugucaggaaggagcaguggacaggggaaugugaacaagggcagugagggaguggcucuuucuuccugugacuguugggauuuucuucccucucuuuccagguguuuaucugccuuuguugugggaacagaguuuuuguuggaaaaguccgauugcucuggguuauacgaggggccacuucucugcuuugguugccauggaaaaugauggcuauggcaaccgaggugcuggugcuaaucucaauaccgaugaugaugucaccaucacauuuuugccucugguugacagugaaaggaagcuacuccaugugcacuuccuuucugcucaggagguaagcaguuucuccuaugaacuauuucuaguagugaccuuguaccagaaacagccugaagugccuuucaggugugguuuuaucugcacuaucacuuaauuucugaaugugaugguaguaauugcugaagguacuagcuauacuuugaaauuuaccuuuucaaaacugcuguauggggacacaucaaggaacuuaagguggugauggguuuuaagaagaaaaaguaaagaugagguuugugauuuaaauauggcauuuuagggaaugagaagugaguuuuuaucugaaagcagaguuccaagaauugcaaggccagugugguuuaagaggggaagcaacagggaaagagagaggguaggcggcagggggagggaggaagggagaagaggucagagaggauagggaugggggggaguucauugaaggcuuuuuaaagcuuuggguuuuacucuggauaacgugguaaaccaauggccaguuuacccagaagaggaacauuuggggucuggugcauggcaggagcaggaacaccagguauuguagaugaaggggagugaaagggugcuguagaccagacaggggagguggugagaagguacaaaaacaacgcucuuucagaaagccaguauucuuauaaaaguauuggucuuuuauuuaauauacuaguaauuauaaaacguuuauaaucacaacaugaagaaaaaaaguucauagaccguaacuuguauaauuucagcuuguacauaauugacuaaguaaacuuaccuugucauguguuugaagcuguggcuugccaggaucaguuuauuaggacauuuguuuuuuauuuuaucuaacaaauuacccucuagugugcuccucuuuaguuuuuuucugagaaauuucccauuuaugucuuuuuaaauuuaaccagagcaaacuggacuuuaaucacaaaacuuccaagaggucaaaaccaugugaaaaguugauugcuuuggccuuuucaugaguuagcauaccagcuguagguuuccaugucacauuccuaccaagucucugaucuguuguaugauuuucccuuugucuucauauuccuccaaaagcuagguaaugaggaacagcaagaaaaacugcucagggaguggcuggacugcugugugacggaggggggaguucugguugccaugcagaagaguucucggcggcgaaaucacccccuggucacucagaugguagaaaaauggcuugaccgcuaccgacagauccggccguguacaucccugucugauggagaggaagaugaggaugaugaagaugaaugaaaaaaaaaaucaaacagcagaagaccaaggcaucagaucuguaaugacccuaaaguuaguguggugcuccaagcagagucgacaucauggaaugaaccaaaucuggcaggaucugcucggggaaguguuuuccuggaccacacacaccuuauggagauaaugccucugcugcgugaggagacagagaacuuuaguuggacuacaguuuguaaaaaaaa

SEQ ID NO: 15441 - RNA, 176779 nt, Homo sapiens
cauauuccuccaaaagcuagguaaugaggaacagcaagaaaaacugcucagggaguggcuggacugcugugugacggaggggggaguucugguugccaugcagaagaguucucggcggcgaaaucacccccuggucacucagaugguagaaaaauggcuugaccgcuaccgacagauccggccguguacaucccugucugauggagaggaagaugaggaugaugaagaugaaugaaaaaaaaaaucaaacagcagaagaccaaggcaucagaucuguaaugacccuaaaguuaguguggugcuccaagcagagucgacaucauggaaugaaccaaaucuggcaggaucugcucggggaaguguuuuccuggaccacacacaccuuauggagauaaugccucugcugcgugaggagacagagaacuuuaguuggacuacaguuuguaaaaaaaacuaauuuuauuaagacagaacuuuuuuuccuuccaaauuguaaaucugucuauaaauguaacgcaugugguuguguaagacauuguuuaauaggaaaaguuguaccagcaucuucauauuauugagaaaauuuuuuccagcaugggcacuuagaaaaagcacauggcaaauggcucuuuguuccuuucagauauuauuucaguagaaccuggcauucuacuuucaccuuaaaagauccaucuaagucucagaucuggaaacguuuuguaccgauuauccacagcaaaacaaaaauaagcuuuuauuuuauuaauaauuucguuccucuugugcccaaucaaaucuuuuaggaacaaacugcaagaaaagcuaagaauguuuuagagugaacuaaauacagacauugcuuacuuguuuugaagaggguuuugguuuugguuauugugucuuuaaguuuucugauaugcccccuuucaauauuuagauauuuauuuguugggaagaauaccuuaaaaugaggguucuuauuccagauucugggcaguggucugugaguaguuuuuuuccuggaugaaaagggagcaagcccacuugucacuaaaugaauugugugaaaugugcucacuuggacuccaucaacaaugugcugcucccagauugccaugccagagggucuucggauucuuccuucuaucaccucugcucuaagcaaaucuuguuagaagggcaugccuuugcuuaggcagauugggaauaccaauucacuacagaauaaagauuuuaaaaaugcaauaagguggcaaaugcauuguaugaagaauuucucaguguuuagucugagaauuuuugcauguugguuaauuguggccauucuuuaauuuaaaguuaaaacuauaaucuuagguagaaaaacuuuuuuauaagaaguauuauuugaccacuucagguauacauucaauacuggguaaaaauuucagaccuaucucaggaacacagaaauauuugguguccugauaagcacuuucuagacuauugauguggccaggaauuuggaaagacgacacacgcacgcgcgcgcgcgcacacacacacacacacacacacacacacacaguuuuuuccuucccugugaugaaaaaggcugugaaaaccuuaaaguauuugcuugcuucuuguuuuguuuaguugauaaugaaauguguacaaccucaaauuugcugccagaauacuaaaaauagaaaaauacccacaaaacugucaugucuuuaguucuuuccccccgaaaacucaguaaaaagguguucccaggaugaaaagaucauuuuuugcugcaugcuaaaucuugcaggaaaaaugauuuuuuaguacgauucuguagaaaugaaucuuugauauaauguaaaugcugcuguuuguuucaaguggugaauguguuguuaaaaauuggcuguuugcuuucauuuuggccaauaaguaaucaaguuuguagaaaauguuagcauucugacuacuuagcaucuguaguaauuucucuauguauagggauaauuuuuuagugggcagagauccuguucuaguugccuguuaagcaaaaucugcccucccaauugaaaaagccaaagagaauuguuagagggaaaagcauguagccauugcagucugcauugcagccagcguuguccagaguacacgcucagcacuuagcuucuacuguguguuguggucuggugaguguuguuuccccugagcgcucuauuauuuauuuauuuauuaucaaucagugacccugaccacauagugugauaggugcagcauucuucccugugggaaagaauuaaagaugguuccauuuccuaggcuacagacaggaauggggcucuaaaugguuuucauagacuggcuguuaaaggccaaaaauuuugguaaaucaaugcuauauuaugcucuugaacuauuaaaacagccauaauuauugucccaagauagaauauaguccuuuuucaaagaugauuauacguggcuaggugacagacauuaaugacugacucuggagaguaagucauaccugcacucuguggacuugaugguucuuuuucuagagcaaacagagcguggcauuuuguuuugacuuguucuuccuuggggucaaauuuauauauauauauauaaauuuuuguuugggcgaccaagaucuaauaauuaaaacccagguggaccauggauucagaccugccuuuuuauguuuuugacucuuagguucaucgugucccagacuucuucacauauucgugaagguaagauauucugugugcgcuuggccuccuuuucacgcauauuucauugccucuuugaugagugguuacgaagacguuaaacuaccuuuuuguucccugggguaauaggucaguaacuaugagcgccgucucucuccaugugagcuuguguuaauagacacuuuuaugguagaguugggauggggccaccaccuuaaaaugagugagcagacaaggccaggcaagccaaaggcuuuaagacaccaugauuuucuuguuuuguuuuaauugggaagggaaguauaaggaagagcucagagggaguuucauaccuggaauuguuggacuuaauugacacuugcaaauacuuuuaguauaaagguuuaauucuauuuaaaaagaagauccauuaaaucaagcucuuaacucaugggacuauuugcaacacuucuuuguaaauaucauuuuguuuguuagguuauuggcaaaacaguuucaagguucacuucccucccuugaaccagguccaggucauuuugcuuugggguagauuaaagucagaacucuaaaaguugagcaacuuuguuuuuuuuugaauugauuuagcacuaacccaccauugcaucuuaaggauggcaugacgugauaaugauggacuugugugagguuuugauuuuucaauuaaacuuuuuguuaucacagguaauuaauugucagcggucuugagucugguuauggaacccuguaguaacaagagcuggaaauuggcuaauugacaaugcaauugccuuaaacaucucaaguagagaacauuuacauuagugagauguacuugaauuucagaacuuaacaaauuuuaauuacuuuuuauugaaaacugcacugaacgcuaaauguccaccuuuacaauaaacaaauacaguaacgguaacucacacuaaaacaaaacauacuucugauagccauuauuuuucuguuugggacaauuuuaaaguuuuucuuuugucacaaaaacaggaauguaccuauacaaaggcucaaaauaggccaucuuuuuaaacaaaaaggcaaugauucacaaaagacuaugaauagaacauguaacuaguugauacaaaucuaauaggauuuguuaaaaucagucacaucuaauacaucugaaguguucuuguauaaaauaucacgugaagaaaagaagacuuuaucaaugucuaaaaaaguggguuuguucauagacaaucugacaaguuaccauaaaaaguguuuccugagacauaaggaaaugcaacauuauucuucuugaacccuuuuagcucaagacuuuccacucaauaaaauagcagaggaucugaaacugagaaaauauauuugaguacaaacagcuugugaaacuuaauacuuuuuuuuuuuuuuuugcaucaucagaggguuuuacugaacuuacaaccgacuugcccgcucaguaugcaguucagaugugagaggcgcuucucuguacagcagccuguacugucuucaauccuaugcgugcaggugucuaccacaggcaaacaguuuucuccccauuuuguaguaaugugauuuuccuauuagcaaaaagaggucaccagccccuguagacuuaagggacucaagucacaggauggggauuuccucuuaauauuuuuuauuuuguuguuugaacucuugaugcaacauuguagagcaggguguucaggaccugcugugcccaagggacugauaaaggaaaaagcucuauuuauucuuuuugugauuugaugcacagaugaaaaacuuaacacacaauaacagaaguuggucguuaauaaaucacauccuagucuuucagcgcuuccguaagcagacgacaucuucaguuuucuagcucuuguaguuucaacacugcaacaucaaugaugcauauguccagaaucaguuacaaagaccauccgauucuuuuucucuuaguucaucuauuuuucacugucucuuggucccaaguguaucugagugauuaccuucuggcauucucugcuauugcucguuggggugcucucgauuguccccguguuuugugggcugguugggagagggcgcuugggaaggaugugccacugucgggagguugugagucacugggaugccuccagggaugaucccuuccauggcugcaggaaguccuccuggagccacacccacgaugccuggcggauaucuaaggaacacacagaaauagggccuuguaaguucagggcagaguugccaagcucuuggcucuucuacuucuggccuuuucauaagagacaggagcccagugacaugaacauggcucaccuugaccgaccuucugggcucaagugaucccaccucagacacccaaguaguggcgaccacaggcaugagccaccacgccuagcuaguuuuuguauuuuuuuguagagaugcgguuuugccagacugcccaggcuggucucaaacucuugagcucaagugaugccccaucauaggccucccagaguccugggaguacaggcgagagacaccaggccuggcuaauaguuuuuuuuuuuuuuuuugagauggagucucacucugucgccagucuggagugcaguggcgugagcaaucucagcccacugcaaccucugccuccuggguuaaagugauucuccugccucagccucccaaguagcugggacuacaggugugcgcuaccacacccggcuaauuuuuauauuuuuaguagagacgggguuucaccacguuggccaggauggucucaaucucccgaccucgugauccgcccgccucagccucccaaagugcugggauuacaggcgugagccaccaugcccggcccuggcuaacgauuuuuaugggauaguuuaucuucccuauccccaaagcaaggagaagucucaauuuuuauauaaaacacuggcaacuaauucauaaaaacaaaacuaguccaauccaaacacggggccacuaauuuuguagcuuuuagauaagaagauauuagcccauacuauuuaugaauguggauacauuauacuauuuaaaaaaacccacuuuguacaaaauggacucccaacuguucaccaguuacuucugacugauaaaaugauuucccaacagaguacaauggacccuuagggacucaauguuugucucccuccaucccccuaauuccaguucaaaucccacaccuuaaaggugaugaccuuaagagguagagcccuugggaagugacugggugaggaaaugacugggucaugaaugggaucagugccuuuacacaagggagucuagucagugcucuggcccucucucugccauaugaggaugugggaagaagcugacggucugcugccuggccgucaccagaaccugaccaugcuggcagccucaucucagacuuccagccuccagaacugcgagcaaggcauuucuuuacaagccacccagucuaugcuacucaauuauggcagccagaacucacuaagcuuucuaggcugguuggcuauauacucccauggccugagaugggaagugguaugcuugcuggcuguuggcugggggcccgccuuccucggaacgcccaggcucgggcugguuuuauauugcaagcacgaagugcugugugaggacacacugcauucgccaaccacagaacacaggguccucgggcaaagugggacucaguguauucacacagacuuaucauccauccagguagaggaggaggcaucucacuaugguagccaccccacccccagcuccuggccugccauccugucaccaagaccuucagaaggacucuggucauuagggucccuuccucagugcacacauacuguucuagggggccuaagagccccagcuuacgugaaggauaaauaacaauggagacauggaagaggugggcccccagcuccacccaacaggggaaucuggugcugugauaggcucaaaauacuuuugagggccaaaaggacggggcuggaugaaaugugaagacagccaugugaccugcaagcaccggcauagcuucuucaagagugucagagccuucauuacacaaacugaaugcacccuggucgucacuguggcuacagcaggggacauguggcuggagacauucucaaucaucaugagugggagugggaggugcuacuggcaucccguggguagaggccagggaugccgcugaacguccuacaaugcacaggacaggccaggccuccuacgagagaaugaagagaaugaucuggccccaaauauacuuauugccaagagcuagaaacccugguuuagaauaugcaaaaauuuuucuuaagauucaaggcugcaacuucauucauuuaugcaugagggggcuacugauuuuccugggaagccagcaauaaugggggggggggugugggagaaaaccgauucgugcauggaaaauaccacaaaaggaaccccuucucccugugagggcuccugucuuucccccacucugcguucccaaacauggcuccaguuucucagcugacccaaacuacagguaucauuuuuaguguguggacaaggucaucauccugaguugauuguacuauccugaguugacuguaccagaaugccuucuguggacauaagauucaaauuggaaaaugaacuugcucacaggccuuugcacuugaacaucuuaucuacguauaccuuucucuuugagaagcccuuuuuuuuuuuuuuuuuuugguggugggguggggucgggggguagcagcauugucucacucuguggccuaggcuggagugcagugggugaucucggcucacugcaaucuccaccucccagcuucaagcaccucucccaccucagccucccuagcagcugagacugcaggugugcgccaccacacgugacugggaagccuucugguuuuaagauggcuuuagaaugaaaggcaguuccuagcaccuguggucaaucacaucugaccgaacacacccccuuuuaaaauaggagcuucuguuuguuccaugaaauuaggcauuggaagaaaugggggcgguguacacaguuccugcugagaaggcugauuguucugacccugacuuagcaucugcgggagguuaagcuuccgccaaguuugggcuucucucccuggccccggggccguggugcucacaagcugagacaaagucaguuccuuuucucaccuguauguggcaccauugagcucaggaugaauugcuugcuggucuauuacugaccaaggcgcugaugugacaaagaauuccuuguucacacaauuucuuaagcuuucugggaugcgaccuaggguaagaugauuaaaauuaaucauauuauuuuuacaaaucacaguaaguucaacauuacaccuguagcugcuuauguggggaaauaagcauuuguaaaaauguagaacauccaaaggcccaagugcuugagcucuucaacacugaccuucagccucugugugccccccgacccccgaguuuauaaugucugggacuaaagggaaugguucccucugugaaguuuaguucagggcuuacguaaauaaacagggcccaacucauauaaauuugaugcuaaaagugaauucuaccugucgagagcugccuguagccagcaggacaggagccggcugcacuguggagcugaggcugcccuuggcaggccagaggcacggaggggcucaccugugauggcucggcggaucucgguggcagcugccucccucaucuccagugacgccugcucacuguaccaggcagugugaggagugcagaugagauucggggcaucuuucaacggacccugagcaaagcuagaaaaauguagaaaaaacagaguaagcgggaaaugucgcauacgcucccugcccuccucagcacaagggagcucuuggccauguagaaaaguagcuacauagauagcauggauacaggaacaucugugaugauauuuuaugaaggcugggaauuuuugaauguaauuaucaaaguuguguaagaaccguauaauugguagaucaaaaagcccaauucuauugaaggcuuguccugcuguaauccagggcagagaugaugccugucugucugaagaccagaaccacugccacacccccaccaauuuucugccucuccuuucccugaugaccucugggaaacuuccagcccuuuuacaauuagaauacagcacaauccuuagaagaacagagacuguaaaugucaucucuggaguuuccugcccagggaccuguuugggaaaagggccucgaguucaaagugugggggucagguguggagcugggcccugugggcuccugguaggcggcuggggcaacacgcaccugaagggcucugacucaugcacgucgagggcugccccucguauccugcccuccuugagggcuugugcuaaggcuuucucguccaccaggccgccacgggcugcguucacaaggaaugcucccugccucaucuguggaaggaaagaaaagccgguuacaggcacacuggcaugguggaagacucuuguaccaagguuuaaagaagaaagcugcaagcuaguuuuguuggucuggugguuuaaugugugugcugcaguuugagggaagggagugggaaguguuggugacggcuggaagccagggccguugcugcugauccugagaggaagcaacacgguggaaaggcuggacugugccgagcugcuggccucuuuaaagguucugggaagcuucugaagcuggguccuggcuagcgccuguccuucucugcuuagccuggcucagcccgaggaaggggcuucacguggcuugucacugguuuguugcagggccucuucccugcucaacaguguauccagaaaccaccuccguugcccuccgugucccucuugugcccacaagcaagugcuaccaccuuucgacagaagcuuccauggcaucuauuuucaaauuaccugcuuuaugguaaagucauugaugagguggugguuauguucguugagauugcagugcaaggagacgcagucgcucugauacagcaaauccugcaggguguagacccucugcacgcccagggaccgcucgaucccauccugcaaguaggggucauaaaauaugacgcugaauccaaaggccuuggcucgaacugcaaccgccugccccgugcgaccuguacagaaacagagcguccaggugagugaguccacagcccgcgccccagcgcugccaccuccauugcuucugagcugaguccgggcuuggcauccccgcugguagcugcugccagagaaaccgugugcccaaagcuuagugaggccugaggcgagcacugcccgcgaggggccaccauggccgguguaggacaggugaggaccgcagugcuugcugcuuauauuggguacagcaggauuuuuguuaaaaacaaaacaaaacccuuccuuguuauugacauuuucaaacacagaguguucugacaagcccacaugccccucccaucaccacccguguccuccguucccaccccucuccccacuucuugugugcacugcaggcuucuuaacaugagcuuuguguuugaaaaacuugcucucaaugucacagggaguaauguccugccuccucauugcugggcucgcuccugcaaagggugacaugagcacaauggcucccugcaggcuggcccgagugcagacuggccacaugcuacuguguucugggcgggaggcagggcacaugaccaucagaccuggaccugucccacugguggggccucgcgcccaucugcauuaugcagccugggccucccgccagcuaugucacaggaugaggaggugucucccacuccccaacggcugucauuucauaaacccauggggucccccucgauagcaccuccagcuucccagagcaguuuucagcauuuugaaaacaaaaugguuaguguugaugcucgacugguucucuuggagaucacagaaggaaucuuuaaagccauggcuccaaggugcaggcaggagaaggacaaagaugcgcauuuccgagcaggcagccuguguuccagggguaccucaaugcuggauggcuccuccugcagcagcuccaucuaaccgauggccuggcuaggacaacugccguaguuuagaacaaagguugaauaaggccagucugaucagggacagcugcaggacaacuaguauagcaaggcacgaaccaucacgccucuccuccucagugucacccuuuacagcaggcaggacuggacgguggcagggacggagugagagauggcucucugacgcacuggcaacaugaaacugaggaccccagcaugcaacugcugggagcucacacuucacaggacccccgccugccuucccccguuccugcagccuccaucccccucauggcgucugugcacgaacaugcuucaaucaguggggcucacacucugcagauccagggccuggagggccuguggaaaagcagcccagagcaccaagcccagauuugaaccgugccgacggcuauuucuuuguuuuuuuuuuuuuuuuuuuuaaaguucacaaaccccuugaacuuuauccaugagauuuucugaugacccaaugacuuaauccugcuacugacuuaaucaaaacccagucccuacagaagagaccugcucccccgucacagcgccccccccggccccccaugccgcuuauuuuaaaagcgcagcucccacaggcugccuuuccuucaguuucuguccaugcccccagccccaggcugcccucucuuggcggcaccgucccaccccgccugcugcacugagcccgcugggccugggggacucuugcucaguagaacccgaggccagcaaaagcucuuagcccaggauggcugcagcagcgacaguccugaaggcuacagagacaccuggaaagggaacaaggagagcacgacagucccugugcugaggauccagggugguggcggcagggguuaguguacagucucgagaaaacagggcggcggcagggggcugcacugaccucuauacaccgagaggguuuuuaaaguugaaugacaagggcacagcuacaggaacgaccccaggaagaagucccgugacggcuggagucagaagccccugaaacaagcaccuccccagugaggccccaccguguacccagggugcucaugaccacccccaggcucugcagccuggccagagaccaccgaggccccaggaggggcuucagagauggagaugaagcugcaucuccgagccaugaggcccaguggggcccggacagagggagccugguguucacacaccacaucuguuuuccaacaaagucaaaacacgguggguccuuucagaagauccccagcacccgacacuucaacucagacuccaggcgucgggcgaggccagacccaggagaucacagccuguagcggggacagaaaggugugcacuccuggaagcguccagcaacuucucucuuguucaaguggcaccccagguccagagcggggcuuguggggagaggagcacgggggcuucguccucggaggcgcggagcuccaagcaagggcugagcagcagcugggagucucccggaggccagaacauuacuggccccgugugcacaugcgccuucuuggagucccaaaaggcagauaccacguaucccaccaaauaucuacuuacagauugggaaauugaggcaaaaagcucagguaauucccacaaggccacagagcugguaagcggugggguugagauucaguggcaaugggccgaggucuccugggugugguguggacccugauggugagcaggguggggaccuccucgagcccccauggaaucaggcugcuuaccaucaccuucuccguggcaccggccccuaccacccugcugaagacccuccugggccucuccucacgucuccuuuuccugccccucucucaggagagcuuuccaagcugauggccugacugugccaccccaaccuggcauuugaaggccuucaggagugaggccauguccauaacccgcgucuccacugaacccuacgccagccccuacacgagccccaagccuggcugcugcuuuacgacacaccuccauacagccccugcccuucaccccugcccagggaaauuuacugggcacagcgccuugcccgcugccccacagcaaagaaugcuguccugccagacacuacagacagcaguggacacgcauucuuccagaaccagcccagauccugccucuagggugaguugccugaugggucuugacuccgaucuccuaccccgugcaacacggggagggugcuggcccugccugcccuggcuccucaagagcaggcugggguugccuuucccgagggguccccacuacaccagccccagugucggagggguugggggucagcgcagaggguggcacguaccaaagccaaugaggcccagcgucuccccacggaugcgggccgcucccgaggccaccucgcggaucugcuccacgcucugaacccgcgugccuucccgcagugccugguacagccacguguuccuccgguacagguugaggauguggcagaugguagaguccgcugucucuuccacggcugcagacgggauguugcacacggcaauuccugaaagggaugaggccaaggccggagaugagaaaaccucaagaucaguggggaagccccagggcucccagcccgcccuccugagacucgguuguuggcaccgggggaggcccaccuuaucgucuagcagacgcggggcugggcacgugggcgguaggcccucuggcucugaugcaugggaagcucuagccccaacaucuaccccucccucccaaggaggacuuuugcuccaggacguggcucaugaccaacccaacuccuauggcugauuuugggccugacuggcuuccuccugggcuugcacugagucccaagaaaggacccggaguggcaggaagccagugggccucagaccagacuccuccaaguggaccccacucagccucaaaccccucagggucucccucauggagcuggcagggugacaaagaauggcuuuugguuuuaagcuaugcuaacaguuugaugcaaaaaacauacguuuuaaacauacugguuuuaaaaaaacaccuccacccccacacggaugcaagggcuggccccgggaacggaaccgauggccgaagcgugugcacaaucgcccuguggucaugugcucagcacccugcucugcugggaagaacucagagcagacaggaugcccucccugccccguggagcagccuucaggucagggccgaggguggcuuggggugagcccucuggccccacacgagcugcagagaccagggucaaguaucucccagcacaaagcagcuguggcauggagaguuaacccaagucauaggcagaaagggcccugccauuuacccuccucagccagagggugucuggggaagaaugaaugacugccagauacaacaggggugcaaguaggcagagggccaggcugggaacggccccucccuacacccgacagguggagauccagaggccugcuugcagcagagaccagaggggccgagccaggggcggggccccagagggugggcucagcagccagccuguggcucccaguugagcucucugaggagggguguggcuaucugggcaucacgucagcccaagugaaaugguucccuccuaaucccagcuuugggacccuuaggagagugucucucccagcaaggggugcccaaggcacugggacagggccaccuuuaaggcagcccaggauuccucuaucuuaaguccugaagauugggguggggacagauugggguggggacggcaaucaccaaggcagcuucuucggcucuacuggacaggaaacaagaccagugggugccacaaacccacuuucuagauggcugcguggcugucuccccacaagggccaccccuaggucuagggccuugagagugacccgcuuagcaagacacacagcucagagaaggugaagccacugugagcaggucacccacccacccaacguggccacugagggcuccucugggccaccgaccccugccaagggaccagugugguugacggugacugaggccgaccaacuuucccacgagcuggaugccaggaaucuugcaggaaacuggccucauucauuugaaauagcucagcagagaagcuggggcuugaucacaugccauguuauuauuaagucagacagacugaggcugaugccagagguucaagaaaaucuuuggcggcugggacaauuuucauuccucgggcaggcuaaagcccagcagggaggccccgcagcagaaucacccucaaggacgcuggcuccgugcugcugccggggcuggcucggcagugcugccuggcgucaacagcagcaccuccuccuaggagaugagcugaugcuggcugggagaccccacaaggccacguguguaaaggcacccggguggguggguggcacaaaaaggcagguugaggcaggacaucuggucagucuucucaccgaacuuggacauucagcuccgugguuccacugcucaccggagugcagagucccaggacggggagauggugcaggaggaagagcugcagccacugccugggauggcagaaccuucccacccagaccgcggcggcgccacugccaggaaccuccauaacccucaccgcucucucggagggagcaucuucuuagcuguccucuaucgcucuguggaugcagccucccuucuggaugagucaagcugauccuucaagugccacacgauggguggcucugauacucgcaggcugggccucccagcauccacggagccuggaaaacggccccaaagaggcaagcugcuuuucucucacggucagugccaucgugcuuuaaucccuucaugacugccgcuggcaaggaaaccacauaaaccagcuugcuagaggcggcggggguggggagggguguagggcccucucgaggucuucccggcucguggggagaagugcaggugagcagcuuccucaagccuugcccugcucuugccgugaagcgcugacucucgccugucauuccagggcugacagcucagagccuugcgaucccagaaggugucaccagaggccuagugugcugccucgugcaacauggagggccuuguuuucugggccugcgagggacccucuuucaucaggagagggccugccugcagccaccugccgcucccagcccucagcacaaaaggcccguugaccgcaugauguggggaauaugcauucggagacaaaggacgucuggacagaggcucauuuuccgccuccagagucuacauucgaaaagugcccuuuaaaagggccccgcagaugucuuccaagcgcccuuaucagaugggaccaggaucaaugaaaauccaccacucacagcccuucuacauuuuccaaaaccgcagucccugguccuggucgucuucugugggucucagaacucagggaacacaaccucccaucucggcccucccaggcccccugucauugaggccuuggugccuuucuggccccacugccugugcggggcacuucuagaaauggagaaauaggaaguuccacaggcaaggaccuccccucucucccuggaaagcagcgucugguccagccgaggaagggcagggucagcacccguaugggccugggagcuguguggugaggggccgacgugcuggagaagcaagaggugcgggggacaaggauuugagagccccuggcacaugaagcuguauucuccucugcuguugaaacuugggauuucagcucuacccagagcacaaaggacauuuguuuucaaacaaaaauauccuuguuugugccagggaaagauggaaaauuuuaguuuauauuaaacacgccuuugaagacucacaucuucuggagugucuuuguuccaacagaggggcucggaaggacgccguggcugguagcaagugagggguguggggagggugagggguggaugugugaagcugcugcuuccaggacccuaagggguguggaaucugagugacucucucuccuucccuggccuuuugcuuugggauuugcccguggggcagccccaccccacugcguccugaccccugugaguguacgggcagcucccugcucgcccggcuccccagcccugcuccugacaccaagacccacccagugcuuccgguaccugggugcugccccgacuggccgugaaggauucaacuaagauucugacccauacacuccaugccccaggcuaaggcuguggagagacagcuggagcccauggggguggccucccugaaaacguggccgguggugcccgagagcaggauucucagauguauguaacacuccgcucacacacagagcccaucugacacccagcccgucccggaagcaccggggcccacuggggccuuagccgaugggagagagguggggaaauagcgccugggcuauuccuggagcacaggaagagcuguuccaaggccaggcugcugccuuggaauucauggugccucaugaauuuggggcaccucagcacucguaaggcagaguacagcccccacccccaaaaugcagggguggcguguuccaaacacagagcaagcacagugcccaccuggcccucucccgaggacgcucgaugccagcggucugcuucuugugccucugcacucagcacucacgagcucacacggggugcugggcagaggccccccucaacaugcacccccagccgcaagugcauggggccgauaagcagcuuugaagcccccaacucuggguucccgccugcugccucugcuuuucuucggaagccucugucaucaacuguguugggcaggggcccaccugcuuuggugcugaccuggaccacaugcugcuaaggcugcccucccagaacgggaggcccagguucccauguggacaggggccuagagcugugcacacggcaggggcaguuuaggggacacacacggcaggggucauuuaggggacgcacccagcaggggugguuuagaggacauguggccagucgcauucuccccucuggaggcggcacugggugucuccaaauugagccugugccagcuggguguugcucugagggcagagaugccucacagccccgcagaccccacacaagggccagcagggacuauccuaccugugucaugugaaggcagggccgcaaggugcuccacagcccggccuggaggcagccaccuugcuacagccagaagcggcugcuccguggucccaguuccagcugcuucuccaagcccacccgagcagggcccacagagcuccggacaacuccaggcagccagcgcugccucgcacucaccgagcucgccggcagccuugauguccacguugucauagccacugccuauccgcacgaucacucucagggccuugaacuucuccagguccucccuggugagggugauggugugguacaucauggcgcccacggcuucguuuagaaccugcgugggaacagagcacagggucggagccccaccccgugcagcccaccggcaccacuuggccuggcccccuggcccuaucacccuugaaccugaggcagaggaguucagcaggaaagcagggaacagggguucuggggccugccggugacuuggggcgaucuaauggggggaugcuggggaggaaacugcccaaggucagugcaggccccggccgggcagggugggcccaccuucucguggauuuccugcgucgacugcgcgucacagaaggccacaguggccagguccuucaggaugggcaucuccacagugcagucgcggccguccagcagcgccaccagggggcgggggugcagggggccguucaugaucugggggcggauaccugccaggagggaaggggugagcacaguggguggguggcuggggccacagggugcguggaggggcagcuccccacucaucacucagggcagggcuugggcaagcgaggguggcggagcagcgagggcaccgccuccaccugcaucaccuuccagggagccacugacacgaagaggagccacuucccauccacuugcggcucuggcuggagacgcacacggcugcuucccugccagcagaccauagucccgagagccucaggaccauggggccccgaggccagcacaggcuaguccagcacaggacgggucccugcaccgcgugccucccugccugcaccggcaccagcugccccucacacacuaugacaggggauaaggcgugugcguccaaaggaacuuccuggacaggcccugcacaaacaggcggccugggcaggcuccuccagccccucucaccugcgcugggugaggagaaauggcgggucuggggcagggaagguaugccugagggcaggaggccucuaggggcucaggagagcaaacuucucaaaggaccacacagcaagcagcucucuagacaggccagagccaucauauuaauccugacagauuuccuggugcugccaacaaggugaagggacagcugugaggacagaggggcaggggugaccccaggaagggccccagugguccuucccacaaguccaaguacaaauucucuagcaacuucaucuggaccagcgcggcugcaucuagacguucagcagggugguggaaggccuuaccugccacacuacagacgcgcaugcuugcgccccgugcacauacagggcagacacccugcggggcccgcccaggaugcagcgagagccucagggccucuuuucucucuuuauucugugcagcaaacccagcaggcuccgaagaccucagagacagagaagcagcauuuucuccaacaaaaacugcccccuucaaauccauccuuggauuucguagguccuccugaccaucugcccaaaccucacaucuucaagacccacacccuggacacaagagaacaacuaccugaguuccagaggugcaauccgccgagaugccaggaaggggcaaugucucuugucaaauuagaacucuuuagccucagauuaaaacuuuggggcucaucaacuuuucagauauccagaucaacccugacggcggccuuacauccccauccccucccucccucugaggcuggacgguccaggccauugcuccaggcugagcccagccuggugacccaccauggguaacccaaccaggaaggugugacauucccgggaucacuggccuuugagcacaaggcagcaggcucagggucccacaggcaaaagcaggagccuuccacaaaggccaacuucaucuguguggccucgccuuccaucccuaaccuccucaagggcucuuaguaguccccaagcuggccacuugguggggacgaugacugggaccccagccacgggggggcuccugcuggaccaccaaggcucauauuccguuagccacacgcucggagacgaggaaggaaaucccccuccacuggggccgugacugcauccuguuaagacuauacacggugcuggggagggacggcccagagcaccugcaccagcccugcauggaaggccgugcucggccagugggacuugggauaauugucucuuugagcacaaaguacaaaaaaggcuuuugucccagccucagaagaaugggcugggguagccagguccacagccagccccgcauggcccccaagcuaagugcaguucuccugccacccccggcugggagaaaucauggccccucucagcccugagcggcagcugcaccugacgcucagacaccaaaggcacacgugcacccagucacuccugcugcugccccgacacccagguccccaaacaggguguccgcauggauccgcacuccaacauccuucugcaccaggaaaacagggcaggggagggggaaaauaaggcagggacgagggccaacacccccguguccucaccagcccacgaccuguaugaguggacaggaagcgugcagcacaaagcuggauacccccucagcucauccgcgagauccgcaacagcaccgucaccugacgaggaacccgacacacauggcucccaccugggcuccuguuuucugcuaagaaaaugguacaacugccaaauuccacaagauuccuucuguuucaguacacucuucuggccccuacuugaggucugagcgcacaacccuguggggccuggaaguccuggucucaugccccaggcggucgcccacacacagugaggaacaccccaacuucacuuucaggggugcuggcaggaugguuaucggagagagugccugauuauaagaaauccaagcuguucguuaaaugguagccacacaggaaaaccacgcugggcgcaaggugggaauccagagccgcugaugcgucuggggagccugagaggccauugucacaagauguccauccgcagcaucaucagugcauggauccguuaccaggguaacaaacuccagguugccuagcgaucggcucccuccccgacacggguugccuuucuccuuggugaaacccacccucuacccucccugauggccgggcacgcagaacguggcugaggcuggcccgagaccuguccaaggucugaggcucgaauccuggcagcagguccuucauggcaaggcgggaaaagagaaaagccaacggguucucaugcugggaaaagaugccgggcacgacggcuggaggugggggguugggagugggugggaugcuugcgugcccugcaugaggugcagggauauggaggccacaggagacccccaagcccugggcaugagagcuuagcugggacaaugccaagguuugcucuagaagggaaagcaccaucuuccaagugcuccuucagucccagaaggaaacuguccacccacacaccagagaaucuggacugaaauucaagcccuugccuagcagccgcugcccuacaggcuugcuggagccuggggcagagguuucuggaagagcucauauggaagaucucauauggagagaugaaggugcaaacagaucccccaucuuaccucacacaggauuccugacgccucuuucaggcuucugaccauuugagcaaguuuuuaaccuauuaggauguaacugacacacagaguaagauucauauacauuaagauggaacacgacccuuucagggacgugggguccccaggcccaguggggcaggauugggaauuugcgaggagaaagcccaaggcgcaguacguaaugagggcuuccgaagaacugggcuuuaugcuaaaaagccauggcuuccaguugcuaugcacagcugacggccuuuuccaugcguacagaccacaaggcugacaagaguccugcagugcugcuguucuucccacuucacagcccgggagucagcgcucaggguggccccguaccacggugcgcaaccacgagguaugaggagacacuugcggacgagggucacagggcccuggugcccucuaugcgcuauuuuuccuuucuaccgucucccgccaguaaaccugccuuguccauuucaggacaauuccagcugcaacuggacacaucacggaaaugacaucagugccuuacuguugacagcuugcccacauuaacuguguagagcagaaagcccugccggcuccccugguaucaauuacuaucugguuucaggcuugcgugugcaccaggacggcccugccccuccguccgggaugugcugugcaccagcucaaggcagugcugacgcccaucccugggccugguauugcuuagagcugcagcugcaauaaauacuugugaaaugagagaugcucagucaaaaacaaagacaacaccaggccaaacugcuggacuuuugugaacaguaaccagacacccaggaaaagcaaagugcguggaucucacagauccuaaggcagguagaucucagggaggauggcggaaggauccggagcuggaaaacgcuacauuucauuguggggagcugcugcuuucucggauacaggcagacaggccuggaguugaccuucuggcucaguaccaugcaaggcaaaugggauguuccccugagcagucaccaagaaggaacuggauugauccugccacacaaagcugccugcaguguuucugagacccauuuuccagucuuccuagacacugugugagcuaagccgacauccuuccaacagaaauucucauuauuuaaaaaugaucuaaauggguuucuguugcuuacagcacaagacaaccugccccaggguaaaggguuucaggauuugaggcuucuaccccaaagcaaagcagcugcaaaugaucauuucugacauaggaggcaaaggcuggcucuggcuuuuuuuuuuuuggagacagaguuucacuuuuguugcccaggcuggaaugcaguggcacgaucuccgcucacugcaaccuccaccucccagguucaagugauucuccugccuuagccucccaaauagcugagacuacaggcaugugccaccaugccuggcuaauuuuguauuuuuagcagagacaggguuucgcgauguuggccaggcuggcuucgaaccccugaccucaggugauccaccugccucggucucccaaaaugcugggauuacaggcaauaagccaccgugccuggccggcucuggccucuuuuuuuaaaacgcacuagauuuuauggaaguuuccugacaccguagcagucucaagacaccagugccugagucacucccuguuccugacaggggcuacggcugcccaaggacagacacuggccacauaccccaggguugccccaugaagucccugcagguugcagucuuagagcugaccgagcuaucacauucaugagaagaaccgcugcucagagucacaguaguggccuugcaggagggagccucuguggaaugagggcaguugcuggaauuugccgggugccgucaccagcugcccuaacacagauguuguaagaaguaccuggauccuuccacagacgggagauccaggcaggucuuccaaagaucccgacagaaggugucagagugcugcaagcagcuccgagcuguacagaguaaagcagagguuccucuucaaagacuuuccuccccgucuaauuaggaauaaauacuaacuucucuuagaggcaaaauuuauucaaagaucugugcuaacauucuuaaauauuugcuagccguaauaaggaaaucaauguacguuauguucuuagcucccgcaauuuagccuaaauauuugccuuagcaugcuuauacugguccaagcaagcauuaggucauagccuguuccucuuccuuauuugaagguguuuuuaccuuucucaacauuccacaaguuacuuccuccuuccuuuguuccccucuaccuuugccucuuuaaaaaaguucuaaguugcuagccaaucgggacaaauagagaaugugaggucccuuuccagccaacggaaacuggacacagcgguaggguggacgugucagguuauaaaugacccuguguccuuuguugggugaacucucgugggaaaacugcuggagaguguacccuuucugcagaaaguaaaaauggccuuacuaaguaaauuaaauuuauguucaagugcuauuucuuuauggcaccggggaacgagcauuccaaacagagccaagcgauucacggcuucaucagccccugugaccugcagguggccugggaggcaggaggagccuaagcagccgguguggcucccagccucaugcacaaugauccaggaagaaagaggagacaaaaccacacaaacuccagaggccggggcgggacagggagugacccaacacagccgaaccugaggccccgccugccuccaaggaagccccacuuaauaucccaccgaucccaccacccucagaaaagcuuccucuuaaaugcggccugcuccccaauuaaguggccgcuuucugcaauccagcaugacccgauccccacuggcugagcucagcagaccugauuucuagaaagccagacacagaaucagaacuaaggccugcuaacaguguuauuucagaggcuuggguuucuacaacauaaaacugaaaaucgugacagggccaagcugggggccagauucugaugcugggacguacgcaagugccucucagacacuuggcguuagacuuguaaacacagcugccucagugggucuacaggccagcccagcacacagggcuguggagcucugagugggggaaggcggucugugggagccucguguugucaagguaagagaugucucccuugcuuuguaaacauguuuaaccauguuauaaaagcuguucuaaaccgucagacgugggaucuaaacaacaacaaauguucugcaguuggcugaucuggaaagugagcaagccacggugacucccccuccuuguguccccagcagccgggaaggugccuguucccacggcagcugcagagaagacugcgggcaacaggcaucuccccucugccuuucacgagaaggaccacaggagcagggugcugaugagcggguggcuccgggagcagcuucaaggcauaauuuggaagaaaaucuguguugcuaagaguggcacuauuuuaagguuaaaaaaaaaaaaaaaaaaaaaaagcaacugcuauuggaaaucucagcuuuguuucuacguuguuaucugcuuuuucauuuggcaaaugggcuuucucucuguguugcuucugggaagcucucccaaugcugcguccacuucuuugcccagcuucccagaggcugcgauuucauuuuacagucucaguaauguauagguaguaugugcucccccagaauggagaacccaauccuugaguuuuaaguaucaccugacacgcccaacagauucccuggcucaugugcacacuccuccucccaccaugcaaugcaaaugcgcaacccuuaucucucuuucugcauucauggcagacaucacuaaucgauccccacauucuuccugaagccaggaccucagcccuggaguggcaucacacacaccaagcuguugaagaccuggcccagcugaaaaugauuuaacucaaccuuggacaaggacuggccugaaccaggcacuggaagacagcaugaggagagaaugagagagcagcgugguacaaaaugagugccggggaauuuaaagcaugaagcacaccuucuaaacuuagaaagcggugauggcugugccaucaccguguacauccuuagcagcuauagggauuauccuuauuuuuccuccagugagguacaaccagguaggaaaaagcucacaaucugcagcauauucagccagcccacuccucacacuaaaaacgccaggaucuuaaucuuccaaaguugggcucuuacuugugaacaauuuaaaaggguuuauggcaaagguuucaugugaauuaucccucaaguucccccugcuuuucuguaaggagggaaaaaaucgaguguugggaaaucuagcuucaccaaggccucugagcacccaggggcugugcuguuuggggugccccacaccaagugggcuccccagaaggcuggaugugccccauggggaaccuaguuuuaagcuacuccucggcuucugaguuuggcauucucugcaaagucagcuggagguuuggugaagaaauggccacaggaacacccugauaaauagauuugcuucuuaaauaaaacauguaucugaaugagucacgaugugacacaugagaggcucccagguaaucucccuuguagcucaggugacagcuggacacagagcuggcgaggcaggaggcuccagguaccccugucuuuauccagccagucaggugcagucugaugcuccccagagccugggccauguucucaggcccccaaaagcuuucugggugaucauguuaauaacgaagagcaugugugguaucuuccaggguuggaaagagauguccagacccacaccaucaaguucagaaaaaacacaaaauacaaaccccccugaaaacgaagcucaucugcaacccuagaaagacaagcacgugcagucacuucaacggguuccucagagccccuggggaagcugcagcccgcacccugcaguguccgcgcuaugcggaacggaggagcacagcgggcccagaacacaggaaagugacagcuauuucccgguuuguaauggaguuuaaaauaaaaacaaaaccaagagugauguuaggugcuugaaaguguuuuuaggcacugguggcuuuuuggaagcccagacaccguccuguuggcugccucugguguugaguguucaggcuccgucaccuucaccuaaccccgggugcagcucauguucuggggugaauuuuugcccugagggagcaggugccauccacccggggcagauccaacaaccccacccagccugugugaaugcagacacugcugacucacugggccugaaagauccgugaagggacaucaccaaaaacggcgccuuagaaggcauucccacagcgaagcagccaaggacgugaggcucugcuucuauuucuggugagacgcgcuacgugugcgagauuuccccaguggcccagccucacauggguggucccugggcuccgggagggaggacaggaugugggggauagaagccggagcaacauccaagccugaggagcaaggaauaaggauuguggcucccacugggugaggcucugcgacauacccuccugcuucccaacacggggacggucccugcagggacggguggucaggaucucaugcacaggauagggacacucucagccaccacuguggcuggggacacacaucgucugaguccccuguccaauaaacaguucugguggaaucuuccaggaggacugcuuguucucuuccugccggcacgccaaggucagaugcgcccugggguucucacucccccaccugccugugccucugcauaccccacucguguggccgauccuccaagccucuguggaagagaugagccucagggcaucgccaaagacuaaaaauuguuguuguuguuguuuugagauggagucucacgcuguuguccaggcuggagugcaguggcgcgaucucggcucacugcaaccuccgccuccugggcucacgugauucuccugccucagccuuccagaugggguuucaccaaguuggccaagcaggucucaaacuucugaacucaggugauccgcccgccucggccucccaaagugcugggauuacaggcaugagccaccgcgcccggccaaaagaagcacaaaccugccaaggacaaaaaggggcucccauaugacuaucuguucacccuggugaacucagucgucaaaaccaggacuggcugguccaccuaacucauuccuccuugggaggugcccaccucgccucuccaagcugccagccagcagcaaagaaugcuaugacuauggcgaugggccuucugucucgaggguggcagcugccagcaugugguuccagcccacagcuccuaaacuaugagauucucaguucaaaggcccaagcuccgaguugugagguggucuggagccuguuggaaagaccaccaagaaugcccaccaucugcucagccucaccuguaaugaaaaccagcugccuguagccaaggggccgccugggauaccccuacuuuacauaucccaugugggcagggugcauucugugccacaguaauuagacacagacuagacuuucccaggaugugccuggaagcuggggaaauaccugagacuggaaacgcccgaaguuguaaaauagucucgugcgggcaccgcugccgucagccucuuuuacuuaauugguuuucaauacuuuauugcagcaauaaaaucaccuaugcaccaagaacccaaacacacagggagucaaguuucugguaacaaagggaugguaaacaguuagcuccuuauaccauaugcugagcaucaugaccauggaauacagccugucccauuuagaaggauggucacggccacuucucuugcacccuccacacaacccugugccguaggcgcugcuguuuccccagcagguaacggaggcggggggaacuugcccggggucacacagcaaguaagugauggagucaggacucaaacucaggucucucugacaccagagaccaagcaugcaaccccaggguccaccgcagugcaaaccaccugcuggauugguucaacucaacaagcucuggacacuggaaagacagacaucaucaggccuggcccuaggaaacagacaggugaucuugccucggcaggcugagguaggucuuaaaguucucucucuuuuacugcaggaaugugauuguucgaucuaucaaccaggcacacaaaaucaagaaccaagggccugaggcuucucacgugaggcaugcgcucuucccacccgggugucucucuagaucuugcagccuaaaagagacgucaucaugguaacuguuaucagaacggcggagaacagaagggcacauccaagcaagaccgagacgccacaggauaguaacacgugugugcuggccccacuccccaagcuggaugcagggacacacgguccuccucacgguguccuauuggcccagcaggcauucauggccccggugauaagaaaccuuguccuaaccuggacgacacagugaaaucccaucucuacaaaauuuacugggcguggugccacgugccuguagucccagcuacuuaggaggcugaggcagguggaucccuugagcccaggaguucaaggcugcagugagcuaugagugugccacugcacuucagccugggugacagagugagacuuggcucuaaaaaauuaacugaaaaaacaaacaccugauccaagaaauggaucuaugucaacuuggcccuuaacacuggccucuaagaggguuaaugcaagauucaaugcacacgagguugaccuuccuuacggggagcaaccucuuggcggccuccuggcaaauggcccaaaugcccugugccucagaugccugagcccguaggccucuggccaggcagaacuugccgagacgggaacaccagcccuccagaaagcacugacuuggaaggaagcacuuccccuaaagucucgggaagaaugaguuuggggagcugaguuucacccaguucugagccgugguggacaagaccagugaccacggcugcucagaauccaggcucuccagguugagccaccagcagccgccuuggccggcagggacgcccuucuguccuuuucagcaauaaccagagagaagggccaaucaucagaucucaccuccaagcgaauaaaaaccaagaaaagugagcguucgucaacccaagcuccccguaccaggcaguuuuccuagaagauacucugcgguguggaggauguuuaccagcuaccacacaucugcuuccuuggguagaggaaaaaaaugugcuccacguuccucgacauuaggucugagugaccggagcccgagggagcuucauagcgcaguaauggggaaaccugcguggucagucccgcugugauuguuuggagacucacuucucaggcagcggauucacgcugcuggacaaccagccagugaggugggaaaacccgcuugccagcaagugaccaacacaaaagaaaaaacuagucauccccacccaagcaaggccauuagcuucucuucgaguccugcacuguccccagaagagccauggcccagauggaaaagaagcacugcugguuuucauaucaaugcaaaaaaucagugacaaccccacaggccacaagcaggaaacgugacgucuguuuuugaaacagagccuuugcugugcggucccugguguggccuggccauccuccccugccucgcuggggccacagccgggcucccagggcucccuccguccacucccggucuugcaguugggagggcgucccggaagcccaugcagcccaaacccuagaggacucccucuggcucgaggcugaggagggaugggcuggccucagugcuccccgaagcacuuccaagaaggcgccucgcccgcccgcuguguggauaccgcugguggagguguugggugaacagcucucaaguucuaaaaaugugccccugacaacaacagaaggggauguuugagaaaaauaagggaaaauagagaagagaaaaguacgaauuguugccagaggaaucuggcagagcggccagcugcugcacacucacucgccggccgcacaagaggcugggugcugggcuggcagcguguccaguguggacacacacggggcugggugagauucugcaggaaucuaaaaaggccacaggcaacccagagauggauggcucagucugacuucucacugugugaaaguuugagaacgccuacugugcgcuggguacccggaucccugcaccucacaaaaaggcucuggcaccacccggggugacggggaaggggauggucagggugcagugagacuggggucugggacccuuuggugggucccgaucaggcugaggaaggccaugaggccccgcccacccuucccagugccccaagggacuuuuccuccaagguacaggaaguagcagcaaccaggagggcaaacgcccuggauguuccaugaaccugcagcgagccgagugccacugccaaguuccaggggccaccacugagucacugcccgaggggauggcugcccaugagugccgggaccaggagcccucuggauggccgcccuggcugcuggcuugucccuuggaaucagauggaccaauuccaccaguguuccagagaaaugaacaacacguccucccgcaaaaggacccugaguagccuguagccuggcagacccagucuuaauuuucucaccuuauuucccagggugaauguccacaaaagcaaaauaacacccuccuccuuagcuauggcagccaaggcugagaugggagagggagaagccucaugcuugcagcacacucucguuuuucgagugguccuaaaacccaagaggaaagugauccgcgaggacugcuguccggcaggccaagggccaagagcgcugcgcccaggcccagcucacagccaggaagugaacauucucagcacaacagcuggcuggaugccgccuccacucuucuuucuucucuaacuuuuucuuaaaaucuaguaacuucuacagcaucccaggcucagagcccaguuuacaggaaaacacuagaacccaucacaaaggcauauuuauuccuucauauaaaaagcaucuaauaggcaaauccccaguggggaaacguguuggguugagaggccagaggucagcucuaagcacuguggauggaaggggaauggacuggccugcgcugggcaguuggugccaacauucaguuccgcaggcagagcuuccuuccaccacgaaaaaucccuuaaugcaaucccuuaaugaggcagggccagaagaggagguaggaaccccgggggaagucagcgccaaagaacagcugacuguauccagccaaagugcaagaagagcuuaacaacuucaaccaggaugaggcccuggugaaaucagaaggugacacgcaggaggcugucgacggguagcggaggaaggugcaggcugaggagcagggagguaaugccagaaagcaaacugcaaaccagcgcugaugccgcuucuuuggagaggcgauaaaggcaggagaaacucaccucugcuucugagcaacggguucaucggucccaucuuacaugcagugugauucuucuaugugaucaguuucccucuuucuuugguugcuaggaagcucagagcagaauucccaccuauccuuguguacaggauugcacgggaugcuguguuccggcccuaccacccucccucaccuuuuccuacauuuacuuuuccauuuauuaaaacuuuacccuuguguguguuacagcuguucccaacagccagcuuaaauccucuuaugaccaaagaacauuuuacauuccauuuaaucacacaaaagaauggcauuugcucuucacugggagaauuaauucccugaacucucccaggcagcagcaugauccagggcaaggaguuuggccccgcagucggagcagcucagaugcagcauggucuugagggcagcagcuggagccaggcaaacaccagcaggugcucguggagccagcuggggacccugagcuugccaugcacacagcuccggugugaugcgguucucagagccguggggggcagguagggugggcaccaucaccccaguguuacccaugggaagcgagccucagagcccaucaugaugacugcugcuccagagcccgucaugacucuugcuccagagcccagccacuuuguccuguuuccucuugcugacacagaccuuggcuuccagcucggacuggugucuccuccccaaguguauaccauuguugauuuucccuugcugugcuaaugcaccgugccugaggaucaucauggcaugggccacccccugcugugggacucaggguagggggugaaccucucugagucugucagaggaaaaauguccagagucuuccugggauuucagaugggggaucauccuugucaaaugcuccacaauaggccaggugcaguggcucacgccuguaaucccaacacuuugggaggcugaggcggggggaucaccugaggucaggaguuugagaccagccuggccaacauggagaaaucccaucucuacuaauacaaaaauuaaccagguaugguagugggcaccuguggucucagcuucuugggaagcagagguugcagugagccgagauuguuccacugcacuccagccugggugacagagcaagacucugucucaaaaaaacaaaaacaaaccaaaaaccaaaaaccaaaaaaagcaccagaccaaaccaaaccaaccaacaaacaaacaaacaaacaaacaaacaaacaaacuccacaauagugacaauuacuaauauuuacugaacucagucagggcccuagauucucucaaggcugguuuccccuaccucggcccuggcaaaggggcaagaggcacauuccaugggccaccugggguaggugcaccccaccagcccugcggaggcaccguguucauaucuagcugguauugcaggacgcgcuccccgccaacgccacuggcaucccacacaacugcauugggggaccaggaaucaggguuccuacucuugccccuucuggugaagcacacccagggugcuaacucagccacaggcugccccaugucccauugacauuugcaaacccuccugggaugaauuucuccauggcucucaggagaacaugucccagggggccgcccacucugucaguggggacggguguuucuagguuggauuuuuugcucuccuaacaauuuggcaaaaguuguuuuauucacaugcugaaagcugcuguugggcuaaauuuaacuacaguguaccuuccuguuccuucagcaguuccucccucccacuggagggggcaagaaaagugaacgaaggcuaguuuuuuuauccuuuauguaaaaaacaacuagaaagcccuuuguugaagccagccucagagugggaaacacacaccugacaacugcacguuuaaucacacucguuucuacaucgcuaacgugggcuaauuaguuauggauuacaaguacuauuucucuuucauaaacuuaccaaaaaaaccucucccacguaugagcaaggaaucugugaaaaagcuuuagaauucuggcuucguauguucuuggggguaaauaaauuugugccaaacaccugaaaagcuuuccuguuaauauauguuggcuuucucacuuaaaaaaaaaaaccacgucuuucuuccuuagaauguuaguuuccaaaugcaagaagucuggcgugaagcucuaauuuugcucuacccagcccagcucuccacagcucagcuucugcaaagcacaaagcaaacacugggacaacuggcugaaugggaccccuaccucacaccauaugcagaacuuuacucaaagcagaucaagaccucaaugucagagcuaaaacuaacauuccuggaggacaacauaagaauauaucuucaugacccucgauuaagcaaugguuucuuagaugucacaccaacggcauaagcaaauacguaagacuccaaauuaaaacuuucaugcuucaaggacacuaucaagaaauugaaaaaacaaccacagaaugggggagaacuauuuccaaacugugugccugacaccaaaaagccugggccccaugacccaggaagacccucaacucaagcacugagguugacagagcugaaaugugacuuguggagccccaggauggacacuggacacucaagagcaaaggccacauuugaaaguagaguuaaagcaaaauagcguaggggcccauugguuguuuuuauggccaggugaacauggggccacucaccuggucuguggaaucugcucagguacuuaugcccuuggcuccgcaaaccuuccaggaaaauaggaaccauaccuuggccaagaucaacagcuuuuaaagauuucagaggagcaacaaucccuggagggguuuaggaggcccugagcuuggccaugcacagaguuccaggugugaugugguucucacagcacuggguggggguuggggggaugggauggggacagcacagccacacaaaacuauuaucuagaaacugaagcuauggccccaugaccugcuuccuggaaagcagaggguccgcuggccaagaccucccuacuccauguggaacugcuuucuaaaccaggaagacagaacgccccuguagacaugaggaggucagucaacgcgggccuuguggagacagacagaagagggucuggugacuggaacgcgggcagagcuggccaaggucccagcagcagucuuggcugacauggccucccaugaaaacacgggucaaucccuuuaaaccaacagcaagcgccgaccucauucaccaccugcucugaguccugcaccacgcccggcagaaaucauuugucgaccucuucccccuuggagcucuccagaugcggcgaggagcccagccuguuacgcacaaggccugagacucacgaccccagccagcugacaccaagcauccacguuacucucuggccagacuccuggucagaucacccacccaccaguguggagggggucugcgcugucgagggggacacacucuaugcaaggugggcuuacagaaauucccagauacucacuuuugaaaaaaggcccacuaagcuuuaacaagacagaggccuaggagagcagucuuugcacaaaacugaggaccacagcagggccuucuucagcagcuuggccgcugucuaguugucccggcauggcucaccccacguccuccauggacagaaugaaauccacacccacggggucagaggaagugcugugaaggcggcagagcugggggacaaguuuggccccugagaccccgagggccucaguaguccagugugagaagaggccaagggucaaccacgacaagaaaagcgccauuccccgcugaggccaggcagcuccaaccucaacacacaagcccucucuuccuucucugcucacugcucucccagaagcagaggaaacagguucaagaccuacccccuuugacagacauggaaauagaagcacagagaacucaacauacuugcccaaacacaaagcagguggcacuccuucgggccaugcauucaacuacuuuaugcuccugggcugaaaucauauuccuggggucuacggcacguccaggagccugaaaggggaccaagaaacccagucuagccuagcagaaugagcuccaugaacaaagggugaggccagguucaggcacucgcugaguucagucugguaagggggcacaaccaagaugcgaauacuucagggcagcaacgggcaggagggaugaucacugcuguucugccaugaaggcggagggugaucuggcgaggucacaagaagggcugggagucucaggaggucaggcaucagucacaaccagggccucagaggcacagaggccaguagcaggugacuugcccaggggcacacugaaugcagggaacaccgggccaugaaacccaaugacugaucaaguacaaaagccaaacggaaggcccgcagagcucacugaugucggguguguucaauguuuugcuagaaaaggcugagcugucagcaccugggaaccguucagcugcucuuggauuuggaagggaggccaugccgagguucuugcucuaccaggcugggguaggggcagaguccuggcuauguggcuccacaaugcuggaauguuuuuacuacgcaggcauagauuacucugcaagaaaagagacgccacagggagucucaaaacaccagucaggcccuuagcugcccuugcacacgacagcucacgcacacacuuccaucugccccacgccggccugggcgguggccucuccccuggccccagucuggcugcggugcugagcucugcccuucuccugcuucccugccggugcacacacaugcgcuguagggacgcucuuccaagcauaggaguggccaagaagcccuggagcuccaggugcuccacaggccccaucuuggugccugcuauacauagucacaguuaacuguccuuuuaugaauugccuuuccuggcccccagaccagagagcaccuaaacacaagccuugggucuugcccaccugggagccccaaacaucuggccacaggccuggcacauagcaggggacaggucaaugaggaaggauggaaagaaggaagaacagcagggguacaggucaaugaggaaggaaggaaggaacagcaggggacaggucaaugaggaaggaaggaagaagugaacaagccucuaagcucacgcugggcucugcccagggcaguggucuguguccaggacucagggguccugggggcagcccggaagagguuuccuugcucccuuacaacucucucuggcuggacugcauggccagcacacaggaagggcuggacucaucccucugcuggucugcagggccagccuggggucacagccccuggaccucacccccaaauguccuugugcucugagaugggggaagccugccgaagguuuaagggucaagacccucaagagcagugcguccucugccccaggacagaccucaaggugcagaggagucucaaacaagaggcaaggcugcuugaggacucagcagcaggggugugggccgauggcggcgacccucuauacagauucugauagggcuaaaauuauugauggaggugcuuucuaccuaggagaucagcguucacaccuccaguugcuggaaaccgaggccacacgaaaagaagccaugagagugaccagcucuggugacagguaacugucacaaccaucagccuccucaacagccccuccacacagaccacgcgcuccucccuccauccuggaguccucaggcagugacccuaagcaacuagacaggggucacaugugcccccauuaauccaguugcaucaagaaaaacggcuggaagaaaauggaaaaagcucagaaagaucuuuuuguggcucuuugggcugggacugcguuucucacaucugaaacuuugcccccaggguguguccugagcugagcccugugcaggcugcaggcuuggcuguauuuugugaagacaaagauaugaaaauggccgcagccccauucguucguuguuucugaugaucccugcugcaucuggugcaggcagggcucgggugacagcacgugacacggggagauugcuggcucgcagccaccgccggagggcuccgcgacuugugccauagccggccaggucagccugagagcgacagccgaccccaccaccugccaggugcugccacucacgcgggccuggagcccccauuugucugugucaccggggcuggugggccgcacugggguccccgcagcauacgccuuccucacguugucacucuggacugcuuggccagcaaacuggacuagaaauaggagccuauuguguguaugcacaaaacccaccaagauaaggcagguaguucguggacugagaaaaagcaaacauacauuaaaaauagccaaagcauccgaaaauaaaauagauacugaaaacaauccccaaaccccaaaccaccccacuauaagcagugcaacaccgcccaucccgaaggggagaagagagucaacuuccagaagggcguuccuugucccuccgaugggagggaagcacuugaguuaggcggcaccagaacgaagaugcguucaggcuggcggcgucccaaacaagcaacacuggauuuccagauggccgcguccuggaccagaggccggcgggacugcccagccugugcuuuccugaaaugucaacauuauccuccacacacacaccgucuacuuucccugcuggcuccgacagauccaaaugugacugcggauucuguggaaccuacuguacaaaacguacagccauguacacagcugaagcgcuaccagggacgccagccccugcccccuucccgacagggugugggggauaaugccacaaucagcauacgauaaggaaugaggagggaaacugcagcuaugggguggaucauuuaacagagacauuugauuugcuggcuggcuucugccugcagacuucccuggcacuggcucgcugccacgcaaauuaaguaaaaaucaauauccuccggucuguaaaacaucguguuagcaaucacacugcaaacaacuuauauaauaccccucacuccauacccaaauaauggcgaauguuuuuguuaaaaggcaagucuaaaauaaacaggaaaaagaaaagaaaagaaaaggcaaucuuacagguuccuccuucggcaaaaccuuuccacgacuugggugaggagauaaucuuucugugauuaugaccaaacccuccugucacuuagcaacacauaauuaaggaauauguuuucagauccgcuuugcaagcccggccauuaucagaugaaauuacuggagcaacaaaugucaucgccaugcaaaucaguugguugcaaagaaagaauguuugacugagagagcaggcacaggcccucggaaaaauuaucugacgucccuccugccgcacauguauuugagaaagucaaauaaugaugugaucagacuucaaaaaaauccaugagacaaaaucagaaucuauacgacaaagcagaaaaucaggccaguugcucagucuccacuuggaaacaaaaugcaaaaugccuggaggucaucucuaggagguaauauuaauagcacacacgggccacacagcgauggcagagaaacuuaagguggucucugcaggguugugagguccagcgccucgguccccgccuacagcugcuucagggcuauuuucaaaaagguagaucuuauuguuucauccugauuuucacaagcuauucaggaaaaaaaaaaaucauuugaaaaggauucuguuuucugaaugacguaggggaggcuggcggggaggaaagaauuauguuugaaaggaagaaaacugauuuacauuuuaaauuuguggucaagacucuagaguuaaaauaaaaauuguaaauggugcucugaggacgcccaccuaggacuucauccacaauguccaaggaaacacacgccauaaaucacaccuggcacauguugugaagaaaaccaccuaccaucacucucccuuuccuggacuuggaaauauauccuucccuucaagcacgcggaauucccaacuguauuuucugauaugagagacuaaaucuguuuuugaaacugaguucugagggauuucaacaucuugcuuuguuuaacccacaaguaugcaaacacacacauuuucaucuccacgguggguaaucacugccucugauacggcgugcggacccgugagagguacguuuccacacgaucacgcccuucuaaauggaggaugcacacuuuacagccagcauuugaugaaacguuccugccuucuccaaaguucccuagugugaacuacagaaagggccaccccucgugagcucaaggcugcagucuguucugagugacuugcgacuuucuccaagaaacacaguugaguuuuaccaccguaaugggaaaucuacacaucaacccgaccucaacuaaagaacaggagggcacugcugccccagcagaucuggccugacacacaaaucugauuaacuuaagagaagccgugucaacuggccacagugcugcguccuucuuguuuggugguguguguguguguggccuggugagugaggacuugccauccuauguucaaacuucuacaaccccgcaccccccugcuccccccagguccccaggcagggcaggcggggaggauguauuacuugguucuggugcaagcaugguggacacgaugaugggugccccugugcgccgggccaccuucugguacggugagugaggcguguggaggcucuggcuggccggcggcaggguggauggccccaggggugcaccuggcuuccgcaagaccugggggcugccgugagggcugggcagcggagaggcggccacguugcgcucccucuuuagcagcuccaugggcaccguguaugccguggaguaggcuguucuggggccugggugaaggggguuugaggggcccggguuagucaaggccaccccugccugcaggggguacguggggcucagacgcgcugucagggcgcaaggggugggagagcuguacccggaguuggaggggaaguguggggcaugggugcccacgccaggggcagaauagguggcugccgucuccaggaggugcugagauggugcgcuggagggacggcgagccgggucuccagcucggggggaugcugucugcagaggagccgcagcgcccagagaagccaagucaccauggagcaguucgcuucgguggcugaagcugcuggaccgcgcccggggcagcgggcccccccgguccugccuccgcagcugcauuucgguccugcagcuauuggccaggcggcucagaacacgggccuggcccagguugggugcgacagacuugauauccgcguccuccaggguagccaggacggccggggagucaaagcccugcugcaguagggcucccagcguggccucugccagccccuccgcccgcagaaaggccaggaacucagggagcacgguccucuugccaccaggacccuggaagguggacaggucagcuucguaagucucguaagccaucuuggaugggaugcuuucccgggcaggcccguagccacgauucagggccccuggggccaccccugugcugccuucgggggcagcagcugaacugggguccacaaccaggcacgucggggccaccugucuggcaggggcagggucaaugggucuuucgcugaugucgcugaagaccuggcugaggggguaggcaggcaccuccgccccauaccuggugucgggcugcucccguccauaccgcccgggagaugcagcccugcucugugucugccgccccugagggaucauuuuaccuccaggaucccgguacaggugaccggcguccugcagggcaggugaccggccuugcauuggaucccaugacguucugcugccaagcacuccguagcuggggaccggccggcugacuccugggucccgauagaggggaggcucuuuggguacccuagcagcuccagacggaucacuguaguacucccguggcagcagggggcugcgaccagacaucacugccugucugcugucguagaaggugaagucaggaguagaccccuuucuugcagccacugaguuauaaacggccucccgguacagguagggcucggcggccacgggcagggcagcguccuguggucggugguuuggcucaaaccaaguccccucugcugugccauacgucagggagcuucuccuccccagaggccgcagggacucggcguucucccaggggcccucguaccacccagcagcaucccagcucugagaacgaccaauauuuauaugccugcugggaacuggcauuggaaaaaaaaugacugcggaugaggcagaggagaagcuuuucuuuauaaaucuucaauuacauacaucaaaaacagaccuggcugugugcuaacccuuccgagacggcagggacaaccaacuggggguuuucuguuucaaagcauggccugaauuauuaauccuccgaaaccuuagcagacaaaacauaagacucacgguaacuuugccucacuccccaacgauagccagagaggucuguuccuuacagcucagucccggagaggaggcuguccccagccugccaggucccccuuccuggcuggugugcucacauggaccagggcucucucagcaugcggauuaggagcuaaauaaaacccuaaagcuuuguuccaugugacaucucguuagacugaugaagccgguggcuugcucuauccagcccucccaagcugcaacugggauuuacuuccacacugacgcucagguuuauacucccucuuccaagcaccaggguacuuuuaggaugaacccugccucccccucuggaaggggcuguucccaccccugccacugauuccugagagguaacagaagcaaaauaaggcugcuucaaugucaguccacucuuaauccaccgugaugaaacguuaauccauggcacagcuaaacacaaauuaaacauggauaaacagaaaaagguccacacgugauccuaggccauggaugccuagcccaaaaaagggccagcucugaaaccugaugcuuugauaauacugagaucuggcuuugagacgacucuuugguugugaaucaaacagguuuccgagcucaagcccaaaugcauucuuuaccuuauuacugugaaacacagaugggcucaugcugccggggggccggggagugccagggaagggcguguguaaucugggauuuaaagugacugcaacagaggucacaggaacaggaggaugggugacuaaaccuuacacugcaaagcagaacugggaagcggcugcaucugaauaucucaucuuccuuuagguaugucaggaugaaaagccuaauuccagcaggcuuagauccugcagaugcuuuuccauauucacauggauuaagcuuucagaguccacaaaggacuucaggcgcaauaaugcaaagaacagcaguuauuuagauaaaggagugccccgaaguauuaagacauuuccuuaaacauauggaacaguaccagagaagcaacaucccagacuaacacgguagguuccugcccugcaacugcaggauucccaugacaaagaauucauagcaaaaauaaaagccggugauuaggaagcuacaaaggcuguauacauugaaagcacuuuaaaaugagacaacaugcauaccugcaagcauuaaacccgagugcuguuccucacucacaucucucucaaucuagcacucuacuagaaucuucuaaagagaaauaccagucuuuaaauuuuuuuuuuuugagacacaguuuuuuuuuuuuuuugagaccgaguuuugcucguuucucaggcuggagugcaauggcgcgaucucggcucacugcagucuccgccuccuggguucaagcaauucuccugccucagccucacaaguagcugggauuacaggugugcaccaccacacccagcuaauuuuuauauuuuuaguagagccuaccaugucucuacucuaucuacuucaccauguuggccagacuggucucaaacuccugaccucaggugauccacccaccucagccucccaaggugcugggauuacaggcaugagccacugcgccuggccagcgccucaggauuaagccaccuugccaauuucuuuccuccccuuguuguaaugaacaacaugaccuuaugugguguuaguacuaugcuaccccacucauggugcaugcacaccccucaaagauggguggauaaacuuggagcauuccgggaaaaucccccaugccaagucuuuuuuguagcagggugagguagcucuguugacucaccagcuucuuugcuaucugguuuucagcucagcaaguucucaaauguaaacagggcucuauagaagaauguuuacccgguagcgccuaagaaaccaguaaugauucuucagagagguuacugagcugguguccaaggggugaucgcaggagcagggcagaugugggcagaugcgcuuuggggcagcaucagccucccauugaaccaggaggcccagcuuccauuucuaucaacuuucaaccuguucugcuuggaaaccacccaaacucgcacagccuuggcucugagauuugacaaauauuaugacagauguuuuccugcgcuagguaaaaacaccuguaacuggacucacuuuuccaaacacucugguuacacaaacaccacacacacacacacacacacaccacacuccagucuuuuagaaaggacugcuuuucuuaaaaauucucauguugacuaaaagugagaugggacccauuagaguaauacaucucacgggcuuaauuuuuuaauucugccaaaacccucacuauagaaauuaugucaaguaaaaauaagaugauuguguaacauagcugugucggggagagaggcgauguccacccaaagccaauucugaagucccugugcgacacaaggugucaauuaacaacagagaccuacagagauccagacaauuccagagauggauccagacaguuccagaagagcugggaagagaggccaggauggggaugaucaguggguacccuccgacggagcagucuuuggacaaacugccaacaagcauuucauguucccauuggaauaaucaugcaggaaacugcuugaaaugagagagaaaacaugacucuggggucuaauucucacuuuuauagaaaaagaagaacaggugggaucagugagucugaagguugcaguaacaugagggccauuuggcucaauggugugucccucuuaacuguguugucacccgcccacuuggugggcugccagguuugucucaaggccuucucagggaauagcucauucucaggaggcaacuuaaguucccaacugaaggaacuuaaggaacagcuuccccagggggguccugcaccugccugggcuuccauucccugauccugccuccaccaacacaaagggccagggcagcucugaaggugauagcggaaauaacaucucaggaggcucuucagcgccugcugcaucccaggacggagccaccacagugcccucuacgucucccacagcgagcgcuucccuagggaggcugcagaaguuagcggguaacacgguuuucuggcagacacagggcagaaaaaucggccuauggcauacccauuuccugcuuuuaaauguggacagccugugcuggauuuuugucugcuucugucaaguuaaguguuguggaauuugugccauuaaaaaaguuuucuugggccgggugccguggcucaugccuguaaucccagcacuuugggagacugaguggggcggaucaccugaugucaggagauggagaccauccuggccaacauggcgaaacccugucucuacuaaaaauacaaaaauuagccgggcgugguggcgggugccuguaaucccagcuacucgggaggcugaggcaggagaauggcgugaacccgggaggugcagguugcagugagccgagacagaaccauugcauuccagccugggcaacagagcaagacuccauuucaaaaaaaaaaaaaaaaaaaaaaaaagucuuuccucucaucaacccccuacccccugcccccgaacguccucaacccaaaguagccaaguuggcuaaucuaacgcaaagggugggaggccacaccaaaugcacugguuacauagcaaacacaaagucuggcuggguuuuaaagcagccuucgucuaaaucacgcaagcacacagcaacaauuagcaaaacugcccagacaucguuucagguaucaaaggggcugagugcaccgugcacccuugcuugcacacugagugcucucaccaauuucugggccuggagcgcggaggcuugggcacccacgcaacgcgccaaaggaagucaggagagugacgucgagugucugaaccaacccagccuuuuucagauuagcugcauccuaagaagccccaguccucaugucucucaguauuuagccaugguaagugaaaacaaaggccugcacauugcuucugacucaauuucuuaacuauauuguaaagcuuccugggaacugcauuaugaaaauuagaccacucauuaugggguuucaaaagaaaaaaaaaaacaagcccauucucuugcacugcccauuuugaaaguguugguggagccaaagugugcaacgggaccccagcugggaugcaggacaggccucaccuuggaccaugucaggauucccauuucuagcaauggaacacacucaaccucaagaggcugugcucagcucuggacagcacccggcacaagacgcuccgcacaguaggugcucaaugaacaccaccccuucugcucuuuagcagcuuuuccugcagauucccaaagucuccaccucaccuccauggugacccgccccaucacacuccacuguuugaggucuccucggcuguccugcgaucagaaggucccaggaugccguccuuccucugguuuugugagcaaugcuccuaaucagggcuggcucagcgagcccucccccaugaaccuuucucaguccaauucugucacuuuguccuuaguccaaaaaaccugccacuccucaagaugagaaaggcaccccaaaaauaguccagggcaugcaugugccuguagagacaggccaaggcauggccgcuuagccccugaccugcggagcggagcgcaccccucccuccacagcacgugcucccuccauucaucacgugcuuuucauuuuguuugacacccgggcuguaaaucaaacugucgacuaugacucaauggugauggacggcuggccucaagggaguguacggugugauggggaaaaacgacagagacauggacacaguccccagaagccccuccccacaaccacuucagcccucugagccugagcccacaucaaagcccaaacagccccauuugcaagccugggcaugguaggcacuaagcuaggcaaagcacccaccgcccaaauacaaauggcugccugacagagaccugcuccaccugagccugcacacggacaguuucagcacacgggccuugaugggacggucagccuuucuuaggauacgaaagaacugacucucagccucacucccaagucucggauaaaucugcgucacccaucccagguugcaaaugggaagggaggaacccuccuggcacagacaucucuucaaccggaacacggaaaacaaaacccucaggugaugagaaacaggcuggagggacagggagugugggaucccacugugccccagcgcuggacacccagaaugcucuccccucucggcaucuucacagcccagcuggggugcucagccaggcuccugcuggauguggaagggcugagaaaggcacgugaggucacucuguagauggagaugagacagagacagaggaacgcccucgagcgcgcacgccaaggugccugagcuuuaguagcaagcgagccaagugguagaaaccaaucagagaggagucucauuucacagcuuuaacacuguacguucuggaaaaggagagagggcaagaagccggcagcaaaauguaucuugggguucugguucacagucaccccaaauaccugucaauuagguugagcugugugaagcgcgcagaagguucuccgcauucgugcgggcugcugucugcugcugucuggcuacccuggggccuccuccaaacacggagacuacggaugcacuguuccccccgcggcacuccuucccccugcccaccccaagcacugcuccccucaaggcacugacuuggccugaaacuagagaugcucuuuucccaaaggugccgggaccaagaggacaggcacugagaguaaagcccugggcagcugggcccaggggcuccgggccacacugugggagguuucaacucaaucaucgauggagacagggcaccaccaaccaggcggugggaaacagcgcgauucacugugguaggggcaggagcugaaaaccgcagcugcagaaccaaacuagaagacggugaugaacccccaaaccccagccacagacuccaguugcacuacacaucccuggccccccaaauaaaagcaaaguggccuuaacauguugcuauuagaaaaaaguggugaguaugaagacauccgcccaucaccaaacugaccggugcaaagagacgcuuauguuugugcuugagaaaugaguaacaacagagaaauaaaacaccgaaccugauucacagcugcagaacgggagggcagucuaugaaccccauccccagagucgguggaggaacagguggggugagggguucccuggggaggggucccccacucugaguuucucuuaaagccggggacagauaaggcaaaacaugaaacuuuaccccuugcaaagaaccgcacuuuugucugugaagcuuugccuuggcuguuuccugaaccuuuaccuuugcauaagauuguuuggguauguucauuugugcuuugggguuuuaaggcaugucuaguugacuauuguauauuuacauagcuaauguaauuacagcuaaucacauaauugcuggaaaugugcauaauugccugaucccaacauauaauuauaauguauagcaacauuaugaaucccauuuuuaaaauccacauuuuggggcuauuuaaaguuauuuauuagaacuguuuguggacuaccuauaggcaggcuucaacucuguuucuuuacgaagcgcucaaagugcuuuaaaaaaacaaacaaaaacaaaacaaguccugauuuuauaaugcaucuguacaaagauaggugaaaagaaaacagcuacucagaacaaaaacaaauaaaucuuaaauaccaaacaaaaccauuugucaacacucuguggauuauguucuuuccucggggaaagagaaagucacucucucauccuggaggcucugauggguguuugccaggcaaggaggcugcuggaagaaggaaagagccagagggacuucuagaccacuuggguaaccuugcugacccuggaggcgccugucuuuguuccuuauacguauggaugaccuuucuuggggguacaucccacugacaugugcuuccaccauggcaaguucaacccacugagaagagcagaagagcccgcgacacagaagagacccacuggggaaacucccuuccaccucauccccggcagcaucuucucagacuucucauccuccugcgacaaaggugaugcagaaugagauucccagacuuucuaacuaucuauguguuucacagaaaccagcuugucuccuuuuuccucauauccacccaaccagcucaacguucucauuccuuuuauccucuguggucgugagaacauuccagaggugcggaauguuucaugagcuuguuuauuuaagaggaggucccuuuuauuuuugcagaggaaauggagaagcacccucccugagucauguuacaaggggacuacucacaacucagcugauaccauccucgggggaccauuuuccacgucucuaacacauucgaacaaaacgcaguaaaacgaaacacauacuuuuuucaaguugcaaucgcaacagccgcaggaaaggggagcaguguuuacagacugauucuaucauaauccacaagaagcagcucuaacaaaaaguuaccaccaacaacagccauugugguuuauuaaguucuacaaacccagggcucugcaagaugcucuucuggguucccuuugcaaugcugagugauuguuagcuagcccucauuuccaaccaauagauguuuggggcaaaccaaaggagcucuggcauaaugcgauaaaguagguacuaaaacccuccagcuggugcaguucacaaugucaauuaugucagcagacuaaacagauaggaagaucuccauuauacuugagaaugaggagaccacaaucuuguucugaucagccuguguuacgagagggcuccuucguaauaauucuuacaugguauuauaggauugcuugauagcaggcaucagaaaaaaaaggaacaauuauaaauagcaaacucaaagaguuacauuaaaaaaauuaaaauguggcuuuuacauuggcuagaaagaccauuauuccagcucauuuggcuggagucccaaagacugucuguguccugcucuccgaguagagacacagccuggcggagugaauccccacggcagauucugggcacacagaaggaucaagcuccaugccacuuuuucuugcuuugaaaaguuucaaagaggaaggggcuggacaggccuuagaaaacagggaaagguuguacaaguaucugugcaggggugaugcucagauuccagcggaguaccuggagugggacccuggagaggccugccugauuccagccuagggacccacgaccagggcuugauguuggcauuguguagcaggcgggaggggacgaauuuuaaggagcugguguauccagacaccaagagcaggaagacaaaguuccuacaagccugggagcagaccggguaagcacagcagaacauggcagcuucaugcuuuuaaucauuuagaaagaaaaaaaaaacaaaccuaagggacgcagaagucccugugucagguguaggcaguggggagggagaaaaaaacaguuugacaggcucucugcauaucaauacagaacauucuacaaguaguugauagaauagaaacauggugagaauucaaagcuagaggggguguguguguguguguguguguguguguguguguguguguguguguguuuguguguguuagauguucaaggccuucagguggaagaaagagcugaauccaacaagcugguaugagagaaggccaaacagaaaaaaacagacugcccggguuccugggugcaaacugccuacugcucaacgccucucuggcagcaccugugagaugggugccaccuguccugacccauaacaggugccacaaggacuaagucagcuuauacauaggaggagcaccaacaaagcacuugggaccaacugugaguacuuaaugagaugccuagggagcugacauauagauggugacccacacuggaguaacugcauuuuggccugucugcguugauaguuauugagaaauuuaaaauauauaacugcaaauguaucuggaacaccaugcauagacaagguaaugcaaacuucuguuauaaaaaauuggcugaaaauuuccuauuacacaugaagggggugggaagguuggugaaccauccuucagcaccugucuggaugggacagagggucugcaagcagacaaugguuuugcccaagucagguuuauacagccauggaaacacacagaggaaacgcugcuagcucuucaaucccauucuaguuucugaugcaacaucccuggagaauccugggugcaggggguggagucagccccagaggcauuccugcuaguaaccuuggaaagcugagucacgagcguguuccagaagcaaguacucaguaaccucaaucaagcaccuuuacaguggaagucaagaguaaauuuuacaacuccccauacaaucuggugaaccuauacuguggaauagucuacaaaucaauggggccugggcucuucaguaaguccaaugucucugaaagucaaaaaagcccaggggauaauuuuagacuaaggagacuagagagauguaacaacuaaacacaaugcgugacccuuaucuauugcacaggcaaagagacguggaggaaaugcgaauaugcagccuauacuagacaauacugucccugagguuagauuccugggguucauuccgguacugggagcaguacgaaauuggauaaaaggugccaugccauagguaguccagaguaaagugcugccccugaauuuuuucagaugguucuggaagaaaauccaucaucuacucacacagugucuauuuauauguauaucucuaucuuuaucuccccucaaaagaaucuggaaaacugaauggaauauugguguucacuguaccauccuaccaaccucucuguagguuuuuauaauuugugaauguuuacuuuaaaaaaacccuuuaacgccaaacuccuuauacugaaccccaggaaugucagugcuuuuguguucuugcagcgcagaguucugugaggccauggagucacucagcagaaugucuaugauguccccaccccguguggcaugagccacaucuacuuauaggacagacaauuccauaugggcagcugcaggggaagcccuguggguugcauauuccuguccacaaacuggugggucagcuacuaaacuucagcgugugcgugaagggugcagagggggcugcggagccaucuucgcuucccuccgagagccacccuguagggcaguaccagcaaucacccugagcaaagagcagcccuguagcacugaccccaucuggcaggugcacucaccccuaaacccgaacccacacgcugguuucuuaccacccgcuagcuggaagagcgcagugcuuaaucaacacuucagaguuuuguccccagguuuccauuagauuuuaauuauguuuauuuuuccuuucaugaacagaacacuuccagacauuuccaaagauaccagggacaugaacacaccacgaggggcaaugcugggcucuucaggaaucucauaguaucagggaauucagcauuguaaauaucuuaauccaaaacagguaaaguccugagauuucaggaagugaaaaaagaugguccuaaucaacaccaucuuuuauaugcaaaauaaccuuagguacauggaagacauagaccucagggcccaccagcccugaaacuguccuccuaguccccaaccccgccccagaagccaggccuuguccuaagccaaggccaggcccacggccaaggacacccagcagagggugccaaugguaugcaguguuggaaucggaggagggacucuggcuuggggaguggcacagccaacucaagggagcagccagcgaagauuugagugagggacuacguauguuugguaaaaaccgccaaacacgcucuuaccuucacaaauucuguccaaucgcugucucuugacuuugugcuuauccacaagggccauucuuuauggaacuuugcaacucucagaucaaaaggcaaagcaguccucuaagaacuuaggggaacuugcaggagucugcgugcaugacgccacuaugaacccugaaacaaggagaaaagaauccuuacucucuggagacccucugggcacaggacaacagcucacuggggacuuaacugcuacuuucuauaagggaaccugccaugcggacacaugggacuugcucuuuucccaaagcacugggaauggaggcugcaccaagugcaucucagccgccuccugcuucuuaucucauaauagaaagcaagugaaugcacacaagacaaucgucaguuauuucuggaagcagcaaauuccaacagaucucuugcuuuuaacuuuagggcuauaaauuccaauuuacugaccaauuugaaguguaauaaauuauauuccaguggcagagaccaagugacagccaguuggaccugccccaaacgcacucacacugagaugcagacgcacaccguggcgacucgaggggcucugcgaaggccugcugccaggugaguuacaacaaugcuuuccaaaacagccgcgcaggggucaggggucaaagccacagcucagcacaacacaaaacccugacucuaccacgugagaacgcgggugggaagccccagcagcuccuaaccaacguuccuccgaugccgccuuccugaaccuuccuugcagcuggaggggaccgcagucagcaccagcaagggcagggucccaggcugcuggccuugacacuugguuccagcuauaugggcugaaguauuucuuagugugagaguguaaccauccccaugacguuucagguagaggugaggcugauggaggaggcaagaaaggucucccaugugguuugggguaugugggauucucuagagggagaccugacugcggccuggggaagaggagcugcugcccauccuccuucucaggaggaucugagcacuuuggaagccucugacugucaccaaugugcccggugagguccagaucauuaacagcuguccccaauaucccagcuuuuaagucacugcucuggaacugcauucuuuacauugauuaaaggaggcuuaaugaaucuuggccaggcacgguggcucaugccuguaagcccagaaguuugggaggccgaggcgggcagaucaccugaggucaggaguucgagaccagccuggccaacaugguaaaaucccgucucuacuaaaaauacaaaaauuagccggguaugcuggcaggcaccuguaaucccagcuacuugggaggcugaggcaaaagaaucacgugaaucugggagguggagguugcagugagcugagguuguaccacugcacuccaaccuggugacagagcaagacucugucuuuaaaaaaaaaaaaaaaaaaaaaaagguggcuugaaucucaacugggaaacaacauuuaaggcccacucuauugucuucuguauuuuuuuuuucccaaggaauacaauuaaaucagucuuauuuuaagaccaccaccacaaccacauacacacacacacacacacacacacacagaaaaagugguucucagugaucuagcagaaagaaagaggagagauaaagauaaaaaugaggcccaagggguagaaaugaggauaaugauguacggucaucaguuaugcaaaacauuaagaguuacuuuaucaaaaggucagacugcaggucuaccagguuucuguaaguuaacggcuaauuucccagcaacgaagcugaaaaggcauccgaaagauuuauggcgauaauuacgugauucuccauaaaagagcuacgaaaaagcacaauuuccaaucacauaaauaauuaauguaacaucccugagauaccaaacccuuucaacgauugggaaguucccccaaaacggggacugaccauaucggaucagucaggagauggagguugucauagaaugugugggguuacccuugagcagauccauguggacguauuuuaaaaauugguuuugcuaguguuggcuuuuuuauuuuuggugagacagggucuguucuucacucaggcuggaaugcaggggcaagcucauggcucacugcagccucaaccucccaggcucaagcaauccucccaccucaccuccuuaauaggugguacuacaggcaugugccaacaugccuggcuaauuuuuguauuuuuugaagagaugggguuucacaccauguugcccagacuggucucgaacuccugaacucaagugauccacccaccucagccucccaaagugcugggauuacaggugugagccacugcgccuagccagugcugggcuuucugaaagguaaccacacaaaaaaagagucccuaacuauagccaacuuaagaguuauuggagugggggcggggggccaaaccuauugaucugagcuuuuguccauccccaccccccccccccccacccacaagugacucuaggugaggcugaccagggaggcucgggccagcaauugucauuugcucaggcgcaagcucugauggucaaacugcagucuggccccuccuugacucuguuguaaaaacagauuuccacaucagcugcgucauccaaggggggaagagaauuaaucaguuaauuuuugugaagaccucggagaugaaaaaugacagcauuauaaucugaggcaagggggguuucacacccuccucccccaacccccgagugaggcguaaucauuccuuuugcuuuccuuugaauuuuaauuuguauaauuagauggcuuccugaaaaauugauaaguagaaucucaaucaugcaaucaaaggaaagaucagccaucagcuuccacaaacgccaauauuccacuauuaaaaaaaaaaaaagaggcugacucccaugucuggcuuuuuugggggugggggugggggaggggggucacucuguucuggaccuucuguggguuccuuucugcacaccccaggccaguggcaccgacccauguuuagggcuggccaucuuggcucccaaggccaccagccucugggucuggucugggcagugaccauugacuuguguagccucaauccucucccccgauaucucuugugcaaaaagaauguaugaaaugugacauuuuccuccuuagcccucccaaggagcaagcuauuuacgaggacuuaauuaacauaaccaucuuccaaugacagccacaggcccuccuuagagcugagcugcacacagcggccuccagcuggucuccaugcugagcaagccagcacccccgauccacgcuggcucugggcucccugacaucacagcucucuuggugaugccugcuaugaaaaccaggcuccacucauaaaucaauuuuuccccccuaaacaccaaacaauacgggcacaaauaaggaaggaacaaaagcagagggaacguguuucacuauuccacuucugcugaaauuguuccucaaaucaugccaggggcggaaucguggguggagggaguucuagaccccacucguggaaugagcuuggaugagcuguucuggagacucaggcuccuugucuguagaaugggaugucacugugaugucccagaguggcagugaggaccagccagugaggauaugcacaaaaacacucggugggagccugcaggucucugugagcugcuccugccuuuccuuugacacccccuugcacacucauccccgcagcgaauaaucauucccuucuggcugaggcugggagguaaaccucagugaaggucaaggucaacaggaaagcuguaucuuuucaaaaggaagaagagugcccugaagccaaaccgcacaagaaacacuaccuccucccaaaaggaaaguuacggguaucacaggccaaacuccaaccaaagaucagaaacguggaccuuaaauuuuauuugcuuuaagugagggcugugaucuagggcugaaauauuuggugccaagaaauucaacucauuucugaagaugaacaaggcuuggaaaagaaagccacuuguagauacuugguuguuuccagaggggacggguauggaagauuuguuccguggagguaucacagagaaugugacauuuuugaagacgugagagaacaaaaaggaaaaacggcacauuuuacaaacccuugcuuggcuaucaaacuccaacauauccagaaucaagggcaggggaaaggggaggguuccccucaucaagcacagucuaaaaucugggcagguuaauuuuacucaaugaccaucaccagcuccucgccaccaucaugagguucucuaccaagcgcccuuaagguuacacagcacaaaaaccugggaucaacucaguuuuauagacccucucgauuucuuuucuuuuucuauuucuuuuucuuuuuugagaaggagucuugcucugucgcccaggcuggagugcaggggcgcaaucugggcucacugcaagcuccgccucccagguucacgccauucuccucccucacagccucccgaguagcugggacuacaagugccgccaccacgcccggcuacuuuuuguacuuuuaguagagacuggguuucaccguguuagccaggauggucucgaucuccugaccucgugaucugucugccucagccucccaaagugcugggauuauagguguaagcaaccgugcccggccgacccucucgauuucuugacuccacuuccuagccuucaucaagaauaggcagcugaagggauuuauagaguaagugcaugccuuugacagugccuuucuucaaaaugaaauuucucucaaauccaguuaaacaugaugauggcuuucaauucuuucaaggaaaucuauuuaaacauucuguuaauaaaggcagaccgaguuucacaauaugcucacaaauuaauaucaucguaguuaagcaaguccugccaaaguucucugaguguguccccggagaacucagaucucacuguuaagcaugaguggggcgcagacuuucuguuugagagguugaggcgauccaaugcaggaagaaaagauucccugcaacccagauggccgcaucaaugcacaagguccaccacccuucugagccugggaucccaaacgacaggacucacuccuggaaagcuuccuucaccgcagccuacagggccucucagugcacccacaggcucauccaggagccugugcgaccacugugccaagaugaggagacagcaacaguccaggcgguggugacacccagcucuugcacacauagccgaggauccugcugguguggugcuggcggcacaucugcagauacggugccaguuaacagggccuugagaacgccagcccaccaaugacuucugcccagaaaacacucugacuuuucauccggaguuaacagccacaugugcucaggccaccucaaaagagcacauuccauaggcuucagaagccaaacuugugcaacagaugucuuucuuaggaagagagcuggguagaaucuucugaacgggugaugagcauuuuauuuuguaaacuacacuuggaaaaaacuacuaaaaaccagauauaagcagggcacaguggcgugugccucuagucucccuccucagaaggcugagacgggcagcucucuugaggcugugaugugccacgaucgcaccugugaauaaagccacugcacuccagccugggccacccagugagagccugucucaaacuuaaagcaacagcaaagccagauauaacaaaauaaacguccuaaaggagucagggaucagugggucaaaaagcacuggcccagccuuugauuaaauggcaaccgcaacaccacaauuaauaacaaaauuacuaaaacuguacuuuaaaggaaggaaaugaagcuuuuugagaaaaucaggauaggaaaugagcuuaauggagccaauuuucagaacggcagcuauggaccgaaugcuuguguacccuaaaauucuuccaugcugaaugcuggauucgugaaugugcaaacccuaaugcccacagugauuguaucugggugcugggccucuggaggugauucaugaggcucugcccucaggaacaggauuauuacccaguccguaguacccaauagaugaucuugcugccccacgcgaggauacagccaggaggucuacagccagcaagcaggcccucccagauccuggaucugccagaucauuaguuuuacauuuccuaggcuccagagcugugagaaauaaagccacucagucgaugguauuuuucuuacagcagcccgaacuaagacaauggccaaaagugaauauugcuuccugauuauuuauuaauuuuugcaaauuuaguuuuauguuuuugggaauuaagagggugucugacuuccuauacacuaccaauaaagaggcguacaggaaaaucucccucuccaagggcccccauaccaugcccuaaagguaacuagcaggacccuuucuuucuuuuuuggagacagauucucacuuuguugcccagggaaucucagcugacugcaaccuccacuucucgaguucaagugauucuccugcuguagccucccaaguagcugggcacaagccaccaagcccagcaaauuuuuguauuuuuaguagacacaggguuucaccacguuggccaggcuggucucaaacuccugacuucagguguccugaccccucggccucccaaagugcugggauuacaggcgugagccaccaagcccagucgugacccuuucuaauauacacauugaaguuucacucugguuccaccaucaaagaaaggcuagggagcucauauuuccccagggagcacccagcagcccaaccccagagugacauggucacacccuggucacaugcccucgaucaguuccaagggccccacccucuaauucccuagggcugaugcaaugcaggaaacccagcuguagccaacacagggcuacaauccacuucccacaccccaaggcuagguaugcuacagaauucacaagugcuuggguuuaaaaaaaaaauacauggcuuccacaaucuauuacgguguaccccccaaaucaucuaaaugccugugccagaacagauaaucauacugacccaacugcauuaagaaagaauauaaaaaauagacucaacaauuuagggcaggucaaauucugccgcuaucagaguauuuuagaauuuggauaugagggccaggcguaguggcucauaccuguaauccuagcacacugggaggccaaggaggguggaucacaugaggucagaaguucgagaccagccuggccaacauggugaaaccccaucucuacuaaaaauacaaaaaauuagccaggcaugguggugcacgccuguaaucccagcuacuggggaggcugaggcaugagaaucgcuugaacccaggaaguguagguuguagucagcugagaucccgccacugcacuccagccugagugacagagugagacucuaucucaaaaaaaaaaaaaaaaaagaauuuggauaugaggcuaaggaauguggaucugugauucuguucuguccaucuaacucccaccaaaacauucuuaggggcuuugaaaugaccaaaaaauuaaaagugaagccccuguaaguuacacagaguaagaaacaucaaagaaauguacacagcaagucucugagcacauggagucagugcuaggagagggcacacuaugaggcucugggcugccacacagaaggaggugagcaaaucuaaaaaccaggcuuucccuuggccaacaaagcugaguaaauccucccguuuugguuaaggguuguuagcacacgaaaauacauuuccucguguuaaaugcaagacuccaaaauucuaaauauuuucacuugcuaaaagcuauaaucaagaacagaagacuugagcagaaagaauuugugauuuuccuaauugguuguuugauuugugucauaauggaaauuaaguguuggucuuuguugcuaaagaaaaugagccauucuuguguuuaggauuuucacacaguuuaaaagaacuugucuuccaaauaugccuuaaaaauaaacuguauauuaguuuuaauaguguuauuuaauaauaaagguuaagcaaaaaaaaagggauaaaagcaaauaagcaaacaaacuaaaugacaccucuuauuccugucuguuuagacuugaggaaucaggaaugcagaucaauuuuuccuuuucuaguuuucucuuuccuacucuggcaugaaaauuuugaucuguagccgagaagacugguugaacagauaaaaaaaauuagugaucucaaauuuuaggcagacagaagugguuccaccagaaaacucaucuuuuguuacauacagugugcaagaaaugauuccagaauguuuauaucugaacgucaugcagagaaacugggcacacacaauacaauugggcacacacaauacaucugcuguguccagcaugguguaaaagcacaggggacugauggccacuaaggguuuugaacuugaggacuugcaaaggcaagagccaccaagcuacacuucuuggagagaaauaucuggagguuauaugcuaaaccuaugcaaaacuuaauacaauuuauuagacuauguauucaacugucaauuguaaccauauuauagaacacuguguuauauguaucauauaguauauaauaaauuauuaaugagauaauguuaaacauugcugucuuaauauaugaaaugggggaagauuuaauccuccuaacuuuuaauuauuuagcuuacacuuaacacaugaauugcccuuguauuuaaauaucaaauaaaggcaauuauaggaauuagcuacuuaucaaacaaauugcaaugaugagauaugaauuuguaaaaaaaaucuucagguuagauuuuuaagauguuugccuuugaauuuugccucagagaggccuggaauccucgacugauuuuauggggccucuacuguccuuaggggaacccaacuggccuucugagaucccagcccacucaucucuugacaccguaggguccagaaugcuuguauaaggacaugcucucugcagucucugcuugcucucaaaaccaauggaaacccccacgugggcugaccuuuuccuguugcagcccuuccugggagcuggcccagcccaagggaggccugguguccagcgauggggcccuuuggccagcagagggcacugcacacccugcauggccuuccagaggcugcagagacagccaugagccaccauccucauuucuaucccaacuuaagcucuacaagcaccuggagaaaauaagaucagcuacuccuagaagggaaggccugggcccauggaugagaugcugcauuuccccgaaaguuccagaugugaaagaggcagaaggucucaccguuccagcagcagaugcuucguuucuaggagcaugauaugccaggggaaaggggaugcagcgccagcgccuacuuguuuaucucccgagacgcuagcugggggucccacuuucacagcggagugacuggagguacaggccaagaaggagggaggcucccugcccaggguguggaguccccgaccccagggagccaggggccacccugacaaaugauuuuuccauuacgucugcugacagcaaccaguuaguguugaaaauuggaaacaacuuggcagagacggaacacacacagagaggacggugcuggggaggggccggcugggcugcuccgcaaaugccccuuaggcuuuccauuacaaaugacagccucuggagcacuaugcacaccugaucaacaggcucaauuugacucaacaccaggaucaguuugcugugagacaaguaugaucuuaagauauacaacuuuuuuuccugguagacacuaauuuagaaaggaaaggagauuuuuccaacuuuccccaggaauugauucuggccagaaugcacauuaaugugcucucuggccucaauuugcccgccugaccacagacacacacacacacacacacacacacacacacacacacacacacacguccaccugaccacacacauacacacacaacaccccuuucaccaaguucuaagaugcuggccaccucuucuccacacuggcaggguaccugacaguuucugguuggagaagaaugggaggggcugguguagcccacuaaugccccacuacgggagacagaugugccuaauucaguccccaccgucacaggacacucuuucuuaccaucauuucaaagucgccacaguugucacagcagcaggauaccacugagugauacagcacaugcuuggccugauuuggcagaggaugccuuuggauagaccccacacacgugcggauccuggggagcccccaccugagcuccggugccaccucccccaggcagcgccucuccaccuucucuucauggcucugaugccacgaauaccucacaagcuugcuccaagucacauucagugggacuugcuuucacuuuccaggacgagguuccucuguacaacccacuucaguguggaaccuucagcaaggaaugagggcuacaugguggccagggagagguggagacccgcaggcauggucgaagauggugggaaaggggaguucaagcuggacgggcagagauaagcuaucaaagcaaacgcuggcugggcugccaaguguccggagagauuaucucaaaaacaagcaggaacggcucccuccaaaggggcccaccugcugaaggaguggggacccagccuuccaaguuccaugccagccaaguuauagagucaaaccaaaucaagacucuugagccaccccgcuccaacucuucugcccagccugacgugaccaggccaguguagccaccgccccagugcacagcucagcuccccaaaccccacgucuguggggccaacuguuuaggacaccaguaguuugggcaugcacugggauaaaagugcuccaggcaccugggguggcccauccuucauuucaacuaaggcaucacucaucaugcaaaggcuggcauccaggagagccaacucagaccucaggaguggaggauuauguuugcuuuaugagggcagauacucuaugccuggguccuuacaaguauacacauuccauaaugcgucucuaucaccaaaagccgcucugcagcaucauggggcaccgguacccugucuccugcgacaggucguggaaaugauauguagaaaucagacaucccuaacuccagaaaaucucuagauucaaagacaccgcuucccagaccuuaucuuuucaaccugagucauaaagagaaaaaucuuagucuuauccacaguuauuuaacaugaaauaaaauagcuugcagcuauucauuuugcuuaacacgguuuucacguggaagacggcuacguaacggaaacccagagggaugaaggcuuuguuugguauccaugacugcacccaaagggagagcgggcgucucgcagagucugauggggaggaggagggugggacacucccgugucacacaaauucaucuuugccuaucaaaugccgggaaaaggaagggugggggugcggcucacaagaguucuuuuguuucuguuauggggugucgcugggguucagcugucuucuugaaucauuucaccuguuucacaguggcuuccagucccggucuccaggucucugacgaguacaccaccccauuuuaacacucaucauagcucagaauguuccaggcuauagcuaaaauauaaguuaguggaaagagguugcuggggaggaguagacaaggcuccugaugagaaucuucuagagaacugcaaccuugucauaaugaacugggguccucacaggccuccugcaccaaaguccucuggagagggagacaucuggaugaggaggguggauggugcccaugaauacagucaccuauguggagaauuacagcucaucgugagcuaccaucagggauccuaauuuuacaugaaaucccacuggagaauucuugacaagguaauggccauuuaaaaaucugcucugagacauuuuauggggauauugugcauguuagagcccaagccagacaaauaaaugggaaaaaagguccgaggacucaggauaccuggaucccaaguuuauguccccaccccagacaccauucgaaaacgguacauggagacccuuagggaaaggcaggucccuggaggcccacuccucauguacuuccugccauagucauccaagccugaacauuuauggucuugaugucaauuaaguccccaaagcaauuaaaauaccuuuucaggccaggcaugguggcucacgccuguaaucccagcacuuugggaggccaagguggguggaucacuugaggucaggaguuugagacaagccuggccaacauggcaaaaccccaucucuacuaaaaauacaaaaauuagccaggugugguggugggcaccuguaaucccagcuacucaggaggcugaggcaggagaauugcuugaacccaggggacagagcuugcagugaacugagaucacgccacugcacacuagccugggcaacagagugagacucugucucaaaauagaaaccaaccaaccaaaaaaaaaaaaaagaaaccuuuucaauuaaaugcccacaggucacacacugacuguuacagguugaauuauggaccccccuaauuauguuaaaguucuaagccccaggaccucagaauggaaccuuauuugaagauaaggucguuacagcggcaaucaaauuaaacaggucauuagaguggacucuaauccaagacgaauauucucauaaaaaggaggacaguuggacacuuagacacagacagggggaagacgacgugaagauggcaucuaaaagcuacggagacagggcuucucucaaauccuuggaaggaagcaccccugcggaugccuuaucucagacuuccagccucuagaacucugagaaaacacaucucuguccuggccugucuguggaaccuucuuucagcaacccgagcacgccaacacaugccaacagacgggaggcucgcaccuaucggugggggucugcgcugcugagaccugcaagcucaggaccccccggcaggaagccugguugugaugcaggggcagcaaucugugcagaauccuggcuuuauuaaaaagcuccaagucaacccaagccugcuuuauggggagaggcaaccuucacccuccaaucucgccccagacagcucaacacgcacggccugaggugugcccguggccauuucccagcaguggucagaggggcugcaggucccagagcugacccccacaacacgcagggagcagccuccugagaggcucagaccuguguucgccaggggagagacccaggagggaauguucuaaccuuauuucccuuaagcuguuuucugugcuccaugucugggauuucauuguuuggaccguccugccuuuguguugucuguguuaacaacacccagaagauuccaucagccucaugccaggguugggagaucaaagaaaggugauccccacacggcccacagaggagggaagaaccuaucaagaacgcccuugggguccagcagcaaacggauggugauugugccuuugaaugccucaguccgggcuuuguguaucauagugugggcuccagcaggaaucugggguccacaaucacaggcaccaucgguuccugcuuggcggcagccccaacacauucccaugggagcccagacggagcgcccacuggaucucaggcuggaauugggcgcuuggaucaacuccauucauauggcuuugggacagccacgugcaucuccacacuucccaaguucaugggaaauuuugagaaaaacuuuucugacugucaaagcauucucuccgguccauucucaaauucuucccccagaaugaaguuuaugaauacgcaucacgcagcaugcagccgcugaccccaaguguacuuauuucuucaaaacacagaacuuuaggaguacaaaaggcuuauucgaagagagagaaaaaaaaagaaaacaaaaccccacacaacuuccaggauaauucaagcaugaauccacggggccaccgaagccaaggcugccccucagggcaggugcagcauucucccagguuucuggaguacgacuggggguucaucucuggagggccggggcucccucaccuccaggaaggauccagugcauugucaacacaaaggacaugggagcaggaggagcccacugaaaaugacccgccacucuaucuuuugaauggcaaccucacugcccgccgaacagagagcaagaggacacagugaaaggucuuuugcaguccagauucuugcagccccuccuggcaucccccaacacagcagugcaaggaaggcccucuguccucuccaggccccucccagagguucucccagggaggacacccagggaugaguggcuccugggcucagccugcuccacucccaaggcccuugggaaaucaacaggcucagcucaagagaggcagagaaggggugaggcuaauagguuuugguuuuuggaaggucugagguuagacccucugggcuucagagacagcacuucagaugaugccggggugaacaucucagacacgcuccugaagaugggaggggagaucucagcccagagccgaagguguagacgggucugaugagugggaagacaggaagggaaaugggaacuucacuuggaaaaggagagaugccacauaguuccgaagggcagggcacuggccacagacugcccuucaugcccagcuccacaagaaaccagggacccggcagaggaucagauuccacacagggacccucacugagguugcacacacauuaucucagugaccuuuccagccccuacaggacuucuggggaauccgaagccggauagcucugcacagccacccaccggugacacaggcgugcccacaaaacaguagagggccaugaauugagggccauggaggcuuuucugaaucacugccccuccccagaggcccacugagagcuuuccaagcugaacaugacccucucccugaauaaggcagaucccaucuacacuguggaugccagaaaaagaaucaaucccauggcccccggggacccccaaccuuuuggaauucauguccuuguacaagcucugcuucuaaacaaacaguaaacaguauacacaggugaggggaugucacuucugagauuagguuaaaagagacuguggcuaccagugugggcauccucccaucuucccugccaacuucccucccucccagaggccagcugccaugccagcugcccuaaggagagacccacggaacaggaaaccaaggcccucagucccaacaguccaugagaagcugaacccuccccgagccgggccuucagaugagaccacaaccccacugacauccugaaugcaacauugucagggcccuagcaggaggcaccaagcuaagcugugcagguuccugucccauagacagugcaagacaauaaaguuuuguuguuuuaagccuuuacauuuugagguaauuugucacacagcaauagauaacuaauacaacccuuuacacaaacuaucacacugacuauggucacugacacaguacaguucaacagaaaagauaaaaacaguaauacauuuguaaugcauggcgucuaguuuauacuaccuacaggacagagaacacuaacaaaaaacaagcgaaacccucuaaauccuccgcugcccagacugacaugaggucugugauauauccacuucuguaaacucuugggguaaacgcuauucuccucacaacagcaaugcguacaagcugaaggaacggaaagucugcuguuauguucacuuaccccagaugcuuaaaauaaauuccagggcuacgcucaacaugcacagaguuaacucaggcacccuggggucuccacucugacucacgcacacccauaaaucuggggaacauuaaaaagaucuaucagagccugggccccacauuaagaaugcagccuccuagaccccccucugaaugguaauucacuggguaaacagaccuucuugcuuuuucuuaaaagugguccuugaacugcagcuacgauuaagucugagcucucagagaaaaagagcauguagguaaauauugaaggcagucugcacagagguucagggcacaaacacagccgcuucugagacagggaacaccaugagccgaggcaggagcuggccucaacugcaacacaaggggcagaaaugggaaggcugcaaaaaccacgcaggugccaugcccucaugugcccagaugcuuggguggcccuggaugauuuccuaggaucacggcauuucuggagccuucugagauuguagaggucaccaaauccaaacuucagagaaccugagacucaacauggccaggucacuccuaguccuauguccuuaggaccccgauguacaucucccgcucccccagaagcagcacugcagaggcuuguggagucagacugagccacaccagccagaugcaaaacacggcuacgucucacaaagccacaccccacaauccccgaaccacacuccaagggagagcucuccagagcagacacagaacaucugcagaagcaaaaagccagacuagcauguaaaaucaugaaaagaaaaaaaucaaagaggcagguagacacauacccaacuguuggcaggggagucccucugaggagugggacugugggaaggaggaggcuccaagaggcuggaacgcuuuuuagcugcaugcaugacuuuaaaagcagcuaacuggccaggcguggcagcucacaccugcaaucccagcacuuugggaggccgaggugggcagaucaugaguccaggaguucgagaccagccuggccaacauggugaaaccccguguguacuaaaaauacaaaaacuagccaggugugguggcacgugccuguagucccagcuacucaggaggcuaaggcaggagaauugcuucagccugacaggcagagguuacagugugccgagaucacgccacugcacuccagccugggcaauacagcgagauugugucucaaaaauaaaaauaauaauaauaauaauaauaguaauaauaauaauaauaacuaauaaacaaaagcagcuaccacuucuagaaugcuccaugugcgaugagaacuauucuaagcggcugugaguaguaacugacacaaugcauaagcagccagcaauuccauucugcugggcugguuugcacagugaaggcgugcacgccauggaggaggacacgcccagcacagaugucugucagcucuggaugaggcuucaggugaguccccgaaaccucaggugcaggcaggauacacacacucccccuccaccccagaugccuucagaagagugugccauuggcucuaaggagcccaggaggcccagagccuguaagauaacaucacaacacagcggcccaggagucagggucaucugcugaaaacucacucccucuagucacccgccagccccacagcugcucuuugugccucagcuucauggaaagguuaaaugaccaacgccauccuccugccucuagaacggccacagagucaggucagaugacagucugcacucuuagucgagggauguuggcuacagaaacuuccguggccuuaggaccuccaacuccaucgcucccaaccccaucacgggcagcaaugcggacaggucacacaagugccauggggacccaccucccaguccgugucuguggccccagugcuugaugagcugugugaucagagcauguauccacaggcagagcucuggaagguucucuccgagggaccuguugagccccucauugcuuucuccaucacaccuucccgaggaagacacaagggucccucuguccccgggguacacagggcagcccccagccggggaagcaugccucucugcccucuggguugggcuccguuccccaugccagguccugggggcaggagggagacagcaaggccagaaggcagugcaaucuuauucccagagaggcacccaggaaggguuaaacggauuguuagagacaaaaccgaugaaaacgacuucaacacaaucugaugaggucagcgaguagagaggcccuaaugacacuuguaagaaaaaacaucuguuggugucaaaaggucagcaggaagugagugggauuuacguggcugggauuggccagaccagcacuccucgaaagagagacacacacauggcuuaacuuagccugagaggaacaacaaaaaccccuuucaauuguccugugaccagcccccgccucccucuaaacaacaggccaaaccccgagcuaugaaauccgucugggccccugacuggcaauuagcucuuuguccauucacugaucggccacugaggcccagacuccccccgacugagucuuuuggggaugacguuuuugcugugagugcguaucccuuuuccaggccacagaaucuccagcuugacuuuuuccuuggaacacaaagagggucacuugaauagcaaauguuucaauaaauccaucaucacaaaaaccaaaacaagaaguuucucuggaaaaacaggaaguccugguacacagcguggcuuaaaauagggccuguuucauuuguugacaaaacuccagccucuggaagccucuuggaggagcuuugucugagauccagcuuaccuuuuaaacacuccuucaguaaaaagcaucccagugcuucgggcaacagacuggccuggacuucguuacacucugacgcaggucacaggucuggguccuggccgucccacuuccuguccacaggcccccaagagggucucacgggaagccaggcucagggccguggcaggaaugaggccuggugcuuucaugccaucaacgagcuggguggcgggaggugcuuuuucagccuucuccucuaaagcauuucuaacuuggaggccucucggaguuaguauucugcuuguucuuuaugaacuguuacagaguuuuacaggagcccugacggggagaaacucuuggacugucaccugaacuugaccacugugcaguaggcaaaguggaggucccaguugcacccagccagccuggaauaugcagcugcgcccuccccaaagucacccacuauaaagaauacaggcaccagaaaacuccagaaagauguuaaaaguucuucacgugauacgauugcacacacagugcugcguccucacaagaugccuccugggcaccgucccauaaaggugcucucaccugaucuaaccauccauuccucucccccugaguuuugccuuuuccaagcuaaccgccaaggaucuggaggacgguguucacacagcgaggcaugggcgugugucgcaacuauuccccuguugaaaugugaagccacggccgggcgcgguggcuuacaccuguaaucccagcacuuugggaggcugaggcgggcagaucaccugaggucaggaguuugagaccagccuggccaacauggcaaaaccccaacucuacuaaaaauacaaagauuagucaggugugguggcgcggugggcagaucaccugaggccgggaguucgagacuagcccggccaacaugacgaaacccgucucuacuaaaaauacaaaaauuagccaggugugguggcacacaccuguaaucuccacaacucaggacgcugaggcagaagaaucauuugaacccgggaggcgguggcugcagugaaccaagauuaugccacugcacuccagccugggcgacagggugagacucugucucaaaauaaaaaggcacagagagaucagagaaucaagucuaccaaauucuucacacggagauuccaccaccaccaaaagcacauccccacggucaggcaggugacgaggaccuucaggagauuuccuuaccacuaggaugggcagggggaggcuucugcauggauaccggaggcucacugcgugaaccuucuggagacggcacugucacuuuugucuccuuugcuggugcuaaacaaagugugggcggugggggugggaggcguguuuaaguaaaaaggagacacaagcaaugcuaguuguuucaggauccugcuggguuuuguuggcuuauagaggagaaaaucagcgauaugaagguacgugagggguaagacauacgcaauuucacuucagaaaugugaauugaggccgggcaugguguuucacgcuuggaaucccagcacuuugggaggcugaggcgggcaggucacuugaggucaggaguucaacaccaaccuggccaacauagcaaaaccccgucucuacuuaaaauacaaaaaauuagccgggugugguggugcacgccuguaaucccagcuacucgggaggcugaagcauuagaauggcuugaaccugggagguggagguugcagugagcagagauugcaucacugcacuccagccaaaagugacaugauuuagauggaauuuacuccagacccaaggcuugucaccaccaacccauccugauccacaccugaccuggacccauuagccuaauguccacgcuaagauuuucacacuguuuuuugacgucgaccccagaagccaugcuccaaggccacugacacugcaucagugggcagcucagugugcugccccucucgccccgccaauuuccugcccgcccacccccaccagcuccaggaggcggaaucugucagcuugucagcguuugucuggauucacugggagucaggaaggggccuguuugggagcuuguguugggucuggcuuugcugaucuuuuguggggagacacuuaggaugaaaugggguaaaggacagaaaaggcucaccugcaggaccucgcggguuagccacgagucugacacaccugagccugccccacugcccaucccuggagucauccuucccgggggccaaaggcucuuccaugucacuuuaguuaucauauggcgggcagauucgaaccgucuaucccagucacucuuuugaagagugaacaauauggagaaugugaacauauguggccacgcagcugauguacacaagcauuccccacagccauuuauuuuaaggcaccgugugcuauuuuuauccuccacagaaaugcugccaagggaauccgcagaggaaaacaaagcucuggagcugagcggguuacucugacuucacucuucacacgacaaaugaucauagcauacuauuugccaccuugucucagagacaaaugucaugaaauaagucacucgucauuauuugaguucaaguacuuuuucuuaaaacauggcuuuuaaacagaaaugcauuuuuccuuaacuacuggucaugauauuccauuccccccacguguguguguguguguguguguguguguguguguguguacaugugugugucuguugcggcuuaccugcaacacugguucugagcaagugaaaaacuugcaaauguguuguggaagagaauggcaaugcucauccccagcagggaacguucccgaguuuccaucucugccugugauuaugugcagggcagucaugcggaagagggauuggguguauucugcgugggcagaaccaugaccaggagagaggggaagccaagaggagagauugcagauggauaaagaaguuucucacagucgaggaauaagaagcacacgggcaggcuuccccagagaggccggugccccaaccuagaggacacgaagccgaggccaggacuguggaccgcagcuggagaccccucuugacccgcgggggcuggugugcuaaggugcaaagggaggaaagagcaacaugcagggugacaccugcagacaguucucccuguucuggaaucuuccggucggccccaggggugcacgcuagggcagcccauagccagccccugcuagaucccggcucccggcaacccucaaugcugaacucucccaggauuccugcgguggcaaacagcccugguauguaccauuuuauuuucacucaaaacauccuuccugggaccaucccagcaagcugagcauacuauuuucaacuaaggcccuggcauugucuaggaauguuuucagggcuaagcaaauugcuaaagcaaacaucuuauuuucgucugcaaggacagccaagcgcuguaaaaauacuucccgauaggacuuccaguggaacggcccccucugguggcgcuguuggcaccagacacucugguucaggggaaagcucucgcugggcauccggggcgacacccacacuucccuugacgguggcuccacuggcagccgcccugcuccacaccccuagcugccccaggggaaggccagagaaggccuguggacaggaagggguacaggcccugcagcgccaggaacaggaccucccucaccucuccuccuccuugcuccaaggaacagccaguuugacaccaaaucccacacaucccaguuccaggaguggccugggacucagacaccaggugaucuggguaugggaggauauaacagcgucuacggcagcaaagccugaggcccccacaccaagccagaggcaacugagagcugguaccacaggccagacggagcccccgugcagcauccuggaccugugagcuggccugcauuccuggguucucagaugcaccucggugaggugccaccuccucacggucacugcaacugucacacccuuacugagaggagcagcuguagcaauaagcaggcuccccggcucacggcauccuggacacuguucccgucacuuugcaugaauucacucauuccucccaacagucuuaggaaccagguaugcuuuccucaucuaaaaugacuaaacagaggcccaggguagaaaacaacgggccaaagacacagcugggguggaggugggaccgaagccggguagcccagggaucguccacgcccugaguuugugauggaccuaaacuccuguguguuucacuuccuguuucaauugcuaaaccgagagggcccuuagcgacugcucccaccagggcuggagaagcagaacccagcggacucaaaacggugccuacaggggaaaacggggugagcaggggacgacugaguccagccucgguucuggacuacuagaaagaggugccccugaauggggggacacaggggugcucucaaaacucagcaaauguuaguccuuuuauuuuaggaaaauacacugaacuauuuguugauguaauagaagcuaggguuuacuguauaauggccuaguagggugugucuguaagagaacgcacgugaaaugagggugaugaggacaucugcuuuuuuaagucuguccuguuuaaagcucuaacacuguaacguggggacaacucugaaggcugcggggagguucugggacagcagacacccgcuggcagcacgcagcagaacucagcgcgagggguuagaguuaggguuagggucgcugccaucaguaauaaaaaauacggagggaccgggugcgguagcucacaccuauaaucccagcacuuugggaagccaaggcagcuggaucaccugaggucaguuuaagaccagccuggucaacaugaugaaaccuccucucuacuaaaaauacaaaaaauuagccgggugcgguggcacacgccuguaaucccagcuacucaggaggguugaggcaggauaaucucuugaaccugggagauggagguugcacugagcugagauugcgccacugggcgccugggcaacaaagcgagacucuaucucaaaaaaauaaaauaaaauaaaaaauaaaccacugagggcacccaaggaacaacaucugcugugcacccguuuuccuaauggccccaagagaggcuggcugaacagacaacuaugcucagaugaucuuucuggcguuccagugagcaggcugggccuccacaggaagagagcucagccaaagaaaggacagcuccccagcagcgaggcagggcccugggcagcugugcacagccucggccagccucgagcuggaccucagccgcaacugugugcugugcuaaauggccaucauugguggaaccaaaaacgaacaaugggaaaauuaucacauuauccuucuacgaagcaaucuggaaagcuaauuacguguuacucugcgcacaucuucaucucugauguggaaacagcaugggcgaaucggucugguggggaaaaacaucauacuuaagaaauacggagaauuuauuucuccgcaagccacauacguguuuuaccccacacgucaugaggccuguggcaccccgauggggacugagcauucacucuucugcccacgugaggaaccaacaaaagcuggcaaggacaccccaggauaacacccaaacacgucgacucgugcgaaaggccucaugcacgauccuuucuugcuguggcaaaaccguuaaguuucucucaacacacacaaaaccgaaguaaaaugcucauccucuggcuccccuacaguaguaaaaauuaauugccacauaaaauugcugauuccuaccaaaugaagcuguacgauuuaucagcucauggauggcgcaaacucaauggugguuuaacuacaucaccugaguuauugcuguguuuucucucagugacagcuuuacggggaauguaaguuuugcgaauucauucauguaggacaaacuuccaaaguaaacaaaagcauuaagcagacacagcucucccguggcuaugucacagcgauucucaaagccacagggugucugggcaagaaggguggacaccccguguagggaccccugcagcaacuccaucaggcacgguuuucccccacccccaggcugcagugccaccuuccaggggugcucucugcugaagcccucaaccccccgcaccccaacuuuagaggccaucguaauuuaauuauccaacuccaauuccacauaggaauccaguuauuuaaaaugcauuaaaaaaauaaaucacugccaguagguuuuguauuuuuggccaggacaaagaauuuauaaacagcuuauauauaugguguggaagacaguuagauggugaauaccucagggaacaccauagucuccucgguuuucaccagaguuugccugggagccgggacaucccuaucauuuuaugggcuauuucuguuuucuucaucauuuguccccuguccauuagacaacaauggauugaucuuuuucuaaucugaauuaggccaggcacaaacagguaaguuaccuuccgguuuccauaauuacgggaacaggcaaguacuucuuccaaacucaggccuucagagaaaaauaacuguggugggaggggugcaaucccuggggaaacagcguucuuggugaggacaaugcugaggucacccaucggucuccgaagaauagcaguucuacuucucaagggaagagagccccaacucuaagaauuucagguacaugaaaaaaaagugccacaauccauuguccaaguuugccuuauguucuauuuauagucagagugcgugcucugaaucuguuuuagaaucauguucuucaggacaacuugaaauaaaaaucagagaaguuuaguuucaaaaaaggcagagaggugacuauccacccaggagacuucacccauucccgccacgccaguguccccagucagccuugacccugcuucccugacuguguagugagauguggggauucagcccaaggcuugugguuaaagacagaggaagaaaagacaaagaaugaaaccuuucugguuuggugacuuagcucagagcuggucuggcucuucucuacuuucuugccaaguuuugcauauuugggauuucaguuucacaagcuuccccaccucacugguuuuacugcuuaacgagcagagaauaugcucuaaugauuaucugaaacacacccacagguaaccacaacuguuucacacagaacaggaaaugcccagcaaagaaacucucacuugaugaugaaauguuugccacuagaaaauacaucguacuguccccauuccaugggcuccccaaaccacucugcacaaaaacugugguugcggaggggcugcuugacagacuguucuuugacugggcucuucagguuccagucuuuccagggagguccagccaucaucagauccaaauggaagucuugcaacuggggcacucugcuugaacucaaaugcccccaacaagagccuuguucucuuugugaugauuuccugugcugcacacaugaaucugugcuuuucucaaugugcacuuuuuaaaaaauugaaaacaacccaaggaugagucaacauuuuaaugcagcucauaccugacugucaacuucagcaaaauaaagggaaggaagagcaaagcccgcaggggcuuuggggaaggcgagguggcgaagggaagaggcaggauccggcuaacaaaugccaguaucagggaaauaccaaguccacauccugcgcagucagcuccccaggauuuguuuuugugggucucugagcugagagcuaagggggccggagggagaaagugggagguaaaguuagaggagggacucacuguaggagcacacugccagcucuuguggccagccccaguggaaaagaaaucccacuaaauuuacauccauucgugcuccauaugaagaagcugagggucacuguccucuucuagcuauuucauucagcuggcuuuccagucuaucagaaaaaugccaucaucggcuggguguggugacucucaccuauaaucccaacacuuugggaggcugaggugggcggauagcuugagccuaggauagcuugagaccagccugggcaacauggcgaaacccuguccuaagaaaaauacaaaaauuagccuggcuugguggcaugcgccuguaaucccagcuacccagguggcugaggugggaggaucgcuugagcccagaaggcagagguuacagugagcccugauugugccauggcacucuagccaaaaaaaaaaagccgucaucuucuugauggugaacucccucuaaugcucaggcugauguccuaacacccaggacaacgucugagugaccaguggcucuuggcugagggaugugagcuaugagccccuacaucacagcuucuguuaacauggcgauggcuaggcacaggcagccaccccucuaccaagccacaucccaaauccuaaccccagcagagccagagacucaaugcuuugugucacauggagcuaccaacaucaggaccagcgagaaaucgggaaaacaucaagucagaacgucccgugccuucuaagcagucaggugcaugcaccaugcuaggugagugcagggcaggaacggaaggcaagcagggugcgcagauguaacgggggaagcaggcacggccaagcacccuagaaagugcugucauguuucguacaggagccugcuggggguagcucacggggacuggaagcauggcccugaagugugggcagcaucuuuucuguuugcacgacucaaagucugccugguggaggagggugacaccugcacagaagccagggagcacagugcaccaaccuucaguguaaucuccaguccugccacugacucgugagcugugugacucuggguacaucaccugagcccuucacaccuggggguuucuuauccauaaauggaacgaccucaccagaauuuuaaaauguaacaaaaaaggaacuagcccaugugucgaucaguaaaugccucagggugaacucgagaauccagaagucuccagggaagcccagugugugcgacgugccucuuccuaucuccccugggcagucuucccagcuccauggaaaagucuuuggucagcugaacgcaggcaaggcugcugaauuccugaaguccccgccugaccaccaggcccagguauaagggaagggcgacuccuacugauggacaaccagacaccccccacguccaccugcuauguggggcgauucauuauuggccggcaaaggcuuacacuuuuuucuuucaagaauuuuuuuauuuagagauuacacaaaaaaagucuucugugaaacccauaacccagcccaggaaugagaaaaacaucacacaaacugcaguagagggacaauccacaaaauauacuaucauaaucaaaacugucaaggucaucaaaaauaaggaaagacugugaaacugccaccgccauguggggccuaaggagaaagacagugacauacaaggugaaaaacuggacaggauucugggauggaaaaaggauaucagaucaucagaauacaauguagacuucaguuaauauuaauguauugauaauugguucauuaauuuuaauaaaugucucauacuaauguaaugucaaaugauaauaaggaaacuaggugaggagauacggaacucuccauguaaccuucuagacguuucuguaaaucaaacuguucuuaaaaauauccauuuagaagggaaaaaacugcuuuuauauaugccauuuaucaaacuucuuaucuuaccaucucaaaacccaggcaaaggauauaauguaaaccaaaauaugagagaaaucaaaggaaaauauuaauggcacgcauaacccucauucucuuucucucaaagcaguaaguuauagcaagugucagcugucagucugugcacguagccuuuaguucaaggaaggcccugaccuguacacugacccaagcaucaagucccaugggcagggcccauggugggacucccugacccgcgucauucugugcccucaccucugaagccgccaagugcagugucugcccaagaagccaccgggcugcagacccagggcggguccgauguauacccuaggaggcacccccaauuucaccucuccuuggugggccucucaccuguccacuugccacaggaucuaccugcccucuggugccaagcaacaacggaugaauacccacuaccuccagacagucagaugggccucaacucagccccaacaagcagccagaaagcaaagcgaggaagaugacagccaauuucaccaugcggcccaggcccacagacuccagaggauuuugggaagcuucacagcugcaccagaguucugccccacgaccauccugaucugcgaaggacacguccauucugaccacagauguucacugagccucugcuaggcacagggugaacaccauacaaugaccauucccaaauucaggagugugaaacuucaucuacauuaaagaauucaaacuacguagacagggaguuauauaaaccaaaagaaaauguuaauuugcacacauaaccccauccccuuucucucaaaauagcaaguuauaaaaaucuagaaaguagagaacauuuuauuugcaguuuggauaaccuaagguuuacugagcaaugaaacugagaauguuuccacuaacacacaggccacagguuucagggcagcaggaaggccaggaaggagcaaguguccuggagguggcagcuuugucucuauaccacaccacagaugcuggcugucccggaacaagauggccagggugcaaaggucuuagugccauggccgagacaacuacuggguuucccaguguggucccuugggugagggagcugcagaggacucaucagcacccuaugcagagggguuucugagcacaggaccaggcccuggaaggugggagucuugagaccagcagggcugcaggagguacucccugagucaccuauucccuugcaacuuggaggucaggguugcuuugcccugcugggggaaucugccccugcugucuccgaggccccacucuccccucagccagcuggagcaccggguucuccuuuggauccugacacgcgaccuuagacaacuuauuuuacugcugauccucccaucgcaggcuggggcagggagaucagcuacaggaacagaagggaacgaugcacucacagggcugggguagagcuggugcccacccccaccacuagccaaacagucucggggcuggccucuuccaggggccuuucucaggaccaaggguuuccuguucccugccugucuuggcugagugaccaccuccccuaauagcugccugccagccagcuccuacaaaucaggaccuucuauugacaacacuacaaauugcguuaugauuuuauaaagcuuuaaauuccaaaaucaguauuggaauuaguccaacuuguaaacgcccacaaugaugaguuucaaacacacaaaaauacugccuauggccaagugcgguggcucacacccguuaucccagcacuuugggaggccgaggugcguggaucaacugagguugggaguucaagaccagccuggccaacauggugaaaccccaucucuacugaaaauacaaaaauuagcugggcguuguggugcacaccuguaaucccagcuacucaggaggcugaggcaggagaacugccacgaacccaggaggcagagguuguagugagccugagaucgugccauugcacaccagccugggcgacagagugagacuucaucucaaacaaacaagaaaacaaaauuacuggcugaaaguuuccauuaagacaagcuuguuuuccaauauuaaauccccaagccaggacacggucauuucuguuuguugugccaucuaaucaggacauggagauuucugcugagagucuccccuuuaauggagguucucacagaguauuuuguuguuucccuacuccccaacuccaccaccaucaggaaguugacagaaaguaaagauguaaaauuacuuccuuuuccauacccugccccccucccccccccacacaaaccccaaaagaagugaauauagaaagauaaaaaguuacccuaaguaacuacagacuuuggauaacaauggaucaauuacuuugggaggccuagcugggccaaucacuugagcucagcaguuuuauauauauauaugggucauuaauuguaacaaaugcaucauaccggcugggcacggguggcucaggccuguagucccagcacuuugggaggccgaggcaggcggaucacaaagucaggagaucuacaccacccuggcuaacaaggugaaacccggucucuacuaaaaauacaaaaaauuagccaggugugguggcacgugccugcaggcccagauacuugggaggcugaggcaggagaaucccuugaacuggggaggcagauguugcagugagccgagaucgugccacugcacuccagccugagugacagagagagacucugucucaaacaaacaaacaaaaaacaaauguaucguacuaauguaagauguuaauuauagggaaaggccaggugggguggcucaugccuguaaucccagagcuuugggaggcugagccggcaggauagcuugaguccagaaacuacagacuucagcgagcuaugauggggccacuacauuccagccugggugacagugagacucaauuucuaaaaaaugauaaugauaauaauaauaauaaugauuaccaauuuuaauacggaaaacugggugugagguauaugaaaucuguauuaucaucacaauuuuuauguaaaucuaaaauuuuuucuauuuuuugagagggagucucguucuguugcccaggcuggagugcaguggugugaucucagcucacugcagccuccgcuucuggaguucaagugauucuccugccucagccucccaaguugcugggauuacaggcaucugccgccacgcccggcuaauuuuguauuuuuaguagaggcaggauuucacguuggccaggcugcucucagucucccaaagugccaggauuacgggugcgagccaccaugcuuggccuaaaauuuuucuaaaauaaaaacuuuuuaaccaaagaaaaaaagaaaaucacccacuucccucacacugcauuccugcaaagacaaaaugccccguaugcggugauugcuucccuccccaauucugagcagaugcugcucucuguugcauggaagcauauuccaggcacauccagaugcucccgagccgugugccagggcugccacgaccucguaucugugccccacucacccaugcaaccaccgccugcugagaggggaaacagaggcagcgaggggcaggcucccugcucugggaagggaaggagcauuugcgggaaggcccaagaacaugagagccugguugaaggccacuggacggcccuuggcacuggacuagggggccagccagggauucagggaugauggaaaaaccaggaaauauuaauaaaaugcagaacacuugcugugugcuccugauggaggaagcagcaaagccggcuaacaaauuggucauugguacagugagccugagcccaagugggacaggaaauuaauccaacaugcugaagaccugaguuccaacugcuggaacaaggcgaaggggucccaccccaaaagugaaguaagaccugaaagauggcaguaaaaacuuacaagaugcaaauuaaaacagagcuaauggugaugacagcuggccaaggaacaggagaauggaccaguccgccagguuuugaagagcuuuuuuagaaagcaaggcugacuagagccagugaagaauaaaacgcuuagaagaaagacaguaacucucuaaaaccauaguuaaugguccaaugguucuuccuuccaucacaaaaccaaauucccagauaccgugaaaugcguaccaccacccccaaacauucccaaagcagacccugcaccuuugcaaaugcugcagauuaagaaacagaggaugcaagcaggaaacggaaucuggcaacuguuguugaggggaaugggccggaacagucagcugcccgcaggguacuugguggaagacaagaggucaagacaggcacuuccucugggcugaggguggccagucugggcccuagacauccacaccauggacaaacccugagaccuggacaugggcuuuucuggccagaacauaauccacauacauggccgggcacgguggcucacgaggucaggaguucgagaccagccuggccaauauggugaaaccccaucucuacuaaaaauacaaaaauuagccaggcaugguggcgugcgccuguaguuccagcuacucgggaggcugugguugcagugagccaagauggcgccacugcacuccagccuggagagacuccgucucaaaaaagaaaaaggaauccacguacagcuccuaucuguccugcaagaaaaggaaauugacgaagcugggugcagugacucacgucuguaauuccagcauuuugagaggccaaggugggugaauuaccugaggucaggaguuugacaccagccuugccaacauggugaaaccucaucucuacuaaaaacaaaaacaauuagucaggugugauggcaggcgccuguaaucccagguccucgggagacugaggcaagagaauugcucuaaccugggaagcggaggcugcagugagccaggauugcaccacugcacuccagccuggacaacagagugcagagugagacucugucucaaaaaagaaaagaaaaaaaaaaaaaaaaaaaaaaaggaaacugacaagaaggccaaaacaaagaaacagaugccaauugcuuggggcccucaugguagcuggggaggaacuaccaccuaccacuggcauggcugauuccccaaguaacugccugcaggucccuggagcacacacaggaucuuguagcaggaccugcaggcucaaaucaaguaaaagcuagucucagauauucaguauguuccccuugauacaugucucaggacuaauuauuuuacaaggccccaaaucacuaacaaaacuguugacuacaguuuuggcaaucaucauuuaagucauuacuaacgguuggaugcaauaaauagagaugacagaauggcaaacagcugagaucccaccuccagagcccaagaacacagugucagagaaagcuaacagccacagcaguuccacgccggcucgcccaagucuucagauguggcccugcccaauaaaucagugucugcaauggcaagggccacucucuuacauuuuacaucaucuuucuuucuuaaucucaauguugaugauguccacuuagaagcucaaaaacacgaugagauuucuucaauggcuucugcaucucucuuuuuuuugagauggagucucccucugucgccaggcuggagugcagugacgccaucuuggcucaccgcagccucccgaguucaauugaccagguucaagcgauucuccugccucaggcuccugaguaacuggaauuacaagcgugcaccaccacacccagcuauauuuuguauuuuuaguagagacagggcuucaccauguuggccaggcuggucaacucuugaccucaagugauccgcccgccuuggccccccaaagugcugggauuacaggcgugagccaucaugcauggcugguuucugcaccucuuucaaaugggauuuauuuuuuaaaguaagauaaacauguuaauaaaauuggaaaccgauuuguacguggcaaacaauuuuuagguggaaagucaacugccuugauucauauaggcauuuauacaaauuguuauggcuauagcagcuaaguuucaccaaaaagaaagauacaaguaaauuucucuuagaacauagugaaguucaccaggacuggacacauaaaauggccagcaucucugcgugcugccccccggaaaggguccggacauggcgacauaugagagggaaaacuccucccaaucagggucuggugcugguuggagucugucugaugucaucuuucccaggacggucuguucuuacucccacggcccaggcguggaaaccgugaacccugaucuucaaucccacccagcaccacagaaugcuggggauguucucaguaccuguucagcuguaucucucccccucagcacuguugguauuuuaggcuuaacaauuauuugugguggggggccuuccugugcauugugguauguucauaagccuggccucuacccucuagauaccagcagcauucccccucucugaauaugauaaucagucccucaaggcaaagucuccugaaagcagcagcuacaugaaggucucagagaauauagugaacauaaggaagaauguaacaaaauagcucagggcaacaaggauccccugcagacaauuggcuguaggcaaugaccugucuggugcaccaugaagaccuagcugggaugcacccucugcagugaacacugucuuuuuuucuuucuuuuucuuugagacagaguuuugcacuuuucacccaggcuggagugcaguggugcauucucugcucacugcaaccucugccucgcggguucaagcgauucuccugccucagccuccugaguagcugggaucacaggcgcccgccaucacacccagcaauuuuuguauuuuugguagagacgggguuucaccguggcuggucucaaacuccugacuucaggugauccgcccgccucggccucccaaagugcuggguuacaggcaugagccacagugccuggcgaacacuguccuuuucacauugaaguaagugugacuggguguacguuucagagugcacagcauguauucaguguuguucuccaguaacuucuuucuuaccuugaagcacucuguguaguacuuccguuuccuuggcccuucucaacaacuuggaccccacacaucacucagggcuguuccucaucagcuacagguuuaaccuggcagagaaguacaaugagcugagauggcagcucaauggcacagugacacuggagccaccuguggaaccaugaguccuaccuugacuacgacuuccacaggcggagccgagaaaacaauaauaggugggaaccuggacuccuaacugacgccaggcagacucaauaaaguaaaccaaacuuuuaaaagaaaacaaaggagaauguccuaaggaucuuggguagacaacggugaucuaagacacaaaugcaucaaccauaaaaucuaagacuagccaucauaaaaagcuucugcucaucaaaaagauuauagagugacaauacaaaguaagaacauauuucaguaaaaauaugcaacaauggucuuccaucuagaauauaucaagaauuucuacaguuccaguauaccacaguucgcauauggcccccaagaagaguaugcuggaaacuuaaucccccaucauucugggagguggggcguuaaugaggugauuaggccaugaggcucuacccccauuaaugaaucaaugcuguuaucgugcgaguggguuccuuauaaaaaggugaauuuuauucccuuuucucuuucuccucucucuuugccccuuggucagggaaugacacaccaagaagacccucgccagaugccaaccuugugaucuuggacuucccaaccucaaaaacugcaagccaauuucuauucauuauaaauuacucauucugugguauucuguuacagcagcacaaaauggacuaagacacgguaagaaaaaaauccagacaaagcaauuuuuagaacaggcaaaagacuugacaggaacuuaagagaauacccaaauagccaaugaaaagguaucuaauaugcaccaggaaaauauagauuaaaacgugcugagguucuacuacaaaugcaccagaauugccaaaugcagaggauaaugcuaagaauugccaaagcuguggaacacaacucccaugcgcagcuggcaggaguggaaaucgguacaacucuucuagaaaaccaccaggcgguuucuaccaaagcugagcauguguaucccaaugggccagcaaucuucuucuagguaugugcucaacagacaugcguguagcacaugugcaccaaaugacaugaucauggcagcagcaucccuaacagcucaaagcuacaaaucccaaaugaccacgcacagaauggguguauaaucugugcuaucaucacacaauggaaccguacacagaaaugaacuacucccucccucccucccaugaggagccuccucuauuccuuucuuuucccaagcuccagacccccauuaccccacuaucaucccuuaacaccacaggcagcauccaccucugggccacagaagacgacccugagcaaacguggcuuaaggcuccaacccugucaacuccacucaggugggcuggggugugacacuggcccuggaaggcugguccaggcagcagcuggguucuagccccagcucaaccacuuugggagcacggccaucgcccagucagcucuggccccuacacaccaugggaggcucaacuucaaggagggucaagaucuccucuggguccagaagaucuccucuagguucaguucuguccaggaacacugucaccacucagcucuuuccccaggaacucggccaccucccuucuuucaucacagccccacacuccuuccagcuccuuccacucacacaaaagagcaccugggacuugagaggcagcgcgccucuccacgcagcacagacuucacuuuccgaguucuccugccaccgaccugacguggaagacacacuuggcacaaaaggaccagacaaaacccagugccagucaggucggcguuguucugagaaggcagagagaaaaacagaaacugaguuguagcagggguuaacaauuuuauauccacucuggcaagagauggcucguuccuugugcacugucuacguauuucccuauuucaucccuggagaguuuaaauguccagaaagguuucuuccuucccagacccucuucauccuucccccuuuaaauggucauuucugccaagaaucaucugucucgcuacuuccugcugguccauuaauuacaauaacaagaaauaacccugcagugaugucauccaaacuuuuacuuccuguagcgaacgcacaggucaggccaacugauguguguguccagaugcgccacgccuccauuuugaaaagagaaaaaauucaccacucuugcacuccaugaaagcuuuuguguguccagaagcacucaccccaagguuuuauaaguuaaauaaaaaugaaaugcgugucaggcaccgcuaccaccaaaaugucgcuauuguaagcggaaaacaagccacugauugugcagagcugugaauguagguuuauauacauaaagaaaagccacauuuucaagacacauguaaugagaugcaggguauaagacacauucagcguuuccagcaugugugagcuggggaagaguugguuucugcagaguugguuucugacaucagcagggauaaggcggcaccuguuggggauggagugacucccuuaucuguguucuuagagcaacaggacuggagacggggaaggaagaacccccaucuggcuccaaacuccccgggcucgcagaaagggcucacucacccccucaccaggccuggcagccaauaguaaucggugugguucauuuuuugaagggaucaaagaauaaagccacauccaacagcacauucuggaaaguucugggcuugggauuaccaacaaaaagggcucucugacacaaacaacugggagccugccuaaaagaacccugaaaacccaggucagcugaagaaaucacccaugaaaaagcugggggcaccguggugaugcccaccccagcugaugcccacgggaccccuggcccucugccucccguguucaaccucagcucaccucucauuuaguccaaacggggccaccauuuggagucuguucugugauuucagcaccugguauucaaaguuaucuuagguuguggcuuaagcagccaagucugacuucagauucagcccuggguggugcugauggggggaggugggggcugcucugaccccuucaucacaauucccauaagaaccuuucucaggccgggcgcgguggcucacgccuguaaucccagcacuuugggaggccaagacgggcagaucacgaggucaggagaucgacaccauccuggcuaacacggugaaaccccgucucuacuaaaaauacaaaaaauuagccaggcaugguggcaggcgccuguagucccaguuacucuggaggcugaggcaggagaauggcaugaaccuggcaggcggagcuuguagugagccgagaucgcgccucugcacuccagccugggcgacagagcgagacuccgucucaaaaaaaaaaaaaaaaaaaaaccuuucucaugggaggaugggcuugggcguugagaucaacagaggagggagguucuaggacauauuuccuaggcgaagauagguccaagaagauuauuuuugucuacagccugcuagaaacaaggucuuaucaauuauuauugauuacaaagccacuucgucaccucaaacugccuguucuguggcaaccccaagauuguucuacuuccacagccuuuuuuuuuuuuuaaacccaacacacacuggccauuuccucacaaauucuaccaggguugacuucaaagugucggggggaaagugcuguuuugaguugacacgaggucacagacaagccaagcugcgaugguuggggacagcucuggaggcggagcaaucaccggauccuguagagauggccaaagccaggaggacuucuucagauaccucuagggacucaugacucucacccagggcuuaaucugacccuuaccaauaauaauguucuuucuuuuuccugcuguguuuuccuaccauucauuacaaauuuuagaccaaucaaaaaauuuggaauaaccaggccuggcacgguggcucgugcuuguaaucccagcauucugggaggcugaggcgggcagaucauuuuggggucaggaguucaagaccagccuggccaacauggugaaacccugucucuacuaaaaauacaaaaaaaaaaaaacgagccgggcauggugacgagugccuguaaugccagcuacucgggaggcuaaggaacgagaauugcuugaacccaggaggcaaagguugcagugagucaagaucaugccacugcacuccugccugggugacagagugagaccuugucucgaggaaaaaaaaaaaaaaaaaaaaaagguggaaaaaccagccccugaugggccaccaggagcuuucgggagccugcccgggauaucacccggcuccaccaugugugacgcuccugcucuaaaguacacggaggacacagggcacagcgccuuucacagccacuggcucacaugccaguccacgguucccagcgguggcggcauuccucuccagggaggaaaaugcuacagaauauucaccaccggucaauucaucugcccgguuggaucuccuuccaaacuuaaaaucuagggauucaguccugcgaaugccauacuccgcauucuccuuacacagauugagaucaacaguggguugguuucaauaagauaugaagaaacaaugaggcaagaccauuuugaaacagcccauuauacauacagaaaauccaaucaagccuuggcuacaaaaacagaagggugggccgagcacuagcaugucauuaauuauuaauucuccuguaaugucccaauauggacuaaauaaccuauucccacaggaaaauguauugucauugacaauagaagaccaaaauaucuauaaugguugcuaauuugaauagaaucaguuccacgcuuaggacaagugacuauuccaauggagaguuuauuuacaaggcauuuucucacaugaugcagggagacugauuuagaaauugcaauccucucuccugugaugaaaaccacuuccacgauuaagcacuccauggagaaguacuuacuuacaagcuuuccuuuggauucugaauguuuucugcagauuuuaaacagagucggcucacccuccauuccugguaaccaugcuaaaugguuucgauacuguaccugagcauuuaagugauccugucaaauaaaacguuccuccaaguuaacuccgcuguauauuuaugcacuuaauaucacagcuuacugcaaagugcacaaaucauuuuaacagaguauaaauuuaacuaccaugaaggcauuuuauacucuguuuaacuucacugaggggcccauauuuuuuggagaagauaaaucaugcuuccauauaacuugacuuaggggaacagcagucaaaacucacaaagagaaauacacccaguuuccuuggauuagggguaaaaaaaaaacacacacccacaccgucaaccaagacaucugucacccguaccucuuaccaagcagugguagccaccagugcacccagcccagggcaggugggcuaagugaggggcugggccaugagagugcacucuccucugccccuggucacuguccucuggccguucuggaacaauggggauugagcgcugucgaccugacaacaccccuagcaugggagggcugccaccugugccaucuuggcugucaucauuggaaacacaaucuccuguggaucuuuucuaaaaggagcuccaggccccacugccaaagggucuccagacgcacauaagaaauuuaaaaagggggaaaaauagucacgcaagaaauccaugcauacagcagcugaagucaucaauuauuuauugaaugagggaaccuuagccauggcccaucuggaagggccagacuuaggucucaagcugugcccugcaggucaacagcaggagcucuucugaccugauaggagucucugaacucaacucagggucacaggagugcacuuuuaacguucaguggaggcaacugcacaugcgucaccuccacaaauuaagggcacagcgcugccucccacaucccauacccagaccugguauguuacgaugcacaaaaucauguacaggacuuaaaaaaaaaaaaaaggagauugagauaauagcuuuacaguggagaaagacggacucgaucuuagccaagugaucaaaguuaaccccaccaauaauaagauaaauucacaugaugugcccuccuaauccgcugugcugacaacaacaguggguccugagcauucccgcccaaagugcccaacuccaaucaggaaaaaacacaggacaaacugaacugagggccauucuacaaaaugacucaucugcucucuucaaaaacaucaaugucaugguacaaaggaggacaagaaacgguuccagauuaaagaugacuaaagagacaaggaaaccagaggcaacgcagaauccgaaguuucuuuugcuauaaaggaucuuauugggacuacuggcaaaaucaguaagaucugaauauuagauaugauuaucaauguuaauuuccugaccuugauacuugucuuaugugaaagaaugggcacuguguuuaggaaaaauuaacuccuccaucccuaaauacuuuagccuuauauauuugcaaauaucucagagggaucugaagauuauauacucugugcguguguuucuguauaugagagaaacacaagcaaaugugguaaaaugucauuuggagaggcuagguaaaggguaauuagaaauucuuuguuccauucuuacaacucuucuguaagucuguaauuaugucaaaagaaaaaguuaaagggaaaaaaaaaauagacaugaauggccacagugauuguguucaaguuuuagaaucaagauugacugauauuuucccagagaacccaaauuuuugcaaugugauuucauuacucuuuaagguaaacuaccaaaaauaaaguaagagucacagcaugucaggggcgcuucagauggaaagacaggcgggucaggcagggcaaggucccaggccuccuucugucucugcuguuggcugcugcagaggaaguggccaccgagaacccacccugucucuacccaggcucaaguauccaaaccccaggccagcauggucagcgcugcccaggggcaggcucuguaccugcugcugugugccagagaauuccacacggccacaguacaguccagaaaccagccagaaccagcccgugggcaagggaacagaccugaaagucacaaagcuuggcgugcccucccugauggcccaaggucagggcuggccacgccggagcugggggcugcccuccuccccccaggcagccugucucugcaggccggcuccgggacacacugucuucaaaauccccauccaugcuccuuacagccaguggacagccucgccuuggagauguggccagaugggcugccucuuaaguccucguccaugcuccuuacagccaaugggcagauucaccuuggagaugcugcccuucuggccucucucuggagaagacaaaaaacucaguaacuuccccaaaaagcuccugcuuuauguacugaacuuguacuucccacuaaaaucaauuauuaauaagauuuaauaggccucuugccucagguaucauuuccagcuaauuuuuacucccccaugaggagaguaugguggcugcacaagucacguuugcacacuguauccaugaucauucugccagcuuuccucuuuuuuuuuuuuuuuuuugaaacagucuugcucugucgcccaggcuagagugaaguggcaugaucucagcucacugcaaccuccgccucgugggaucaagugauuuucgugccuuagccuccugaguagcugcgaccacaggugcacgccaccacaccuggcuaacuuuuuguauuuuugguagagacgggguuucaccauguuggccaggguggucucgaaugccagaccucaaaugauccgcucgccucggccuccugaagugcugggauuauaggcgugagccccugcacccagccuuucugagaauuuucacaggacauauguccagcaggccucggcauuaccuucuacuccagaaaauucagcucagaagccaaugcuccaggagaggguuucccagagcacaccaagcaagauuuaagugcccucucucucugagccagcacaggguccaucucucugggggguugguccccaccagacugcaaguacugggaggggaugguuauccccuuggcucugcagccagcggcugcugcagaacacguguuggacuaaauaaagcuagacuuaaauucugccuucacgucgcaaguuuacaucugacaccaacaacguaagaccaccagggccagcacgcauucucaacauacuuuccaaagcuggaaaaaagcacagccaagucacucagaaaagccucucuugauuuggcuucuggauaaaaaagagucucccugucgugccagauggggucaacuacucggugaaaacagaggcccauuccacaggcaccacugcugagccucugaguucccaggacagggcuguccgaggacacaacacugacagccaugugcagacccccgaccugggcgaggauaccgcccucugagacucagucgccugucuacaaaaaaggaaaagauaccacauuaccgugaccaucuagucuaaugaaaaugccaccaggaucaaagaccauaacgcaaagcccucuguuugcaccuuaguccgaacaagcacccaggauacacucgcuguuguuuguuuguuuguuuuaaggcaggaucucacucugccucccaggcuggagugcagucuugaccuccuggacuccagccguccugccacgucagcuucucaaguagcugugacuguaggcacgcaccaucacacccagcuaaaguuuuuuuuguuuuguuuuuuugagacggagucuugcucugucauccagcuggagugcaguggugcgaucugggcucacugcaaccuccguucccugguuuaagcauuuuuccugccucagcuucccgaguagcugggauuagaggcaugcgccaccacgcccagcugauuuuuguauucuuuaguagauaugggguuucacuauguuggccaggcuggucuagaacuccuaaucucaaaugaucugcccgccuuggccucccaaagugcuaggauuacaggugugagccacggcgccuggccccagcuacguuuuuugauuuuuuguagagaagagagcccacuauguuauuuuauuuuuuguagagauguuauguauguugcccaugcuggucuugaacuucugagcucaagcaauccuccugccuuggccucccaaagucgugggauuacaggugugagccacugugagcccagccggcugcuguuuagaagugcaucacaaaggaugccuugaggggcuuggggaacaucucagggaagaagcugcacggagaacgguccagucauccuucuauuucgagccaacagcagccccguggaaggaaaggugacuaaaugagaaggaaugugacucagagggaggcgcucuggaggccucugugccuaccccaggaggggcuggccucuagguggagucccuaccaguccggaggcucccgcccaaaccuuccccauccucucugggaagggagggcgugaggaggugguccccuggaagccaccuccccagcccugagguucacaccaccucagucucagggguccggggguggccccaguuaaaacauggguuuccagaccagugaagcacucagaagcacagcccuucuccuugcccguucuguguccccuggcagagggugggucugguaucuguguagcagguccugaccccacccaagcagcagcagugucccagcacccccgccuuccugacccaccggcacucuuucccaccaagacgccuugagauccccaaaacacgucuccacugcugccccaagucugcccccaaagguuuggccuucgccaccuguuacugcccaggcuugacacacagccaugaguuccgccgucgccacgucagcagaucucugccaaugugugccugcccuugaacauuucccccagcucuaggcaaacaaagcccucuccuuagcaacagcucacugggcaaaacccaaagaugacccgaccuggcgcaccuccagcacuccaggucuuggcucaugaccaugggacugcgacagaaauuaccuucaacccucacgucaccacccaucacccaagcugcgacaccaauacaucagcaggagaaaugaggcggauugcaaacagcugccgaguuccaagauaaagaguuuuauuuugguggcuaaggggaaaaguagagaaaagccgccaacauuuuuaccaacagcauaauuauaugagagaaaacucccuccuuuaagauuccuacgcugcccugacagcaauuuaagcagcugagaaaagauggugaagacaaagucauuacggcaggaucccgucuccuuccuguacacacgccugacucucuguaaugacaaugaaagaaagcucugcgggcauauggcaggggagccaccuccgugugcaacagcaguugcaucaagucuuuagugcaggauuuagcugucuuaaagauccuauuaaccagagacaauuuccaucccaggcuccaggcagagcugggagcuuuccuucagaaacgagggcgaagaaccuccaacaguaaguuuucugcgggcgcuggaacuuccagcccaaagccuucagcaaaucacuccauggggaaaucuaguccugucagcuuuaaacuggccaccuugcauuaacagggacucucgcagcugggguguggguaaucucaaugcacagcucugcuacuauaugaguucacucaaaugauccccuuguuucugcucuuaugccuuccaagccauuuuccagagacacccaggaggauucucacuggaaacugaaaugugauccuagcccagugucuggaagcucuccagcaacgcccagugccuucguggucaagauccgggucugcccucacagggccacaaccgcacuggcuccugcccuggguacagccccucggccuccagaccuuuccccagaugccccauggcuggccuccuccugccacgccaaucucagccuccccacagagaaccacucccuguguucucaccaaaggguccccucaguccaaaguaucucucuggucuuaauguuugugucccccugcaaauuccuaugcugaaagccucauccccaagguggugguauuagagggugaggccuuugagugguaauuagaugaugaggguggagcacucaugaacgggauuagugccugaugaaagagcucuuuuggccaaggcucgguggcuaaugccuguaauccuagcacuuugggaggccgagguaaguggaucaccugaggucaggaguucgagaccagccuggccaacacagcgaaaccucaucucuacuaaaaauacaaaaauuugucgagcgugguaaacuuugauccagcaaucccuguaaucucagcuacccgggagacugaggcaggagaaaauacaaaaauuugccaagugugcugguaaucggcuguaaucccagcuacuugggaggaugaggcaggagaaucgcuugaaccugggagguggagguugcggugagccgagaucacaccacugcacuccagccugggcaaucgagcaaaauuuuauuuaaaaaaaaaaaaaaaaaaaaaaaggaagaucucauuugacccuuccacauagcgagagaguaccgucucugaaccagaacuugggcccucaucagacaucgaaucugcuggcaucuuggucuuggauuucccaagaauugugagaauuaaauuucuguugcuaugagccaccugcuuauggaauuuuguuauaguagccaaagcagacuaagacaacaugcucuccacuugacacugagaaagccaggcccucagggagggggcuccgccucuagaacacaaguucagugggagcgcggccacugcaccugcggauccugaggaacaguccacgacacacacgugcgcccacacacacgaucucugaauggauggaugacugagucugaagagaucaugagccagcccugauucuucagcccuaacuucaaccuugaaaggaaaauuugggcaauuucuuucuuuuuuuuuuuuuuuuugagacagagucucguucugucacccaggcuagagugcaguggugugaucucagcucccugcaacuuccaacuccuggguucaagcgagucucccgccucagccucccgaguaccugggauuauagccugccaccaugcccgguuaauuuuuguauuuuuaguagagacgggguuucgccauguugcccaggcuggucuugaacuccugaccucaggugauucgcccaccuccagcucccaaagugcugggauuacaagcaugagccaccgcgcccagccaagggacauuacuucuuaaguacagaagcaucagugaaggucaguggcaugaugcgcugggccguccuccacagguuauuauaaagaagacauccaugaggacgaauguccacaccugccaggaaacacucccccagucccccugaagggcaaaggucugucuuccaaagagccugggccugcuccuuuugucauucuacuggcccaacacccacucacaugucucucauccccccacuuaguccucauuuucucgaguccuucaguuugaccaacaaucagaccccacaucuaggagugugcugaauaacucagcuuuguuuaagcacaagaggucucugggaugcuucaacgccgacucccacagcaugccacaacaugccuuguggccaggcggccugacugcagcucacagcauguacaugcucucucucacugguggacagcuuauguggcuuuacaaauuuucuugauuuacaagaacugugcuuccuugucucccaacccaguucugcccucuggaaccgguugccuccccauuuccuggaacaauacuccaaggacaggugcuucuucucugggcucagcagccucgggugccugaguuacuuuccugcaccguccauucccaccuccuucggugagcucuucaaauggucaaggcacagcucacauccggcccuggaaucugacccaggacgccagcccacagagaacuguccaggaugcuugagagccuauggagccaccaagagcuaaacugaaaagggacaaaagaucacaggagauccugucaagacaacuguaacugguacguacugugcgucggagauacuguacgaugucauucaagaagcucacggaacagcacugcagucggcaggaguaacaacagaaccaggauaguggaaggaaguuggcaaggggcguggaccgcugugggggauucuaaagaaugaaaaagggaugggagcgggaugaccugugcaguuaguacagaugauaaccaugaccccaaaucaagaguuauaaacauacaaagaaugucucuuuaccacucaaacgaugacaggaggcaucaaggcagccacuucuaauacccgccaugcaaacugaggguuuucuuugaugcugcuggucaucacucaaucagccucagagcaugccauuuaucaaucaaugcaauggacaagcugaaaucaccccggauaaccucaggauugaucacuauugcucauuaccuucugaacugcagggaaugaguccacaucaccugaaaaugucucucuccuggaaauuacacaguaaguguuuccguuggcuagaaaucaauagcccuacucaacgccuaacaauugaguuuuguuaacgggcauacaaaaagagggcgaagaucacacccuucauacuucccacuucucaccacuguguaaacccaccugccuucaagaacugcaccaaauucggagaccuaguugggagaugaaugccccagagcucucuguccucccaaagagaguuucauuaucaguucuuccaagccaaagaucaagaugagauaaauaccaaacagaaccauuucacuuucuucaugcaucacgugugucuuuuacucuagcugggauucacaaauucgguugcgaagauauaaaaucaguaucagagacacaaaagccauguucuaauuucuuuaauaggguaagaauaacaucucucacaaguauauuugucacuuaugccucaaaacaagcugcgaccuacauaguauuucagagccguaugacaugcugcaaacauuuuuuuacuuuaaaagacgugcucucgacaauaaauuuuaggcgagaauaaaaguugcuuuuuucauaaguguaaaggaaaacaaacauuaccaaugggauuuuguuuuucaacaucuggagauucuaaaguaccagagguugacacaaaaacuuuaaaucaaaguaaugaaaaugccugacagaaucagugaaauuauuuugugaaagagccgaccaaacuggaugacaguugaacuuccgaagucacgguguggcucagggggagcacaggugucuaggggaggggucaaccuggagcuauuaaaggacccuuuugucaaccuagagccuccaagaacaguuucuggccacuguuugggcuguuucucuuucugagucuacacauuugcaaagugugcagaucaggcaggcacagcucaaaguggcugaacacacccagaaggaccagccagagaauguaagaugugcaggcgagagcagcuggggagaaaaggaugcuuccaggaggcggaagcugggcagcuuccaggacugaacuacacaugcauuuccugcagaguccuagcucaauccuugacacacagcagggacuuaauaaaugucugcuccauagcauacacuacuaguauuugccauccagcugaccaagggaauggccuaaugggugggaccaugucacaggaggguucucaucuuggccucuguuggcucaguuucauaugccccuccccuggaagucugcacacugauguuguccuugggaacacuuccgacuaggcugcacccuucguguuugcuccacuggugggaaccugggggccaaggggccccagcagucagcaccaaugcaauaguccuugaagaucacggccaaagcuauacuugcucuggacagguaacucccccuuucaugggcaggggugguaaaaggagcaagcagaagcaaaaaggaauuuuccucuaaaaacagaauugcugaaaggcacuuaauagagggauaggggccagacacgguggcucacaccuauaaucccaguacuuuaauaggaagaggcugcggugagccgagaucaugccacuguacuacagucugggcgacagagagucccuggcucaaaaaaaaaaaaaaaaagguuggggggaugggauuuggcugaaacaugaaacagugaaaugcaaagaauguaucauaacugaauauguaucauaaacugaauuacagacuuaagauauuuuauguuuauaaaugauuucauagaaaaaauauggaauaauaaugguuauuuaaaaaaaaaaaaaaaagcugaggagggccagcgugguggcucacaccuguaaucccagcacuuugggaggccaagguggaaggaucacuugaggccaggaguuugacaccagcuugggcaacauagugagacccgaccucuaccaaaaguuuaaagauuagcugggcaugguggcauaugccugcagucucagcuauuugggaggcugaggugggaggacugcuugagcccaggacgucgaggcuguaguaagcugugcuggcacucacccuggacgacagagcaagaucuugucucaaaaaaaaaaauaaauaaauaacaaaacaaaacaaaacaaaacuggggagaugggggaaaauaaccaaccacacugacagcaaguuggcaaagugcuuacgucuccaagcacugguccauguaauuugcagguacuaagucauuuauccuuuacaagcuuauaaaacagguacuauuauuacuuauauuuaaggaggaaauuggcgcaaagaaaagaucagccauuuucccaaugccacacagcuaccaaaggcagaggcaggaauugagcccaggcagcuggaugcuagcauacaugguucugccaaaagagacaauugaaaaaacaaaggauaugacuuaacacaaaccaaaaccauaguaaguacagauuccacuuagguaaaauccugggugugcacacaugcccaaaggcaguaagagggaaagaaaaguauuggagaggccuacuggucugcagagguaucuaugcacaaucugccauaucgaaugggaaugcaggaguaacaggacuccuuucgguaagccaacacagacacccuccguaugcucagaugcacuuguacguccugguaaaggcaaggagaaagacaguaucugaggacuggggagggaagguaaucagcucugucuucguaaaucuugcauugcacuguuccccucuucaacaaaugcaugauuccuuuggaagcaucagggugaccagcuauuuuauucccuauuuaaaaaguaacauaggccaggugcaguggcucacaccuguaaucccagcacuuugggaggccaaggcaggaggaucacaugagcccgggaguuugagaccagucugggcaacacagggagaccccaucucuacaaacaaacaaaaaauuagcugggcaucgugaugcaugccuguggucccagcuauguggggagcugaggcaggacugcuugagcccggaggucaagacugcugugagcugugacugugccacugcacuacagccugggugacagagugagacccugucuuggaaaaaaacaaaaaaacccaaacauauauucauuacagaacauuuggggaggaggaguggguauggaaaaaaaaaucacccaaaauucuaccaacuaaagauaaucacuaugaacugcuccucaucagcuuucccccaugauuauuuuuaugguucuauucauaaauguucaacauuugauauugaagcuuuucauuuuaagacaagcauucuacuuauuucaaacugugaaggcaucauuugaaaaagaauuagcuguuuucccacuguuggaugcuugagucaucugucuuuuugcugucaaguaacaccauaacuaaaaucuuggugcauuagagcuuucuuggcauuggguggggaagggagauuacuaggucaaagagcaugguuuccuugucugaagauucuuuuuuuuuuuuuuuuuuuuuuugagaugaaguuucccuuuguugcccaggcuggaguacaguggcaugaucucuaugaucucugcucacugcaaccucugccuucuggggucaagagauucuccugccucagccucccuaguagcugggacugcagucacgugccaucacacccagcucauuuuuguauuuuuaguagagauggguuucaccacguuggucucgaacuccugaccucaagugauccauccugccuccaccucccaaagugcugggauuacaggcaugagccaccacucccagcauuccuugucugaagauucuaauggauuacuucauagucacaaucuaugacaguaacuuaucuaaccuucuucccacccgccaccagcaaguauguggggacagaucuggacagacacacacacgggcauggcggccucauccuacaggguuaguuccauaguagcaagucaggccccgggggcaguggaguagaacagaguggugccaucgggagguggugacgucaccaggcagcagguguccugucucuggauaagcccauguugggccacacuguuucuuccagaacguacccaaugugggcacuggcuuacguuuaggagcaacgacuucuacaacaugcccaguuaccacaugagagcgacacccagugagauguucacacaaagcauggcacacacagcgccaggaaaacagcccgccuucuagagugggggggggcagcacgugcuuccugaguuuaacgguggcccauggcccaucucaggacccaacaccagccccaaccguuacguggugcuugaauggcacucagaacgcgcacucagugcccagcgacuccagaccccaagcugaccguucucuuuacugccucaguaucucagcccccuucaucugcacuguccaaagccugcucaaguaucagaagcuguuuccuucgucagauccauccugcgugcuuucuacaugagcaucuuuaaccucuaaugcugggcugaaaacaacucaguguuuuggaaaguuaaguuuucuacuccagcaaucugaggguggggacauccacaggaacccugcggcccacaaggaaaacagaaggcaggcuuaaucacugaauucucacugaagaauuccagcggccaaauguccuuucuaauccugugugcuguucugagagaacauucuagccacuucuuuguauaugugaaaaccacugcagcagguccuauuuugggcagauuuuccacauuaaaaggcacaaugguuaaaaugaucguaugauacaccucccacccacgacacuuuguuuaauucaaacucaaauaccaaagcaggagagucgacuguuuaccacacuugaauuuauaaauggccuuccugcccaucacccaggcugccccacccccucccuucuuucgacacagcugggugggaaugcagugaccuaauaucacuggacagauaauuccuugccuuggggaaagacuggcaaagcccacggcaucugccauuuccaaucuacuccucggaaugguaaguaggggcuugugccaggacgcucagggggcagcacagaacgcgcgcaaccguggcuggaagugaaaauguaaaaacccucccacggccucgcugggagucacugcucugcauuggaaaacccggguguuugauucaacuaaaucaucucaaagccugcacuggagaaaauaauugaauuaaagaguugcuauaacucauucaagugagauaaaaaccauccagugggaggcgagacggcaaggcaaagacacugcugcuagaaugugccgucuucuugagauugcgaggagaaacgcaauauaaugugguucaaaggacagaugggacuuuccuaauuguccccagauuccuagcagcaggggugguaacuaaaugguuucaauuaaaaguuaaagaaacagaggaaagcaggcgguaaguuacgccuggugcugauaagccucauucggaucagucucagggaugcuuuguccugauuucagacagccaagugucaauggcacacaagugguggagccaucccaacaugucacccugacaaggugacaaauaaaucugucugucaaaugcacugucaugaacacccaugugagcaucauggagccaagcaccaggcauguggcgacggcucagagcagggcccuuccaucugcaaucaaggagaaaaagggacggacgcaaucgcuagaacacagcccaaggaagcaacgaugauguggggguuacgcaccucagggaggacgcuccaccucugacaacggcuacagggugguuuccgugccaagcacgguauggcucaaguacagugugacaagggccauggaaucaacuucuaccccuucaccaggggcucucaagcaggggacacugggcccuaucuggcgacaucucuggucaugccgggguggggagggaggcaacacuggcaucggguggggagaggccagggaugcuguugaacauuguaugaugcacaggacagccccccacaaugaagaaccaccagacccaaaaugucaacagugccaaaguagaaacuccugccuuaaaggaaucguaaguugaagucucugaaguuccaaacuagaaaugcugagaaauggcuggggcugauuaccggcaauuuuuuuuuuuuuuuuaaccaacauaggacauaagcaauacgcugaaagggacaaguaagugcaucaaaaaagcagaacagacgacgagcaugggggugggcuccagccucugaagaagcgcggaggaagcaaguguggcagggcuggguggcgcuguccugcggaugcugauucagaagaagcugacccacagccaaguguggcugagguggagcugagaacaggagguccccugaggaugacugcagccccaucuuuuaggguaggucucucaacacacucacaauucccauccaugucacugcucugggaggaaguuugacacacaccuagcaaacagaucuuggaaaaaaugaaucccuaaaugugagaaggucucuacugacaaaggcaaacagaggggcguagggucccagaaagccaaggucaaugccuaaggcucugaaugcaaauacucagcauccaccagcccaaacucagaaggcagccccagcuaccaccaggcugcucuggaguuacgcagcccagccacgcuuccaagggauguggucaaaacagaaagaccacccagcaaggagggcaggaggagccucaucucaccacagaaaaagggacgaaaugaaccugggaacagcuccguugguguuaggggucaccaggccccaccaccaggaaaagacaagaacagccacuaccacaugcucugaggacgcuaguccuucuggaacugugggccucagaaggaagcagacuaagaugcuccuucuucccaccaauacaccccacgucuggguggcuccugaugacuuuucgauguuggcagauguuuugugauguccugaccucaaaacuagguguguacagggacagggccuggggauucaggcuggagcagacgcugagcuuugcagacagcacaguuucuguaggaaguaguagguuucucacuguuuacaaaagcucuguggugacuccagguuuaggcuaaagaugaccccacucaggauucacuaagccuugcuaaggcccaauggucaugaggugggaggcaggggaguccuugccucugccaggaaguccugccaagucuucacccccucggcccuaacgcagccguuucuaggaagcccuaugaacuguacacccaaaggcaaaccaggaagggagcgcagggagugggggcucaucuccuuucccuccacuccuuaauacuuaggggguuauucuuuuguccccuuugucaaacacaaaaaaagcaaaacacagcacgcacaugguugaaauaagacauguuugcauucuuguucuaagaacucuggcaacaaaauccgaguacucaauuauguagccccacuauuaguuaacacuucauuacuauacuucguauuuccuuuucgucuuuuuuucugagaguagguuaaagagaaagaagacagugaacuuugcugaaccuaccccauggggaaaaaaugucuccaaguuaugaaaagugaaaaagaaaacaaagaugcaaaauaacauagugauaaaaucucugcaugauuugagacuaucgccucaugaaucuaaagcugacugaucaauacuuccuauuucccagcucagaagugggacaacaucgcuacucgacuaaacagauggcuaaccacaacccaguaaacccccucccugccgaaacaguuacuggacaggagaaugcagguuauagcacguggucauuuacaaaacuaaaagguaugaaacucucugcugagucagguugccuagacacagcucuaacacauucugucaccuaagauuaucauauacauuaagguuuaaaaaaaagccagccagcccagguaagaaauacaaaagucuacacggcaugaaauagcucaaagagacuuguuugguggaauuaacuagugguuuaaugggggggugggggggagaugucugauauacaagagugccccaauuucuuccgagaaauuaacauuucaauccuguuuuuaucuagaagucauuaaacugugcaacaugaauuauuggaacuguagcagcgaauuaacucuauucaucaacuaaguccaaacauuuuagaguguaucuguaaugaaaaaauagcucuacauuucuaucucuucucauuaaaguaaaccaguuuucccucucucaguauauaaaacugucuucucuucacauaauuuauauuaccauaagcuggcacacauucuaaacuauuacaugccuccaauuaauuuuugcagcuuuugccugaaaauuuaaugagauaguaguggaugaaccugcugacuccagauuaugugugugcucccaauauuaauguuggcacaauaaaauaaucugauccacaccugacucaagcauuuccccucgcugggguauaaagguaauauggaaaccagguccgcucauuucagucuuuuaaauccaauuacaaaauuuacuagucucaaauuaaacugcuccuacucaucaaccugggagaaaaggagaaagcagcagcacagucuaauuaucccaacaccauuucuaucaacacugcagggaacaguuacaauggaugacuauuugucuaaggccucaguucucuaccguggagaagucacaagccgcacuccucaaagccaacccaaggaagccagcgcaacccccgugaugaguacaggguacaaggaagccuguucucugucccgcugcuacaggcgcgccuuaggugcaugccucacgugggguccauaccauucacaauuuguacacgugugcauaucaguguguccaugucagauguaugugugcacacgugugagcaugcacacgugugagcauguacaugugccugaguucagaugaauaggugaggggcauuggcaacuugaagucucaaugacaggcccucuguaguuccuacuuuuugccaaaggguugagguacaagcagaaggcaaaaaaggccgacgaggcugggagcaguggcucacgccuguaaucccagcacagcaccuugggaggccaaggcagguggaucaugcagguggaucacuugaggucaggaguuugagaucagccuggccaacauggugaaaccccaucucuacuaaaaguagcuggguguggcggcgggcgccuguagucccagcuacuagggaggcugaggcaggagaacugcuugaacccaggaggcggagaucgcagugaaccgagaucgcaccacugcacuccagucugggcgacagagcgagacucugucucaaaaaccaaacgaacaaaaaaugccaacaauaccaguaacagcagcagcagucaguaaucaauguucaaaaagugccugcuauccccguuuucuuuuuugccaagcacugagacggucccagccaucaguccacagguguguggacccagcacguguucagcucuuggagugaacggaauggaacuuaggcagacuacuccccaaauuccauucccucccuaggcugcuaaugacaaugacacccacauacacuagcccugguggcugagaauauaguaauaucaagagaauacacgguacccagcugcgucugguauaugcgugguccguaaggcaucacuugguugauguguguuuaacagcccuuaggaaggccaggaccuggggaugagcgggccaugcuuccgaggauggggguuuauguccaaagauggccagaagaccccccuauuuguaccugugcccugcaccuucacagugccaaugacgcagccuggggcugcugcgggugaacagagagagaaaugggggagggggagagagagagagagagagagagagagagagagagagagagagagagagacagagagagagagagacagagagagagagagagagagagagacagagagagagagagagagagagagagagacagagagagagacagagagacacccaggccucggagcugcccacccugugcuacuuuagccuggaguccuggcuacagcaaagaccaaggggcucaaucugcucuggggccaccuccucccugcgcccccuccauccccaccacuggguguguggggaauggaacugcaaagcuuacaauaaacucagcaagcucaccugacugagcauuuaccaagccagaaagccuccuuuccacgcgcugucggucugcaagcauggagucuagggagacacuguagaaaagccaucauacuagcacacggucaggcacguucaguacgcacagguuuauaccaacaucuaaacuauuuuaggaaaaggcuguggagcagaacaugcugggugugcaacugaaaccuagaccuagguucaaaucugacgucuguucuugccaagugccaagagaaaucaauuaaccccccuuauccaucaauuuauaggaauaaagguaaauaccucaaccuuguaaggcugugccacacacauaggaccaacucaagcugugcagcgucuggcacgcaugccacaugaggcuuccuuuccggggcaacuggcuggaccauucugggcccuccagauuaaaagggcccuuuucaacucugcuuuccugaccagagaaggccugggacaugagccccaagcuccaccacucagcccuccccccaaguucacugaaagauacccccauccugaacuccaacuggagccaucucucuccacucccuuuucagggggcagcuuucaaaggguacaauuccucacucucaauaaagcaaugcuuccugccuuagaaaaccaucaacaaguuuguauggaaaauaagcucuugaguugucaaaaacccauggcuaaaggagaacccaaauggugccaagcuaccaggggagguggcaccuccaagaguggcagaagggucccaaggacuguucagguccacggucucuuucucuggacccaucacuccagccagucugguccaggcuaggacggaguagggaugggggugauagauaagaccaggucuggccagccaggcucuucccagaaccaacacaaucccagcacacuguggccagaagcauccucaaaacaggacuuugcgcaggcucagauucaguccuaaggcaccagaaaaaacagccuuaaauuugacacugccaaguccugggggggcggacacagaaggucucaucuagaucacacauagacucugaaaaccuucucauauugaagaacgggagcuauuaacuguguuaacggcaugcacagauguugucuacaucuaaaaauucccaaauacaucaauuagcauauuauaaagaauuuacuuccauuuucccuugacagaucauaaagaccaaaauguaacgcucauguuugaauugacaagugcguauggcagaagaugcuguauuaaaugcagacaacagugaaaaaaaugguauuugaugauuggccacccaauucucagaguacaaugucaaaagccagaaauccauuuauuuaguaaccaaagcucaauaucacacaagucacuugggcucugguaagggaaguucuaccaucugcacuugguaauuccacuguuccgcucauuuccuagguaagauacugggagcauguguggaaaagcaagacaaggcuacaacccaggggcaaauacacgugcacacacguacacaaaucaaaggaacaaacauuuuuggaaaaaaaauuuuuuaauuuaauuuuuaaacaaaaauaaaagaaggcguaacaacauucuuaugugcugaaauucuaagcaugucuuuauuuguauguuuagaaaggauccuuuuacaggaaggaagggcuggaggagauaaggaugagaggaaaaacgcgaauaacauaaaacuaaaauuaauagaugcagaguuguccuucuucccauucuuccagaauccucuuccuagauugcaaaucaaaaucugcauuuaaauagaauguuuuuaguguaggaaagaggaagcccuaggguacaaagguauugcauucaggaucuaugggcacaauacuguauuuuaaaugagaugaagacuuuugaaauuuacugaauauaugacauauuccaaacugucuuguuauuacuacuauuuuuacuaaauucuucuauccuaauagguguuucucuuuuauggccagaacuuuuaauaaaaguaaugugauauuacaucauucuaucaauuaaaucuugagaaaagauuacacgauccagggaucuuauaagcugugggcucugauaauuccagccauuauucagugugaaauucaaacagucugaauucauuaacauugguuguuacaaaucggcauuuuuagacuuugccauaaaaugcaggaguccagacccagugaccugaaucuaaccgccuuucaugugaaguggccguguucccggccucucccaguguggcucucgagagaaagccucaugucuucguccucuccauggcuggccucaggcucuuuggucacacuuaauguucaggcaaauugcagagaccucaagccauuuaaaggaguagagacauguucccagggaaggauguccauuacgaaacagauguccaggugggcauaggagcgggugcagcagcauggugccagcaccucgccuuggcugcggcugggaucagcacacccucacaacuaaaaccccaaugcgugacauuugggaaaggcuucauggaaaccccaaaccuuucacugcuugauaggaaaacauuauuaccaggucgaugggcaaggagugagcaacccacaucccaagugccagguggaagacagaaccuucaggaacacagcagaccuucacgaccaagaaagguuugaguuccguucgucuugcaucgaaauguucauugcaacauagaccacagguaccggcuuggagagaugcaaccuguacuaccuuccccuccagcccagccaggcgagcagggcaucucccacaugcuaagccuuuggcugugugcauuuacugcugcuacugcagcaaucaucuuuguguguguacauauauucaugggguacaagugcaauuuucuacauccauacauugcauuguggugaagucagggccuucagugccucgaucgcugaaacaaugcacauuguacccaccaagccaccucucaucagccucccucgucaguccccauaaugucauuccagacucagcagucauucuugacuaagcucuuaacauguaccagguaucuguuaagccccguucaguacuguuucauugaauccccacaacucugagauuaagcacuacuaccugcugcauuugcaagagggggaaacugaggcacuaggcucagaggggcauaguuuguccaaggucaacaccaucagaggaggacaaggucaaguuguaaacauuuuuuggccauaccaugaggacucugcccuccugccaucaccaaggccaggaccaaguccugugcaauuagaaucauuaccuuccccuugcaaacaucaggaggaagugccagagccgcuggggcuccuggagggagugacuguuaugaugcaauuccaugcuaaagaauucuuccuggccacaucaaacucugcaucaaucugcucuguuuaaacacacaggcagagagggcuuuccggccuucagcaggccucugcagugcugccacuuaagcccaggguuugcagggggguggggaucagagcacaaaucaauguugaguccuccuucccagaggaagcugucgcccugugucaugguuuagaggucaucuucugcuguaaugagggaguggcagugaguuucaauugaauuacaaaaagccaggaguacuguacucucaucaaagugaagguuuuuuuuaacaaaugugggacuggggccgucaguuacacaugcaggaaacaccagcuuccaggccucugaaggugagcaaagcagcagccaccaugcuggguccuugaauuugauacagaagccaucugagcuuugucucgagggacccaggccuacaggacuugcagagccagugggccuucuugcuguccucaucaucccagcuuggauguagucagguuggcugaaccacauuaucccucaccuacgaggcugccgcaagagcagcacccacagguggcgggagaguacagcuggguccccacacccuaccugcauggguuuagacuccccgcccuacuugcacaaaggagaggcgggggcaugacuucacuucccugcgguggaaagcucaagaacacggcgugauuaucucagaacaugcacaccuccccugaacagguaguauaacaugcuggguugccuucugucugcagaaaacacucccagcuaacacagaaccaacccagccuuccagacagcugcugcgaugcgcuccuacaugugcccagcccacuccacaccccccuggccccacugcagccuggauucauucauucaaaaaauuacuucuggggcaucuacaauaugcaggccaugcacagaauuaaggggacaaugagcucaaggagcuagcucugcuucagggagcugcggaaaucacucuggaagguucuaaguucguagucagaguccugcuccuugguccaaguccauuuacaacacuuuuuaacuuccccugauacaggaaucagaaggcucagggagugagaagagacacccuuggcugcugcacuaagagggacugaagacucccuccagacaacaggccacccaggcagagggagcccaaaugcucacaggaaagccaaccccaggagguacagacgcuucugcgacaugcagaagagacaaaguggccucgagcagcuggagccaaggucuccuaggacgcaggccccauccaugccccccaggcgucccaccaccgcggaagugggugauagggaggacucacuugccaugaccagcugaaccaagggguauauccuacaaaccugcaguguccgggaaagaggcgagcuucccccaggaaagggggcaagccugucccacagcucugggacccuccuguaagcacccucccaccccugcugaagagccucucccccuacaucccugaggaaacugaucacccaagcugaauuuuucaaggaguugcagguuacacccuacccacgacaacaaagguuuccuuugaguuaaacaacguauagcugaaccggaagagggaaggugaccacgggaaagguguugcauuacaaggcucaggaauucgauaccuucaccaccaauucucguuuuccacaaaucccuauuaaaagacagcacgguaccguucccagaaaucaaggcucacaccacguggagcugacuggaugcucacggggacauucgaucccagcggccuggagaaaggacggaacaggaggacccugugcgggcgccauuguuguucaucaguauacauuuauaaagaaacggaaauuaaacacugucaucagaugcucugcacugcugcucauccacggcuguguuuuuucauccucccacauuaacauuucccccuaauguucuaucuuuuugccauauauaauuaauuuuaacagcuucugcaacuuccccacagguuguugcuguuucuuuuaaacaguauacugcugagaaauugauuuguuugcuccgcgugccugaagaaaccacauuaugaaauauguauaaaugucacuguucgggcugcuucucaggauaagugcagaaaaacguuccauuuuaccuccuuacacaggaguccacucacggaggcuacucgcauguauuacccgugugcucacacacaaaugccgaugaauuacgcagcauuuucuuugaaaaccuccuauuuauccuuaacugguacaaggcuaggggaaucaucuuaauugcuacauggaaagaaugaauugcaaaagcauucagucgaccaagaagacuuuauuuuuaacagcauggggccagguggaaguugccaaguuugccaaaaauaaaugaaucaaccaaucaauaaagcaaauguguucagcugguguuaaaugaaugccugggaagaaggaagccacagacagcacguccuucuuucuccccuucucccgcccccaccccugugaaaacaccaggcccgaggacacgagggucaugggaauucucagccauuuccuaaaucguuacuuuuauuuauuuauuaauuuauuugagacagggucugccucugucacucaggcuaaguagaggggugugaucacagugcacugcagacgugagcucccaggcucacacaaucuggccacccaggcauaggcaggcgccgccaccuggccgaguuuuaaaaacauuuucuggagauggggucucccucugucacccaaggcugagugcaguggugcaaucauggcuuacugcagccuugaccucccaggcucacacaauccucccacccagcuacucuggaaccugaggaccacagauacacaccaccaccuggcugauuuuuuaaaaaaauuuuuuuauagagauggggucuugcuauguugcccaggcuggucucaaacuccugggcucaaaggaucugcccuccuuggccuaaaucauuacuuuagaaaaugcauccaauuaucugcuccuucaacaauggucaaaauucagauccagauacuaaauccuaaaauuacugaaaguaaccaggcucuugcacuucugagcuauuuuaucagcauuuguagcugggggagcugcucuaaguugaaacuaaugccccuuuacacuugaaccuggcagaucccucaagcuucagugaaaugcuguguguccuuccauaaagaccaacugaaacugcuuaaaaccaagacauuuuuuuaaaaaaaaacaaguuauuggucuaaugcauucuaagaguauuaauacaaucagcaaugguaacgcauaaauguuaagcaaaaauauuuacagaaagaaauaaccuuuuccucugccacuaaucacacccagcaacacuugauuaguaagccaacauuuuaauaagagaaagcucacuucccugccuacucauuugcacaucggcaucuacgccccagccugaaacuugacaguaaacacaaugcaccaccacucccuucaacaagugaggcucuggcccugccgcucacuccauccacuccuucccacucuucuugccuuuaacaaacacacgcuccaagccucagagaaaucagccgcugacccgugucucuggcugucccacacaacagggcugccaucccucaguucaguggccaggccugucuagggcacaagggggucuccaccaggguuggcugaugagggguagcagaggcccauucucugcacacugccacacucucagcggaaagaugcaccccaugugcggccccacuucacauggaccaagugcucuuccucccacaacccuggguguggggacgguaccaugacaaaccugagaaagcuuccaggaauaucaaagcccccgggaagccaucuucacuguaaagggacccugcaguguaugggaagccaggcucacuaccacaguguuuccggaaaggcuuccaccagcaagggacgcggggcgaccugaguuugggguugcuucaucggcuccugaaugccagauauaccuaaggccacacaugcuggcagguggaucugggcgucaaguucuucacuaacaaaaugggggucuugggaaggguaugaggaucacggaaagagaagcggacaccacgccuccauuucccagcauaacgucacucaguggcaacagagacuccuggccccgccaagagugagaggcaagugugcccaccauccugcagaugcccugcucggagguaccccuccagcgaaggagcaacucagcaggaacccacccaggccggccacacaguguugacacaugggucacagugggaaaauucaggccuucugccuggucucuuccucccuacuuugcaaauccacucugaugagaaccagcagccaggguggcgcaggaagcggaaaacaacaguaacagcagaaagccagacucaccaggagaauggagggcgugaccccugugugacccuggacccauguagaugcuaaagcaaaaagaaggggaauggacggggugaucucuccaucccuacuugggaggccacacuagguugcugagaugcucaggagagaagaacaaacacugaaucaaugccucccauuuauccuugggggguggagggaggcugggauuccgaagcauaacucacauccagaaggcacaggaauaaaauccaagcaagaaccaagagcuucagcgggggccccuccuccccuacuccgaaggcuggcuaaagcuucgcuggcaucuuccccacugccccaucucagccuccugacuguuucucaccuagagaaccccagagaugaaaggcccuguggaucuuccucugguuugugguuucggauguuggcagucuugcuucuggcccaaacacuggagcaggaucacacggcccuagcaaaggccccacggaugcaugcaggccaggagcucaggaggccaagggcccgaaggacucugggggccacacacugggaccagaguggcacaguggccauggcgccaacaccuccaccacuucacaaccauugacaaucggaccccaagguuuagguauguguuuccagaguaauucaauacuuuccuucuguuuuucauggaaaaaagauaucuguccugccagaagcaggcuagaggaccaaugaucaggaagaugaccucaacuagguggccugcuacagccacaacucagauggaaauccagccuaguucccacagcagaucaaggcaaaccccucuuccaccaccaagcacacugaguuuccagcacugugucaccucagacugucuuucccagaggcccuggucggcaggccaagcuucuacaucauccuggagaucugucaaaauacauaauacagcaugcauggcagccggaaacaguccuaucuuugcaaaaccacagcugcaacuauucuaccaccauuuuacguaauauaauaaaaguuaagggauuugauuugcauucccccucauuuaugagcauuuaaccaaaaacacuuuuucugugacacuuuuguuaaaaaaagauaauuggguacugcugcaaauauuaaugcuuaacaacaaaauaguacuaaaaaaccaugacccaacugaagugauggagaacgaagucuuuuuccaggagaagccagcaaagccaucuggcacauugagcuuucauucugacaaauagcaacauacagaacagauaguaaaagcagaacaugcauccgaucuaaauuuagcacgucacuauucauuacugagagaacgagccucuugucaggagaaggcugaaguguuugacgucaaguuacuaaaaaagacggccauaaaccaaaauauuaagucuagcacaacaggaaugggaugcuuuuaaaauuaggacaugcuaaagaaaauacuaagagggcaaaaacgauguauaaauggcucuagggccucacggauucaccauuaccucugauggugucacgugauuuucaucuaccuccuucuucugugcccacauuuuaaaagaugugucuagaccagagaucucaacaggugggcucugguugaaauccauacgugguccuuacuuugguuacaaucccacaugaccuccuuguguugcugcauguagacagcaggcagagcuggauacaacucccugggcauggugacguuccacagagcagaaagggucugagagcaaacacacgccuucuggggccaugugagaauuccaccaugagagcaucugcaaguggucaggggagaaguuuuauccugcuucuggggugggcugggcggggagcaggugggccaguggggccacacucagugugugcgugggccguggacaccaugagcuguugucacagcacagugaccaugcuccagugauggccagcuccaguaccacaccaagucucuuaagcucuuccaaagugcuauaaaaaacucuuacccaaaaggaugccaaaaauacaggaauggugggaaccccacauaaggguaagugucuugagucugcuuagcacucaggaaacauuuguuaacaggaagcgugucacaauuucauucugguucuggaugcauuuggagaauguuaacucaucugucugagagggagaucacugcuaaacaggaucccagaguggcucugguuauuagacugagucaaaugaaaguguccucauucaaccauuuuugauauuuaaaaaguccauuucauccuuauacaccaaguucccacauccuucuguuuagagaaaaugauuuccaacacugaaaugagcaucuaugaaacguaaugaugguccauccagcggagaugcucccaggcaggcagggccugguacuugucugggugaaagagcguggauguccaacauggccaguuccaugguguccaacuggaaacaucaccaugacccaacccacugaaaacaucuuuggacccagcacccaacacuggaacuaucuuugccaaccccaggcccaaggugacuuugucucugccugagaaacccgggcagauucuagcacacaggucugagagugagagccagaaaaguaagcaacguuuguccugaaaggcugaacugaauaagguugcgaguggcgguccugaccucccucagguuuccaccaaagaacauuccaucagacuuccaguuccucauccuccucaaugcuaagagccuuaaguguucaaagaugacugaggggccccucucauacacaacucaacucgagcuucacgcucugcuauggccuuuggcccagcaaagcccugucagagcacucccaggaaaggguucugaauuucuacaucaaauucaagcuuaaaggguggggaggguccuggguaccagcccaauccaccuguucgauucacagauaaggcuuccgagugccagcagagaccacuugcucagucaccaagcugguaagcaauauuuggaggucuaggucugggucagcuaccucaguuuccccagcuagaucuacuuuauggagaaaaggaagggacacacagagauccuuuccugauccuacaacccacugugcugcuuagguucaggcagagauucagcuuggcccccucagguggucacccaugugugccccugggcuccaagucucuaacugccuccagcaacucaggaagccaggccugagggccuggucacaaacuuaaaccucucugggaaccaaagcuaguccccucaaggcucugcuaggagugugacaggugagagagacaggacacaauuggcuagcgguuucccuugcuuuugaaugauguuguuaccucacggggaaaacauuuuuuuuuaaaaagcaagauuaaaaucaauuccaucagagaaguugccacuuugagacuuuaagaaagauccagguuuugugaaaaauggcuaaagacaugccgaaaugaaacuuagaaucccaaaacccugcuacgggcacaggauugaacuccauccaucaaugagugugguagggauugaaugcucaucucagccugcacccacauucccaaucuacuccgccagaaaaaucaugguauguucaagacauccuagaggcugguaacacuaaaagccuaagcugacugaagaggugccaguauccacaagccgccuucuuccuaaagacauccaucuaucacuuaugacugacucggggugucaugagaugguuucucuaauucauuuuuauucuuuuuaauuaauacaucgagaaauccuaacacuauuuccauucugacuugaguuuccuuguagcauaauuuccguugacuuaucucuauagcagcagcagcagcaaaaaucacuuuacacugaacuauauugcuucagaguuaauuacauguauuuugcuuuugauaaaugaaaauacuagaugcaauuaauugaaagacaaucaauaugaucccacgauuagacaucccaaugaaacagccagaggcugcaggcaauccauacucaucaacuaauugaacacacauugcaaaggggauucuagaaaacugaacuuuuaccuggagauauuucacaauaacucaccaauauaaaucuguccacaaacucuauaguucacacgaugggcuguccgucuuuuuaagggaauacaccuucauugguucaaaaccauuuaaggugaugaaacccugaaagcaaaaugaauggagucagugaagaugaaguagagauuuuuuuuuuuuguuuacaucuaggcauccuuuaauugcauuuuuccaaugccuucgacucuaagcuaccagagguuauuaaaugguuucauuaaaaauacuauuugucuugcuuuagucacacaccagaucaaauuaaacaguagagcaccagaacaaaugaacccuuuccaucuauuuugacacaaagccaagugugcaaaagcagaaggugauauugugucaucaccgugaaaaugucauuuagcuuucucuacaucuccaaguagcaagcaaagggacaaaagaaucaauaccuucaagcaaaaaguauuaccaacuguuuugagaaauauggaauuauaaagugcaaaucaugagcccacgguuuauaagugcuauuagcauaaaugcugacaacuguuaaucuacuguaacucugauuaacgguugcaguuguccauuaauagaaggcauuuuaacuuacuacugaaauugauuacucaguuaagaauucaauccuaauguucaauaaaauugcacuuucuuggcaaaugcaauaugaaccgaggugaugcauuaaacagaacucccauuuauuuuacucuacauggaacagagaaggaauacauggugggacccacaucauccgaacuacuuccuaugcacacacagcugugagagaagagagcaaaguuccuccuucugcggcugauggggaaggcagacaaccugugcagcaggcauguccagguguccuuucuacggcuuuuccaggaagaaaagauggaauuuaacacuggaguugcuauguaacuggagagcccauguaugaagguagucuugcucgagccccacgagagagggaagaggcacacucuaaagacaugagcugcugcagccaggccugacauugccaaccccaccuuacaaccaaguuucaaaugguuaauauacaaaaaggcacgaaccacauucccagcugcauuugacuuuuuuuuuuuuuuuuuuuuugggagaaagagucucacucugucacccaggcuggagugcaauggcgcgaucucggcucacugcaagcuccgccuccugaguucaggcaauucuccugccucggccuccugaauagcugggacuacaggcgccugccaccacaccuggcuaauuuuuguauuuuuaguagagaugggguuucaccacguuggucaggcuggucuugaacuucugaccucaagugauccacuggccugggccucccaaagugcugggauuacaggcgugagccaccgcgcccagccaucauucuaccuuuuucguuuuuuuuuuuuuuuugagacguagucucacucugucacccaggcuggagugcaauggcgccgucucggcucacugcaaccuccgccucccagguccaagggauucuccugccccagccucccuaguagcugggauuacaggcgcaugccaccaugcccggauaauuuuuguauuuuuaguauagacgagguuucaccauguuggucaggcugguaucaaacuccugaccuucugaucugucugccuuggccucccaaagugcugggauacaggcaugagccaccaugcccagccaacauucugcuuuguaaaccauucaaaucuuaggaagcuguagauaccuaaaagaacuuccccucuuuuaauggggcuuuuaauuagcaauggggcuaaucuccuaggauccaaucccgugacaggcauuuuccugcaugauuauguagcaagucauaaagaagaacugcuacacucaugguuuccauucaaaagaaaaccaugcucccugcuguuuccacugaauucaaugaguccuccgacagccagcuccugcuccacaccuagaaccaagucacuggcaggaaggacucugaagaacuacucaggaaaagcauggacucuacagucaagguuaucauguacccaaggucaaguaguaauucacucccaacuguacaccacacuguaacccacaccucuuaaggaaguagaugggagacagacauuccagccucagaaguguuaggaagggagggacaagcauagcuuuucaguaaucccaagccuauagugacacaagcaucuaacagccaaggaacuauuuuuuugagguggcagagcuugccuggcaaacuccuauccacccuucaaaacccaucucacagguuaucuucuuuaacaucuucccuacucuagcuggcaggcuacuauauacccugcccaucuccaagucucuaaagguuaaaugccuuuuacuuaaucacauuuuauuuaucuuugaaacauaguagggaaucaaauauuuaauuaacugcaaaacagaauuuauacuccugauuaguguugcuugucuucguaugucacaggcuuucuccuuccauuuccaaugguuuacacagaauuuccaaaaauauaaagggauuguaucuauuuucaggaaguagucccuuuuggaaaggaaggagggauggaaaaggaacuggggaggugcaccuuagcaaugacuauaacauuacuuguuuuugaacaaugucugaagacaaacguagcaacauguuaacaucuaccuaaucuugaugguggguacagguucuaauuugagauauuucauaguaaaauuaaguaggaaauagacaagucugccuuguagaaggcuucacagaggaggugacauuucguggaauuucaagccgggcguucaagcaacugugcugccugucccagugaacggcgacagcuuauuuaguggaauaagaauguuaaaaggcuuggaagacugucagaauuuuaaagcaagugcucguuguuacuugaaggucaaaagaaguacuuuaaaaagacuggagcuacagaaaagcuaaagauucaaaaauacuuguuucagcagauacuugcugacagugcggcguggacuagugccccgaggauucaccaggggauauuuucuuggcaggauuucucuaagaacuuccaggaguauacaacgagacgcagaaaugacuuagcugauuaaaaucaccacuacuucugaaccagcaaccgcaggagcugaaguggccucagcguguaacugccggucagcaugcccacccccuccaaguucacguggcugcuucgggccagacagggguccuauuucuggccuguaccaucaaccugcgugaacuuauuaaacaucccgcggcaaaugugaucugccuacagcugaugacagggggguguguacucucacacaucccagaagagaaccgcagcacccagagauggauuugggggugggagucccaaccagacuguggucagcuaguuccugcaccuuccacauauaggaaacucacaacugaggcugcaguaccuagacaggacccccuaccccaccgccacugcuuggguguuuuguucuuauacuaagucaggcauacaaaaauuacguuuuaggucuguagugaauaaauccuuuucuuagaaacuaaaugagacuagaaccuuuagaagccuucaaugagcccuaaaaaggucuugaugggggcgucugagaaacucugguguggcuccuuccaggaggacugggccugccuucacuugaacucauagcguucuuucagaacagcuucuguacucugcauggcauggaaggggugcccacccacccacccaaaugcagagauaacagaggccaggcgagcagcucaaccuggccuggcccccccaugccgccugcugugagcagcauucaucuaaccaagugcccgcuuaccuacgcuuucucugcaggagggauuucuagugauauuucugccaucugaagcucacaugugccagcucucguuaggacuugaggcuuucugcuugaacucacauuuuggcugucuaggcuccuccuccuacuacugucccgccguggauggcgaaggauucaucaccccugcuucaagguggggcaccuccugcugccuccucuugaggcuggcccugcggcugggucacaccagccagagagcagaacuucagcucagcgugggcauauauuaggggagaagaaagacugauccuaaaggggcccuugcacccuggaaagccuuaucugaaacugacucaugguuuccacgggucuggcugaacggagcaccacugugcgcuguguuccucacacuccaggaagcaccguucacguuuacugcuaaaaagagaaaacuggaauguguccacaaaaccaucccuuaggcgaucaaaaguuucccacagguaauggacucugggaagggacaagggaaagaacaaggaguuagcaagaauuaaucccaaguuccgcaggccagcaucgguggcugagaaguaguauccugccugugauuuggagguaacagcaucuaccuucacagguggucaggcccuuugaaagagagaacccauggaagguucgucccaaggccugcauacagcaagcacucaauaacugugugucaucaucagacuccagacaugucuccaggcugaggccguuauccaccucuucuaagaaacucaucucugccuaacucaugagauaaacaguugacauucagcacaagaauccaauaguccuaaucaggucauugaugguuaaugguuaggcaucccaagcguuccccucccuugaaagguggccucacugccauccugugguauggcugugcucagaaaagagggauugcguaaagaaccauccagaauucugcacuucugccccaagcacagggcaugguagcaggucagaguagucuacagucuucgcccccuauacuccacaccccugcccaccacaaacauccaggcuuccucagagaccucucuggacuagaugcaacaucaacuaugaccucaaacuccuggauccuuucaacagggauuuccugagcaccuacucagugccaggacugugccaagccccagaggcacaggagcaaaacagaaaccuggucccugccccagggacucaggaggggccaccgacuccaggcccgaacccagcacucagcccccgccccacuguugcccaaaccaccgaaugacugugccacaaggucccaagcaaacucuggggccaaggccuguacccacgccucacguagagacggguagugugcaggucacagugccccacagcuggccugagguuucuggaagcauggugucuguuaggacgagugaacgcccucugccucacagacacucccucggcacccaugcugacggccuucucaaaaugggcccgucacauggguacccaggaaaugucccacccuucuccccacacucugccccuccucccaacacucuggcccccuucagaaggggugacuuaccaugggggugcuaaaagugggacccacagaagccgagcuguaucagaagccgagcuaaagccacagcccuggggaucacgcccaccccucggaggcauccagacacagcucagauaccccagggcaagcccccucuccuagccugacacucccuagagcaccacggcacugccucgggguaucagucaguaugugggaaggggaggacucucaaugguaggaccacaaggaagacauguagcuguuucccagucccugagcggauggcauggaaaguggugccaggggcuuuccccacacaucccauagcagauccucccaacgauuucaaguucaagggcagcggucaaggaaaagccucgggcaaaaucuugucaagaagccaaaugcucugccccaaaacugaccugccuacagcagcaugaggcaggaugguggcccuugacucgaggccaugagaagcagcccagaggacccauggguucccugaaggaccagggacaggcacucagcugcccgccuccuuuccugcguaccacaguggcuccugguucacacacccccagccacccucagugcagucucuggccaccugugugugaacacgggccacaccugugcucucccacaaggcgacaucccgcucccuggccuucccaacccuccucugccccgacucucuucaguugcagugaggacgcgcaguacaacgcauuguaacgggggcagugggggguggcacugggauggccgccagcuggcucugcaggaagaggucaugugcaguccugggggcugcuggggguaaagacaggcaucccugagcaaacggcagugggagaugccaccucuccucacuucucaacucugccaccgagcaccacacagugggguacacgugugacccaugcccucuaacaaggacuucaggcugcuaccaugacagcacagcucaacguugccugggacggcaccccccaagcccaccauauuaauuacgcgccuggccagccuuuaaggacaaacccacccugagaaaggccaagcucacugggcaugaagcaguguggaguccaaguuugguuggcacauggggaaaagaaauacaauaaaaugacaacgucuaccaaagggcugagugucagauacacacuggacaggaaugaacaggguguacccgagagguugucacuuuagcauugcuggauuauuccuucccgagauucaauuccaccaacuauugccuaguaauaaauaaaccauauuaauuagcuuggaaacaauuauccuuuauucagggaaggaaaaaacaacaaccccgaaagcuaauucuuuccaugucccuauacagccacguuggcacagaggcacuucaggugaaaucaacacuucauuaugacccccugaugcccaagagucucaacucugagaagaaaaaugcccucuaggcagaaacuuuacauacacagucuuugucagagaguguuuauggaaauuuuacaauauuaaauauauucagcugguuuuaagaauguaaaaaggcccaacagccaagauuuuagaacucgucuuccaauagaaggccaaccaguggaaaacuggaagggaagucuuggaauccugccacuuuuuaaagaaaaauaaaauaggauauguuuccaguguugucucagauguagucaauuaaugugaccauuccccugcucuuucagcuuucagcuuuucuagaugacagggccaacggacuugagacgagcugggugacaaggaggaacuugaagcccuugcggcauuagcuaggcuucuagaagugccccauccgaaguggcuccaggacggagaaauaaacaagggcgugagaugggagaaugccagaugggaguccuggcaacaacuggagaaaggaacaaggaacaaauugauaaacgggugcugcugaucggggcugccaugggccaaguuuugaaaggggggaagaaaaguggauccacgagcaagcagcccacacaacgacgucauuuugugaauucaagcugcauucccacacccaaagcugcccgugggccauggaagcagaggcagccggugugagcaacuggaccugaggcucauggggccuggcugcacccccacacaccuguaccugaguggggcacgacaguccuacuuacagacaagccaggaaaucaccugaacuugaaagagaccagugcaguggaggcgcuggggggugggagggggggauggggaacgcuuaaaaucagccuggcucagagggaagccuggcccugagguccccgcaaaggcgcgcagcuccgaaagacaaguagaaaacacaucccaacucagaagcacuugaagguauccgucucuagucuuccaugguuccacacuguaaguggacaaggcggcugcugguggaggugcacacaccccugugagauggucaggaaccugccagaaggagcggacauaggagauggcucacuccaacugguggccacuacuaaccagcuggggcauccuggugucaggcuccggucuugcuuucucccugauagggugaccaagagggguuuucugagcuccuuuccacaggguaucccaaggacaccugaucuaacaagggccagacuauauauuuacuauaggcccuacacagggccagaaggugagcagaggggucuucagacauucagagcacacacccauaccacagcgagagauggaaccucuaaagcuggcagguuuuaaugcaagauccccugaccaaaagcaggaugcuggcugcucugaggagucagcgagggugugacccccacucccacugcgguggaaggagugggcaucuuuucuguaaacuugagauuccaugccccacuccacucucccccuagggaauccuuagaaaaguggucaagauguaccagaccaugcuggaaaccagaguaggauaaauuuucuccugauagagcuguacagggauaugucagacacuauccaucucaacaauuauguauuuacuaaaaguauuucaaaauacuucaaagacauaggaaaaauacuuauaggucaaauggaaaauaaacuaugaaacauguauucaaaucucacauauuuuaaaacauucuucagugaaucucauuuuuaguauauacguauaugcauaagagacagaauagauccaaaguguuauucuccaugcuaagauuaaaaaggauuuuuacaauguguaacauaacuaucauuuacuuauuucuuauacuuuccuguauuuuucuauuuucugcaaagagcaugauuuccuauaauauggaaaaaugugagcugugagcuccugucaggagggcucugaagcuggggugcagaaagugagcugcugccugggcugcuuugccuugcagguuuucgggccacaccaacauuguaaaguggccccauuuaggauguaagucccugcguggcugcuguacuacaaagguggguuuugaaaaaagccaagugucccuccacccucaugcaaguucgauacagaaaaggauguucucuuggggauuucaaugcagaugucucaauuccaauagccaaucaaccugggagagaauuggugggcuggagagacacagcgagaaucccuugccccagcgaggaucuaggaccccgacugaugccgggaaagaggcacagccaaagccuugucagggcucagccaaaggagacuucccagugggcuccagccaaguccuugaccacagauuagacuccagcaggaugagcaggaagaugagcaggaaguggcauuuaaaaacaaaugaagugagaaccaaauggcucaaaguccacagucccugaaaaauuacuuacaagcgugaccagcuuuacauaucaacaccauuucuuuuuuucuuuuuugagacggagucucacccuguugcccagguuggagugcaguggugcaaucucggcuuacugcaacuugcaccucccagguucaagugauucucuugccucagccuccugaguagcugggauuauaggcaugcaccaccacgcccagcuaauuuuucuauuuucugcagagacaggguuucgccacguuggccaggcugcucucaaacuccugaacucaggugaucugcccgccuuggccucccaauguucugggauuacaguugugagccaccagccaacaacauuucuuuagagaaagggucucacucugucucucaggcuggagugcaguggcaugaucauaguucacuacagccucuaccucucgggcucaaguauucuucugggcucagccuccuguacaggcacgggcccccaagcccagcuaauugcccugcccaugucaacacuauugaucaauggacuacaugugcaauacugacugggaaagugaaguuaguaaaauuaagguggccagauaucgguuccuugacccugacucucucacauugccuuccccugacaaugaccucacccucaacccuuuaucuauugcaaaaggcauuacauaaaugggcugccuguucuguaacugguuuagaugggcagauccaugagagcagagacagaauccaaguuuuauccugcaaagcucagagaccaaccaaaugguaaggagcccuugggugaggcugugagucaccccaggagaguguucucucccucugcuuucucuucuucccccaggagcccagguguggucaccuguaccucccucauggggccacagcgggaagcacaggcaauaccaaugcacagcgcucagcguggcgccuggcacgccagaggcacccaaguguuagcuguaucauauaccaaaugcuuuacucacacggcuuggugaauucgagaauccacaguccuggaaagaaaagaggccugaaggaaaccggguucuauuuaauuuuaaacugaauuaugaacccaaaccucaagguugggggagauuucaauugaaaaugaagaguauccuugcuguggaauggagcagcagcuaaacccaccauguacaaacuacucacuuuucagacucuguacuuuaaaaaauccauuucaaggcuauguauaucacagaaaauagcauaugaagaaacucugcaaacacagccaugaaggaagcacccaaagacagaacugaauucccggguccaaaauauauucccucuagaagcaacucauucuauuuuuaagaauuaaucacagugccaaacgaauacaacaacaucuagaaauggggaaaaaggccugcgucccccagaccaucagcaacaaacuccuuuccaccuugcgccacaccacgcugucacccaggcucaagaaacacaucacggaggugaaaccucccaaacagcagccccuucacauucagccaaagugaguuccgaccacccaacucugaugguccucgaugcaggugacgcagccucuuaccaggggaaucugggaugggagagaaaagccaaacuccagaccaaccugcggcccacccuaacccaggccugugaaccaagagaccuuccaguccuggcuccccaaaaagcaaagggcacuugccuacaaucagcagcagggcuggcuuuagucuugauucaggaaaaaaaauaacugcagagccccuaaaggacauagaaauauuaucuauugauucaugcgcaucaagucacuaacacugggaauccugaacuaacuuacacacguauguaacugcucagccgcauuucugcaguuuggaaagaauggacaaccuuucagcauggauguucaugaggguagcaauucacaaaugcuguucucacaugaugaacauauaaauacacacaaguauguauguucaaaaugcagggcaagcgugcuuucugaaugaacaacucaacauuuucacugugagauuagauucuugggacuuguaauuuuacaguuuucacugaagcaugccaaagccacauaggugcaacaggccuuccuccuaaagaaaccaugccagcacagcccucacuugccuggugcaccgggccugcaccacacguauuauuauucugagagcaugagcgccaagaaagaaaaccgagacucaaaagcccaagggcuguuucuucauguuucagucaauguacacugugcaaacacaugcaacacagaugaacaaaacucacaaggugaaggggguucuuccacucuuuccaaaaucagccaagccaacugguacaaaagucacucccaauacgaccccauggacaucugcugagacgcgacgagguaagagggggcugucgacaugaccagcucuacuugucaccaagcaaggguccugucacucucggguuuccaugauggauuuccucuuccgcaguguucuggucuaaggcugggucaaaaaucuuccagucaauacacagaaaccaaccagccauacauacaacaacuugaaugaaucucaaagggaauuaagccaagugaaaaaucccaauccucaaaggcggcaaugcuguaagguuccauuuauauaacauucuuaaaugacacuggagagauggugaacggauuagugguugccaggcuuagagaccaggaaguagguaggacacgccaacuccagaacuuucuuugagcaaacugggucuuagaagcuggucagcugugucuacccaugugugucgaccaugugcuucagcuggggaccguccuggccaccucaaguggauaugacuauaaaagggcaacggggggauucuugggcugguacaaauagagaccuacccgugcuaaaauugcacagacuaaauacacagccaaaugagugcauguuacacuagggauuucugaauaguauccauggauucuauccacgucaauuucuccgcuguguugcuguuaccagaacucugcacaauguuacaacuggagggcaccagggaaaggguuuaagggaccuccuguauuaccuucuccuacccugugaauucauucuguaugugaaucugcaauuacuucaaaauaaguuuaauuuuuaaaauaacagauuugucauuuuuugguuuaugugguuuagcucaugcugggcacuaaguagggcaauuccuuucuuuaggggaucagcgcuuacaaggaggggccaugaggagcuggcccuguugacacugcuuacgcacucaacugggaucuguguccuccggcuccccaggggccccggggugcauccugucucucgagaagccagagcucacaauuccugaacccugaccuucucucacuggagcuggcagagaugcucgugcuacgucaauucuuuccugggagcgggcaugacugacucauuguucucucccaggugcugccagcugcccaggccucccagggccacacccaacagagggcacguucccugacagagcagcccuggaggacagaccagcagagaaaaccagcccccggggcagcucugugcugggcaagugccucucugguggguaacaacuucaggacucccugacccagucuggcuaaaucgaaacuacagagcaggcuggaacaggccaagacuguccccagcugacauacacaguuguacgcugggcuggccggcuuccaacacccagcuugcucaaagaaaguucuagagcuggagugugcuagcagauagccagggucaggggagacccagagcuacgccccugcuucucgagccuggggaccuugcuggugcccucaaaugccacaccagccuuuuguaucacccgaaaggucuuuguggcacucugugucuuuuccugggccuccccugcugccucccuuuuaggaagggcuggcauacucgacgcuagcacucccgguaacuccccgcugguucaaagaauccaaaagaaaacugcaggagcgucuuugcuguuuccgccuuuauuaucuucaagguuccacguuuuuucaguucauucgacaauuuacuaucugucagcaacaauaaaaguaccuccaucucccaaaaugugccacuagguacacguguauagauaaaaaauaagcagauuuuaauaauacuauuuuuugaaauucuauaaacccuuaaacagucauuuaccaaaaaagcugaaucacuuucaaaucaucaacauugcuuagcuuuaaagcugcuuaaaacacacacaaaccagugacucuuccacacaaacaaaaauuauauucuacauacauuaaauauauaauuugauuaaacauauuuaugucuuugugaugacauuuaaaauagaaguaaucauuuucuuuuuuaaaacaaaaacucuuucaauuauaauucaaagcugucaaaccaaucuucugcuacagaucuuuuaaaugucacauaccuucaaaaggggauggcaguuuccuuuuaaauaugcaauuccaaacagugccuucugaaucaagaauguauuaaaauacaccgcuggcauuuaucucgaugaaguaucgcccucugcccccucccuccugauagauauguacagacgcacggcacucagauguguuucuccccaguguaacuugggagcgguuggugccacugccacuggcuguagccacagggcucaacaccaagucacacuccuaacaccuuaaggggacagagguauccucucaugauucuuccaguuuucuucccagauggcuugcugaacucuguguaacccaauguuggcggagcaucaacagcccaaucguaagacagcguuaaucacaugcaaaaaaaccuccaaacucauucucauaagucaaugaccuacauauucaauugcuuauuugccauccgaguagcaaacaccaugcuauauuuaaacacagagcuuagauauaucuuucuucuaaaaugcucagagagacagauauaagccuuauauuucagcccucuucucaacuuuaggaaagcaaaccuugucaauauccgguguuugggaaucucugaagacaacagucuggucuauucugccauugucuuaguaaggagguacuaagcaucauuuucauaaaaagcaaacauccccgcuggaacuuaagucaauugaagcuugccuucuuagcaccugacaaauagugcucagauaauggcuccgagugaguuaagcaugggucauaugcaugucacauacucacugucccaaaaccagucaacagugauagagugaaugggacacucaguguccaaaaaccagucagcagagugaccagagugauggggacgcgaauguuuccuaacugcuguaccucgguagcagagacgacauccagcagagaugacagcaaaaacagcagaaagcucuugagaucugggcuaagaaagggagccauagcucaggggcugucccucugccagccucuugguauuucacucaaaucagaagaaguguaaacaagucgguccccggauccccaaccaacguuuguucaagggugaugcuaagaacaucggaagaagugucagggcugagcauucgagaaaccaaauagaugacaugccuaacccagucucaagccaaagccagugccguccaccuaagaagcaggaguggacugagguugcgggaaggcaaggaggagcccagggcucuggccuguaccacuagaccgcagugcagcgguggccugggagaggcccgcuggacacacuucgcaaugggccaguucagcugcuggugcuuuccugccuuguccaacuaugugaccucaggcaagucacuuagccucucagaagcucaccuggcagggucgagaggaaugcuaccuagcaagacgcugugauucucgguaacuuaaguucuaauuccacuuaaaaauaggcagucaugaaacuuaacgaccaaagccaaacucaaaagucacugggacuuaaaagacaucaagaguuaaggggcuucucucuuuggguucaggcuagaauucucuuccuugggugcugaacuccguuccuagcguauggauaggaagcaccagaaaaugccauccgcaaggccaggccccacaaacugacgugugguacagcugaggauggggauggcaaaggcagaaagccacagaugaaccgaaauacauggcagggccaggcccgucaaucaggacaagccacguacuuguuccuucccuguuagggcagaugugcucgcaccucccggccucggccccagagaagcuacuaucugcuccccuaggcgccaacauuccuuauuugauccuugccaucaagcuuuuauucugaucaccaccccccgcuauacagacacacauauacacaucuauagcuauuuccacauuuccacaccacauucacaucuuccacauacacacacauccaaaagagcugcgugcacuucugauggucaaagccuauagcccauucucagcugccaucugucuugccugcugcaccacacacgugcauacacacacacauucucucucucucucucucucucucuacucuacucuguccaucccaauacugcaucaacugugaacaagccagguacuauuaaguaaggaaggcuggaaauuaaaugagacauaacuuuguccucaaggaguucaaacaagaaacagccgaguguuacacgaaguaggcacggacgaaggagggauggcaacucugccucagccccaugcacaugcucucaaaucaaaggcacuccagaggcuccuuaccaccugccuucuagauacuucuguccaacugcauguuccaucaaccccuccaacucugcucacccgcaaccacugacaucacugccucaccccuugcagugcucaucaacaacccaaacaagcccaauccugcccugaucucaugucugugucacuggaaccaacaggccugccucaaccacuguccaccugcacaucugagaggcuggcaggucaccggggcuagccgugcacgucaguuccugggaagaaaguagaaugugaaucaucuucucucaaacgccuaucaaaagcccagcugagaucaauaauuuuuugggagaacagaccuguaccaauuggcucgguguuuggugagguauuguaaauuugauccuaaaucaaaggguaucccuagaaggacccacauggaauggccuccucuaaacaucccuccauguuguacuucugacucuuuccagcaaucucaagcacaagaagcaguugugggaacccaggccuggcaucuguuggcagcccaugguuggugguagagcacuuuacagccaucacuaugcccuauacgcaccucccuguggcaagcuguuucccugaaggacacacgucaucccucccuaaacucagagagagcugcccaacuuaaguuaucuguuacagcaacugucgugaaauuuuugguugcuguauuugcauuuuaaaaucaauuuuggcccucccccaaucucaaccccuauuacggcauccuauuuuuugaguccucaaagaacuuuccugaaagagguaggauauaaauacauaaaauggaauccacuuaagagaacauucuaguaacccuauaaaacaugcuucuaaaaguaaugaccccagagacuuggaagagcuggcugcagcuuccugaggcccaugaggcuagcacacccagaugccggguucugggguggcccagcucauggugaggcugcucugggagcagcugucuagaauaccuacuuagccaaguguccauccucacacggaagcaaacuaggacagcaugugcuaccaugugaccaucaguaggcuccaaaaguccacuucugucagucaugaaugcaaaacagugggcacagaugucagaaagaaccaggaacacaccagguaccaaaggccacgaccuucauucuugacuuacuagccuggagcuucaucagagagcaugguauuuuggggacaagaggaagcaggggaagggagagacauugggaggcggggggaaggaaugaaggaacaagaauuguucagaauagccaggaaaagcaagagaaacaggccccacccuaauauagaggacacagcuacaucuuccagagcaugugaacuccacagcccacgcccagcagagccaacggugcagaccccugcccccauccugcuaguagggaggugggggucaagggagaggagggggcccuacccacucacccucccaucccacuccaccacccaagcagaaagccaacguucuguagggugguuuaaaaaauagcugacuuccauacaugaucaguggaagcauaaaauguuauaaccacuuuguaagacuaaacauacaccuacuccaugacccagcaauuccauuucuaggaacuuacccaagagaaaugaaaucauauguccacaaaaagacaugcaugagaaugguucauagcuacuugcucagaauagcgaaaagcuggaaacagcccaaguguccauuaaugggugagcggguaaagaaacugcggucgagucauucaguggaauacuacucagaaguaaaaaggaacaagagaauaaucuggcccaaaaugucuuaaaaaucucaaauacaucauguguguggcaugaaaaaagcuucaugcaaaaagguacaugugucauaauauacauacauauuaaauuguauguauacauguauaugcuguguauaauguacauacauguauuauguaguauuacaugaaauucuagaacaggcaaaacuaccucuguugaaggaaaagaaaccaaaacagugguggccugagaugaucagggaggugaggguggggacagccuggcagggccccaaggggacuuuccggagugacuguagcucuugguagggcuuugggggguacgcagguaugugcguguguuagaacuaaccaaauggcacacuuaaggucaugcauuucauuugaccucaugccccuuccccaccaauccccacuucccucccaacacuuccucuaaguuuuaccucaaagaaaaaacagaaagaaccacaaacagguugaccuuaggucaugagacccgugcuccaggugaagaucugaaauucagccaagaaauguggucaaacagaagaugaccagggcugggggcacaguguguccugccgaacccggggguggugugcacauucauuguagaugaucagacccaccuguccgguuuuccuaacaagagacugaaaacaauaccaagacaaccuuccaaaggagacuccaaaaccucagcugggaacauuuuauucagagcgauucacaggaggccugucucuggaaggaggagcacagaaacaccugugaggaccaaggcccuggaggcacagggagaauaacuacuccaaguccaagucugcaaacagcacacgacagagcagcaaccucugcccgugagcucaaggagguccaggacacggucaggguuguuugugcuaacgcaggcugaugaaacagaggacccugcaccgaaaagggcccucugggaagaaaaccccaggacaaugacaugugcaacaugcuggcuguacagggcuuggaagcagggcaaagaacccccagguauagcccacaggauuucucucuuuuuuuuuuuuuuucuucuuuugagacagaguuucacucuuguugcccaggcuggaguguaauagcaugaucucggcucacugcaaccucugccucccagguucaagugauucuccugccucagucucccaaguaggugggauuacagacgcacaccaccaugcccagcuaauuuuuguauuuuuaguacagaugggguuucaucauauuggucaggcuggucucgaacuccugaccucaggugauccacgcaccucugccacccaaaaaugcagggauuacaggugugagccaccaugccuggccagcccacaggacuucuagccuucccuugcugagccucuuuggaggcagggcagcccuuggccacgguuccccaagagcaaagugauuaccacagguccacuuggaaacacgcugccaaaugccacacgacuuggacgcagcugcuguuaaaugcuguguccuauaaaagugggacuucucaaucugaaguugcguucccagcucaagucacacgugggcugcacuuacaagccucucaagaggcccaagaagcuuuuaaaguauuaaguauagaaaauacaugcaacuucccaguuaaaauauagugcguggacacuggaaaaggucaaugcagccuccacuccauuuucauuacugaugcuucacccagaugguggggaagguacaauaaaagcauauuuagagaccgacuguacugccagacaagacuagcggaacucuaacucccagguugccuugaucugaacagguucuagaaacugccaagcaucgcccccucauuuuagagggaggcacccugccacccagagagggcaaagggcucgcuguccaagcuggagaaaaucccuggguaucgccuccgacccacuguaucucaaauacgauguguguuggcucggcucuuccaaaaaccgaagccaagacacgaucagcucuggaagagacuucuuggggaggcagacaggcggggaggcagagggagacgcaagucugacagcagaugcagaugagauggcagggaaggcaggaggcuggggaggaggagucuucaccugcuguccccggcugggagcagcccgcagagugcaggcugucugggaacgccaugcuggauuuccacugcgggauucagaacguagcagcuggggccaccagucacucacauucccagaagcagaagaucaggagcgucuucauggcugccacaccaugccaggucauugcugcaauuuuacagcccgacuugcuucuaaacuucuccaacguuugaaaaucaggcuuuaagggcaccuagccgaacccaaaguguuuagguggaugccauuuggguaggugugaggcccccaaacaagggcagaagggaggggcagaaucuacaggacucagugaauaaaugagcaagaaugagugaagugaagccaugagguucauuuaggcuggugaaugggagacggcgcugcuuucuaucuaacccaagcaaguguaggacagggagggggcagcggcggguuggaacuacccaacucacuguacuacuuacguucacauugucugcuuuaacaaacaagccuaaaauuguguaucagcucaacacauuagaauuugauuucuaaaucacaagaacaucaggcucauguuccuaaugggcaacucugcuccacagagugauucaggcacucagaauccuccccuagcaccuaggcauucucugcuggauuuuccacauccagcugacagucaacaggagaaaaacugagcaaggcacacuuguuucuuaauuagugcugccgggaagcgacacacauugccacccacauuccaugugggaacuaucauggagccuccgacagauacuugaggugguggaagggaagcagggcccuuugguggacagcugguggucucugccauacucaccuucugucucagucuuaggucaggcuuauuucggaagcauuauagcacucugggucucugaacacaagaacccuggaugaucugaccacugaaucaaaucagaaaagagaggccaacaacucuagaaaugcaacuaguaaaucuucugguaacaaguggaauuucguugaccaauucaaaaguccagcaacugccuuuuuguuggaaaaugccaaacucuaaaacuuuugcaaaaacagguucauguucuucaagucuaagacaucaucaaaccuuagaccagcaucauuuuauaaaccacuaagggagaaaaaaaaaaaugccgucaauuaaacuauggcuugugaucaauuuuaugacacaacuugaguccagagauguuaaagugcugaaaaaccaauacagugucuucaaugaagucuuccaacagccuugucagaaacacaggaauggccauuucacagaugaaggccugggguucccacaguugggggacuuggcagcagucaaacagcuggcgaggggcggaguuggaggaggaggauuuccaaccagccucugacucagcaccugguagaguccuaaucccugcagcugucucccagcacacccccaaacucucaaagcccaagccaagcaccaguauucgcacauccguacagacugcaucaaauggcaaaucaagcaccuuggguauauaauacuuauaaacuuauuugaauaaaaaaaacuccacuaaaauauggguuuucaucugcacagcacuuuaccaacaaauuccacgacauucaagugagaacagaugauguacugaaauaucaacaacaagaauccgauuugguaaacagcagagugcuauuuucacaucauccuaaugaauuuaguuucaauaaacacaaaucaagcaaacacucagaaaauuuuaacaguauggcaaaaugacgcuuagaaugacagccccagaagaugaagucuuuuuugacaagugacagauaccacaaggagagaagaaucaaaauggaugacuggauuuaaagggccugccuguggcccacaucccugaacuuggcccugcaccugcuugcuaaaucuccuugauugugggggaagcagccagaagaaagcucuagaucccucaauccugcucaagcugccaggcacauucuaagagcaugugucuggugcauggaaauccacauacagcaggucagugagcacccacagaagaccacacagauucaaacucuugcccauagccuccaucucaguaugaccuucagcaucaagcacugauuacugguaaguauguagagaugggagaggacaggucaaggcagacccagccuccuccucagaccugcucaccugccuacccaucccccaagaugugucucaaucccaucgugcccugaaaguagagcccagguuaaaaucucagcaaagaguuucacaaaguagcagugaagccaagcaugcaacgaucaggccagaaacucaaaaccaggggauagggaaacaggcucacgcgcuggugggguacucugcagccaggaggagcgcaggcagggccaccucuucggagggugucugagcaguccuucaaucugaauccuuuguuuucuccaucugaaaacagaggcuuguuguuuggaggguguaauuagaacgcauuugaacacaacuauaaacucuaaaucacuuuaaagaggcuagucuagucuuuugaaaugacuguuuuugccuuggaaauaauaagccaccaugaacaaauuuaaucaaaguuguauuuacaaagagucucaaagccuaaagcagaaguauaccaucucuccuccacacugugagcucuuuagggacagggaagugccucauuccuauucagccgaccauguggaaaacuacaacugacuucugaauggcaggcacuuccuaaccacggcuggaagacuggagcagcuucuuucugcaugggugauaaaauguguccaaaaagaaacgcacauaaaggcauguaaaacuuagcagguaggauaucaggcaagaaacaaacuacagaucagauuugaaaaggacacgaucagaaggaacaaauggaaacauuccgaaguccuguccuggagcgcuaguuacucgcugcaugcuguucugaaaaugcaaauauugagcagccccaacgaccagauuuaacaagcccaucaccaacagccaacaugaccaacaucaaguaauucuguuaucauucccaacucagagguggagagacugaggcuuagagucucaugccagaguccacggcaguaagagcagauucaaaucuaggccaacucaaguccacccagcggaagcccccccgccccgugccuugcucagcagagacaacagggcaggaggaagcggggagaaaggaagguccaugacucuguagggaccgccugguggggaauucaggucccucugcuuccuggcccucugcuucaaccaggggaguucacagcaaaguucuuguucugaaccccagguagggaccauaauccuaccgcucccagcaacugcuggugacuccucugagcaaagagcacucugccaggcaggaccaaucgaagcccacaaaggcuggagaaccaggcuggcaggccccuccuuuucugcccccgcaccacagcagccccagacacgcggcgcgggaggacgaagagaaccugaccaaugagggagggugaagcgcccagcacccugggccaccucugcggguccuuggggaaaggagccaacaguacagaugcguguggccaggccuccucccaucuucccccagccuuucccucccagccuggagagggagucaggcauagcccuccccacuccaccuacccugcugcuuagcuccuccugccuccugcccccugcccccugcccccgguauacucaacccucaauaauacuaaaacccacguuaauacuagaacccacguucaucccaacagccaacccccggggaccuuagccgacguucacaaccucaaaccuucccgucauaggcagcggcaaggcuacauugugcauggaugccuuggugcgcccccacucgcugcgcugggcuagaggggagccccuucuugauccagguaucacuguuagguuuacuuccuccugcacccugggaggaaaccaaguccccagucucucccugacucugccuucuacaaaagcccaaccaccaggaaggaagccaaugcccaggaaugccuccagguguccuuuguucccugcagcacccgcuccaccacccucucucccuacuguccacaagacagccucccaccuuuguaggccaaggauucccaucugagggcuccgaaaaaaauguaaggucccggaaucccuugagacacuggaaagccagauucuuuuucuauagaaaugcauauaugaccguccccaucccaucccccaucgccucgugggguuccugggcugaucccccacccaggcaggaagccucaagagguccauagucugagucaagcccuccagcuuugucuccuaggcaacggcugcuuucuccuuccagcuacacauggaccaaggcaggaagaucccagccucccuucauuucuggcaucccagcagcuagcccuccucuccauccccacgcacacaggcaccucacccuauggagcucauuccacugcauucuuuugaggaagugaaacagcccugaaagaugacccucaccugccgaugggaagccaggccacacugggcucaccacucgggacacuucucgguguguggcccugggugccccugugcugcucuccugccuggccccacagcaggagcguaccugucagucaggugugcauuuaagaagucggccucccagggcagccuucugcccucugacccugcucccagucuguggggcagcgaaguuaggacuuaccugauucuccagcccaucccuuccggcccacgagcagaacaggacaaguggccucagcugaggagugcuggcugggcagugguucccuaccugguuguucauuagagucaccugggaacuuuuuauuaccaaggcagaugccacuguggaccacacacucagaaccuggggguaggauuaagcugggaucuuuuuucaaagcucuccaggugauucucagauccagauaaggaugagaacgaaggggcuggagggacccaggcagggggcggccuccuaggggagggugagcugggagggaggcccaggcuggccccucacccucacagcucacagccuaccuccugugaaaggccagcccugaccucagggugcauggguggggcuccccaggccccagacacaucccccugucuggcucacccagcuugaucgccugcccaguguucucugguuggguggucagcuccuugcaggcaggagcaggucaggcuuguucaggccaccacuccagaaaagcaucggccacacuguucccccacccuaaccccuggugcccagcucauuagccuugaguugaagaaaggcccuccucuuuugugugccuauaggagugggacaagguacuguggaggaugugggaaagaaagaaaaugaaccccauggagcccauucuugcaggaauuaugcccucagcaccuuccaagccucccuacuuaggccucuuuugcuccuaaaacaaacccuugcagagaaugugacucacucuaucuucaacaugcaccuacuacacagcaggggccaacgaacuugaagucaucaguugacaguuacaagacaccguccaaacgcugccuauuaguccccccaaaacagcuucacuagcacagggacaucuaggggcagagacguaaaacauucucccaaaaugguaacaggauguuucccugauggcguugcccagggccuugaaagagccgggagcgauuucaaaugggcuccgggcucgugucaggagcaggagcugccuuuggugggacacaggucaccaaaccugacccacccaaaucuucagcacugacaucaccgccgaaaacgagaaguuuguuuacgacaaggucucauauuccugcuuguucuuuaccuaaaaaucuaaauuucccauguggguccuuacacaucuguaucaacaaaaucacaauucgccaagauacugaaagcaccaacaauuucugaguuuaaggagaagagacaaagaaaucaagacaacaggaagaaggaugcaggaagaugucaccaguuugcuaggacgugggccucaggagucaagagucccuucugggggcagcggcuguggccaaacccagagcagagucucgggaaccccucagccuuauuucccaaggggccugggagucccuggugacucuggugggcugguccugaauaucccagcuccucuguccucaccaucuugucaaccccaccaaggcugcaaccaguucccuccaaggauggugaccugcacauacaacaucaaggcaccgacuuuaucuuuuaaaugcacaaugugcuggagccaaaaacaaaacaaaaagccucuccaagaugcuuuccugaaacacacuaggcugaaaaaauggagccccauuuccucuuauuuuuaauuuuacauuggcuguguuuauaauaaaauagaauaacuuauuuauuugcuuaccuuacuuggaaagacaauaaauuggaaaggcuucauaaaucucacagggaauuccuuucaacaaggacugucagcaaaaauccguaaauaaccuucugccagccucuagcaaucaccuccaccacguucuuuuuccuuccugcuuuuguacuaaucuucuagcaaacaaaucaaaucacacaccaaaacguuuuuauucuuaucgagguaaggcucacaaaacauccggaguccacuggggcuacucacucacguggccucugagaagacucagaugcagagaagaccccaggggaccgcgggaggggcaccucugcacccucauagccagccacgcuccucucacuaacuuacaaaaacagagguggugauuagcuucagaagcggagccagagaugcucuucuaacaacugcagcauuaauuccaucuggagcaaaucauccgcaaagcccuagacacacacaugaggaaacaaaguccagggcagguugcugauaggucccggugccuccucccacccagacuuggcugguguccacaacgcagccuccgcucaccuggcucccuuauaaucucagugucgccggagcuucuggucaagugcacucauccuggagccgacugaaccaagggagccaacggagucacgcugggugauucgagacuaucccaagcaacacggaccucaugcggcagguccuguccccaccacgcugacacuugaaaggcaacuguuugaaacugguucaaauggcuguguuugacuugaaacacauccgcguuugguggggcuggugaaaaugaccuucggcaguucagaaacagcggaagauggacagucucacgcugagguuucaaggacugugcuaaaaauaagauuaacuaagaggcagagaaggaggcucguggauaaucaaauguguaagauuggaaagagccgcuguaaucaauuuacauaucaggaaaggguaauuaccauaaccaaagggaaaauuucuccaagccaaaugguuaaaaaaaaaaaaaaaaacagaccagcaaaccacuacccgaauaaauguaaaacaaaaauguauguuuccagccaggaugucaaaugccuuucaggcuccagaacuacagaguuucacccugcgaccuugauucuugggugcaagaugacgaacuuaagaacuccaaacauaccugugcccguccgucucuucacucggcuaacugugcaaaggaaccggcuucugaugagucccacugugguuuccauacagcagcugccaaagagcuguguguuccugggaaagucacugagcuucucugagucuacuuugucucuagccugugaguggugcauuagccauuacuauuaugcaucuaccaaauacaucuccaucuucccugcuuggcacauuccuggcacucaacagacaguagauacuauuagccaggcgagguggcucacgccuguaaucccagcacuuugggaagcugagguggggagauuacuugaggccaggaguucgagagcagccuggccaacauggugaagcccugucucuacuaaaauacaaaauuuagccgggugugguggcgcacacccguaaucccagcuacaugggagguugaggcaugaauugcuucaaaccaggaggcagagguuccagugagccgagauugcaccacuguacaaucacuguacagccugggugacagagcuagacugucucaaaaaaaaaaaaaaaaaaaaaagaugguagcuacuauuauaauuauuccaccaaauuaauguauuucuaauauucuugaaugagggcagaggauuuucuuaagugguccccuuucaaagugauuuaauacugcacaccccuaaaagacugucugccuuguuuuuuucucgacuguucauuagccccuguuuuuuggacucugggagcuuccagucuaggccagcugggccugggcauguaauagcaaaagcuacucaccugagcaagcaccgcuggaggggcucucaacucacuucccuccaagucagcuggaauuuuuggauccacccaagggaagcaacuuccccacccaaaguguggagauagauguggagccccagaaggguucugggaaagcauccuguauccaggacaccaugaggccuuguggcugccuagaacugcgacccuacugugcucacagcugcacaucacagagcacagguggcuggugaccugugaaaagguccccagaucaccuuuccagacaguaaagaacuuugcucucaccauccgaaagcagaccgguggccacacacauucgcaacuuccacucagcgucuagcacaccccuuccccaacccuugcugaacugucccugaacccuuaauaaagacacgaugggguguccacccaccuuucagcuacuaaccccauguacccaaguguccucacacuacacugggaagccccgcugaaaucugcuaagcuauguaugucuuuggaggguauguuuccaucacacucgcugcauggcaguuuguucacagacgaccacccagaagaagccaagaaugcuuagacauuaauuucaggccaggaaucaaggucacauuuagucugagcucaaaggcaucaaaggguuuucucauacugcaaaugcacgcauacaagaugcaccgagaucacgggaaugccagucagggcuggccaaucacgaugacugccgcuuaaaccugcccucagccugacugaugugaugagggaaggggacaaagaaugagcuccgaaaggacauuucgggcaacgaccagaaaauuagcaaaugcagugauccccacuuaacaauuuuauaaauuccaagacucauuucaaguuucucccaacugaaagaaaauaauaucaagggccgggugcaguggcucacgccuguaaucucagcacuuugggaggccaagguggguggaucaccugaggucaggaguucgagaccagccuggcuaacauggcaaaagcccauuucuacaaaaaauauaaaaauuagcuggacaugguggugggugccuaucaucucagcuacucaggaggcugaggcaggaaaaucacuugaacccagaagguggagguugcagugagccaagaucacaccacugcacugcagcaugggugacagugugacccugugucaaaaaaacaauaaaaagaauauuaaaaaccaugacguggcugggcaugguggcucacaccugcauacccagcacuuugggaggccgagacaggcagaucacuugaggucaggaguuugagaccagccuggccaacauggugaaaccccaucucuacuaaaaauacaaaaauuagccaggccugacagacuggcuguaaucccggcuacucgggaggcugagacaggagaaucgcuugaaccugggaggcagaggagaggcugcagugagcugagaucacaccacugcacuccagccuggguaacagagugagacucugucaaaaaaaaaaaaagaauaaauaaaaauaaaaacaaaaaccaugaggcaaugagucaguugcagcuuauaucccagagugcaauagggacuuccugccaagcaucuccucugcugggcaccugggcacaagucuccagcgccuucucauuaccuccuccugugagaggaacuagugacuagcguccuauuugacgcauaaggagcuggcaggguugaaaguggagcccaggacugcaagcauggccaucuacccucggggccggcaccagccucggggcagcugaccuuccccaccucagaagcucucauuccucugggcuuuccacaaaccacccuucuugaccacaaaaagguggccauccugacuggucucuaccuucaggaaaacaaauggggaccugagggcgcucaaccaccccagaccacccagaagucacaggagcacggaacaggaagcagggagacagcacacaguaagcacauggcaagcacacaguaaacacacggcaaguacauggcaaauacacagcagguacacagcgagcacacaguaagcacacgguaaacacucagcaaguacauggcaaaugcacagcagguacacagcgagcacacaguaagcacauggcaagcacacaguaaauacacagcaagcacacagcaaguacacagugagcacgcggcaaacacacgacaugcacacgguuagcacacugcccggcucccuccaaagccacuucccccacagagaaaggagaaagcggcccuggccuggcagucacucacagucccucuggaccuggagccagcggcuauggcggacgaagaggcaccuguucccaggcacuuuccaagaggggcuggugggacacaguguggagaggcagcuguugugagugucccuggggagcccagggagcauggccuuagaugcaccagggccugcagguguggcccagaacugcccacucuuggguuugcaggggacgggggcgguuugccuacuuugcggaggaggugguuaucugcugguuucagacacgacucaagacugcagugacuggcuuuugguccgaccuguccagacgagccaagcuccuggagucucaggcaucccuaggauggcacuggggagaggaggggugucauccaagccaaguccaucugcugugaccagagcaccccuggggcucaugcauaauccuuggauauuacaaauguccuggaaauuacuggccucucacaccagcaucuaccaaacuccucgcacuuccuaggcuggcccuucuacuaucaaaaaggagugauuuccuuagugguggcuggaggcugggagucagggcggggaggcaggaacuccauaggagcacagagaacuuuccucggugaugggaugguuccgcaaccacccgguggcgacgccuagaucgucaagacuugcagaacugcaugcuaaaggguguuuuacuguauauaaguuauuucuacauaggauuuugaaaacuugauccuucucaaaaagcaaaugauaaaauuaaaugacuugcuuuaugcagugaacugugaaauccucugcggcccccaagagcuuugcaacugagggguggcugagccagcacacaccccaccaggcuuccuugaaaucagcaacacccagaagacaccaggaggaaggauucugugaagcacaugcucgcagaggcugccugagaugcagcuccgcuucagaugguuuacucagggaaaaucauuucguuaccucccgugguuuaguggccaggacaugggagcugaaaggacacgcgagcuugaaaggcuccuaccuuggguucccucucccacauuuacccucagcacacccccuucagccuaacuccaaaccuaauguggccaccucugcccaccccagcucgcggaaauccaccacuguuuugcugaacuccagauaaacccuccuugcucuucuucccuguagcccggcagcccccccacgacaucccgcacacaguaggggugcaccuucauuccacaggcaauguucagaagaagcaaauucgccucagccggccggguguguuggcucacaccuguaaucccagcacuuugggaggcugaggcaggccgaccaccugaggucaggaguucaagaccagccugaccaacauggugaaaaccugucucuacuaaaaaauacaaaaauuagcugggagugcuguaaucccaccuacucaggaggcugagaaaggagaacugcuugaacccgggaggcagagguugcagugagcggagaacucgccacugcacuccagccugggcuacagagugagccuccauuucaaaaaaagaaaaaauucaccucaauggcacugcauuaucacaccauguaacauguugaaacccuaugucuaaaauauuguauaccuauuuuuauuugauuuacuaaauucuaaagcuuuucuaaaucucuaaaagguaguuuccccaguaaugcauaacugcuuaaucgggaaguguacaaaacauaauuacacugccuaaaacuacaauauugcuuaugggaauaucuccguucaugcauuccacuuuauuuuguauuuaaucucuauuaagaugucuaugugaaaacagauagguauucuucauaaacaccauaaaucauaaagucauuucuuugcuaacucaaguccaaaagcggccccaaaagaaacugccagggccccaaagacuaucacuuuccauauucaagcagacaagcuccuugcacagaggccucagugcagagccccaaaacaccuagcccugggccaauuagucaggucauaauuucucucaccauaaauggcucugcaugcaacucaaaaagcacccagacgcuccccagaaagcagucacucaaaccaagaagagcaauuccuuucugcucaagaccccaguuacaaaccucauaucaaggggcaaacagagucccuuaaauccuucuucaucuaaggacacccguggaugcucuuucaaguucaccuuucaacccgggggacucccaccaaaggcuccagacucuugaaacuggauucuccugcuucccuucuggccuucgaauuugcacccacccgcucaucccuagaauggggucaugugaauacacaaccauucucuggacggccugguauugguggaggagaaccaguucggaucucgcucgaucauuaauuaacugugagcccagccuaugcggcuugccaauuccucaagugggaaauaaucgcacugccucacaacaggguuguuacuaaaaauaaaauaagccaauguauaacaaaguacuucugcaaacagaaacaagcuagguuaccagccucgcugaagccuacuaauuaauaaauuccccgaucaagauaaaaaggauuugccacaaaacgaguucacucucaguucuaaaacagcagguaucacucccaaauccgcuugcaucaugaugaaacaggcuagaggcacaagugagggccucgggggcgcuccugaagguuaagcauauuugccugcagugggaaguaaaugcaccuuuugcugauccauguucuugcucacacgggccaauguuaaaaacaucgacucuguggcauccaucuuugacuuguguacauagauaguaauagugugcuucacugagcaguucagauuuuacuaaaauauaaucugcaaaaccaauuucuuuucuagcagguaugcucugacacugcccagccucaucucaauacacacugcugcccggucaagagugaaaugucaagugcaucugaauacggaacuagcuccaauuuuaucagacacccaggaaauuuccucugccuuccuagaaaugccugguaauguuggaggguggagaaucccucuucaaagaaugaggaugaguacagcagaaauccauauuccaaguuucaaauaauuuaguggguuauuugaguuauauaaaaucuucuuucaaccauuuuucaugccaaauguucaauaacuagacucgaguguguggguguguguugggggagugguuuguuuuugaagaaagccagucugugugcugcuguuggcaguuucgggcuggcugcaucaggcacccccuggaggagguggcuaaaaauacagauguuagggcuucuccaucgggacgaaggguggggcccucaggagacuccuggccaggggugccuuggggacgccccugcuccagaagccaaccuuuugagcacccccaaccccagguaccagggccucucuggggacugacugagucacucgugaaaaccaccaagcccacccaagcuucguaguauuaaagguaucugcugucccuuggggcaggguagggcagggcacggcagggggccagagaagguugcuagcacuuaucugcucccuccugauaaaacagggcacaaacagccacucccugcuaggaagaagaaggcacaguugacgggaggauuugucuuucucaaugacauucacgccaccauaacuacugggauugccaugaauccuacuacuaucaccaccaccaccaccagcaccaccgucccuaauaauaauaaugguaacaaacagcuagcgugggagcacuucccacaucuuauucauugugcacacucuccaggauuugcaauugaagaauaugacauucuggccccagaccccuggucccuggccagcugagaugcccuugcauuccagcaugggugguuucccaagggcauuuucaaggaccauuuugcuuuuccaagugagauuuuuuuuuuuuuuuaauuugagacagaguuuugcuuuuguugcccacgcuggagugcaaugggaugaucucgacucacugcaaccucugccucccagguucaagugauucuccugccucagccucccgauuagcuggaauuacaggugccaaccaccauaccuggcuaauuuuuguauuucuagaagagacuaaaauauaaucuacaaaaucaauuucuccaaaacuaauuagaagagacaggguuuugccauguuggccaggcuggucuugaacuccugaccucaggugacuggccugccucggccucucaaagugcuaggauuauaggugugagccaccaugcccggcccuaagugagauuuuuuuuuuuuuuuggagacagcgucuugcucuguugcccaggcuggagugcaauggcacgaucuuggcuuacugcaaccucugucuccagaguucaagcaauucuccugccucagacucccaaauagcuaggauuacaggugcgcgccaccacgcauggcuaauuuuuuguauuuuuaguagagacaggguuuuugccauguuggccaggcuggucucaaacuccugaucuuaggugauccaccugccucagccucccaaagugcugggguuauaggcaugagccaccccaccuggccuccaagugagauuuuuuaauagcaugaguugaauccaaagaaacugcugguccaugaaaugaccagcccacucugaaggugacaaacuaacugccggacaggcaccuuccuuaccccaccuugccauuucacgcacaugaccuacuauucacaccuggagccccacaggaagcacagagcaguuaacacuggcuggguggagaaaagauauuugaacauuucaaucagaagacauuuggugaugcuguacgcacaugcguacugugccuggccccuagugggugcucagucaguaucugugaaugaauauccuaggaggacaugauuaauuaccaccccauugccagggccuggggucaggaacaugcucaaacaucacagcagaucugccacccagcugcaccugguccaguuaccacagcugcugcugacugagcacccacaagaaaccaaacaggaugccaccaagcaagucgacagcccuggucacugaccggcaaacgcacccauuccucagggaccugggagggugaagggagcuaugaugaugacgugugcacagagggaagggcagacacaguuccuuuuccucaacaaauaugcuccucggaauguggccugucaugcccacguucacugugguuuauguacugaggccucaguagaggagaauucaaaccugagcgacccuucucaacaggcuucaccugggcaggguggcuggggcagcacugggcccccacccuggcugcccaucaggcaaggcaguuuuuuucuuccuucuccaggaagagaaaguaggucuuaaauagaaaguaaauauuuuacugagcguuucuuggagugaccuaauacguaguaacaucccacagacuaaaauuaaccucgugaacaguuuucaguucauugcuuugggccccaggaaucaaugagaaagaagacggcugcucccaaacuaagccagccccaccagccacuccccuucccuaccacagggcacgacaucuuccagguauuuuuaacauagcaccaugacaggcuuggcagcucacaccuguaauccuaacacuuuugggaggccaaggagggaggauuacuugagcucaggaguucaugagcaguccgggcaacauggcaaaccccaucucuacaaaaaauacagaaacuagccagguguggugcccuguaccuguagucccaccuacuugggaggcugagaugggaaaauugcuugaacccgggaggucgaggccgcagucagccgugauugcgccacugcacuccaagccucggcgacacggugaaacccccaucucgggaaaaaaaaaaauucuaacaaacacauacgguacgucaggccaguucuaaaggcuuuagaaacacuacuucauugaauccuuacaacacacccucuccuuacccucauuuuacagauucagaaaccgaagcccuuugcaaaggccucccagugugggagagaaguccagcauuucuuuccaucccuucuuugccacacuuccuuguuuugccucuacuaagcucuaggagggcaggaccaucucuccuugggccgagccucaguguuugaaaggaagaaagacauucacgaccuuccagugggaccucucuggucaccagccaccaaagugagcacagcaguuagcucagugcuuucaaagugcgcugccggggccccuagagcaaaacuuuggaucugagccaggacccugacaugccaaguaaccaccagguugcaaaacucccagcuacaggcgugaccaaaaaggugguccaugugcugcugcagcccccuucccacuaaccacagcgaacccaggcucucccucccaccuugcccgcugcucuagaaaacaaaagagaauuaggaaaguaaacuccuuuuuaagcuuccuugcugagaaauauuuuaaaagacugcucugaggggccaaguaacauacgggauuugcuucuaagcucucgggccugacugggacacaaccagggacccaaaagcacaacuggguugagucauaaccccccucccuucauccucuacggacaugagagccucaacuaagacauucucgaauuuaccacaggagugucuuccuuugcccacuauuuggagccauguggccaauuuaggauagaaaaauauuacccacuauucaaggccuuccuuaaaugcugaggaagacaucacugcagacacaauuccaacuuuaauugugaaaucuccuggcuuuugucacuugaagccucauucuuaaucccaggcuuagcugagaaaugagaaggaugugugcaaguggaggaaaaagaauccucaacccugagugaaaagcaugcgccguggaggagcgaggagaauggacacucugaagaugcuagggcugggaaacagggugcuggggaaaacuggcucgcuggccucagagcugcggcagguccaccacugcgccguguucugcuggaggaaccuggaugccagcucaguggaucuucugcccagcgcaaaggaucccugaaaccuggaacaggacaggggacacaccauagacacgacaugggcucuggaagaccacucacaaggcccggcucacaggaaaugaccauucaugggaaccugcacgccgcagucauucucaugcuuagaugccacuuuccaagcaacagccucugagaaagcagcuucccccuucucagugucccagugaggcaccacagaaaggagagggcuggcccagggaugauccuggccccaccacccucuuccagguggagugaaguggaaggagaccuguuuaaaaacugcagggggcacuuaaaaugggcugacucuauucauacccaagcuggaggugagccaggacaccgggacucacaugacugauuugucaagagacuccucccagcacuuccuugagucauccacaagacagagcagaauccaaaggccaagauggaggcggggggcacccaacauccacaccacccccggccccaccagagccccagcggaaaccaaggauuuccagaauacacaugugcucacaaguguacacacguguucacaaaaagaagagaaggguuguagaauaggaagguaaucuuauaaagaaaagccuguuuuucaggaaaaccuucaccuuguggggaccuuacccucuauggaaagccaaggucaaccugggagcucccgcaucaccugcuccggguacucuuccgguggagcggggcuggucucuggauuugaagacacacccaacucugugccauucccugucaguucucugauagccucuuugaaaagaaggcuguucccuuuguucaggaguauuaauucaaauuccuuucuaaggcccacaccacacggaugcaggggagcgacccaaaggaaguucacccggcaaaaccuaguuucucccugguuuucacaggaguggugcaaacagacuaucacaguuaggagaaauccuaagcaucuucccugucucuugacccccaacuccccaacguggaacccacaaaccagauccuauuucaggugugcacauggcuccaguugaaugccagaggcaaccagaguuggggaggggugcaucccauggacccaagcccucccucgagggagaugggggguggagggcaacugagaucacacuaucccagaccacaaacauggucuuaccuauugaugaaaugauaccuggccacuaaauccaauuuuaccacaugaaacccuaagcacugugaaagcuacacacauaaccccaggagagugugcccaugcauucuuggagugugggguggugcugcaucagagacacacagaugagggcaagggagaaacagcuugggaggaaagaaggagucuagucuugguuaguguggcaaagccauccccagacauucccgugucccagucaaaggccacaagaagccucggucagccacagagaagccagagccaggcgaaguugguaguaacuagccagacuuaauuaccuaagcucccuggcccugacucuucauugguaaaacagugacuaacuaucaccugugccucugcgaggacagcgcugugcuuggccagggcuggagagccgaucucaaggcaggugucuggccuuuucccggacauagugagucugugauccagagucugacccacguauucaacggggccugccucacuuccugcucuaggauguuuuacauucacugcacuuuuggagugaauauucacaacagccuggcuccuguuuggaagccugaggcaggccccguugaauacgugggucagacucuggaucacagacucacuauguccaggaaaaggccagacaccugccuugagaucggcucuccagcccuggccaagcacagcgcuguccucgcagaggcacaggugauaguuagucacuguuuuaccaaugaagagucagggcaacgcaacaacacacaauggcccagcgagcuagugccagacacuaaguaagugcucaagaaaugguugcucucuaguuacuugaauaacagguagagcgcacuugaauggcugcauaaguuucuggagcaccaaauuaagucugcaaaacauagaggcgaacacagaaauuccuccauggagaagacgagggcaagacgaaacgggccagaucgcaccguccuaccacucugcgcucggacaaccucuagucacaugccucgccaggcuucagguguugggagccgccggggugaacagcagagaacgcagcagaggcgcgcaaaugucacucguccucgacguggaguucugcugaaggucucaguggcccucgcuguuucccacagcaacugccacugcgcuauuuguacuacaaggaaaacacccagauucgaagguuauccaagaaccguggucacccccaaacacugcccaggagacgagaucccaagccggucaaguggaaaugaugccgcuguuuaccguuugcuugcaacucagccaccaucgcgcagucaaucaacgaaccucaccacucaccacgaccccaggaguccccaugagugcccggaguccgcgaccgcugcgggguggaggcggcucuggccuggugcaaccagguccccgccccugcucugagccucgagugcgggcugggggccaaccuggugucccgcguggucucgaggcuccuaccuugccggggccucgcggaccggagaggggccggcgacccugcuggcuugaggcggcgucuagcuggacccccgccgccccggguccgagcggccccgcccagcacaaaggccagcgggaggaaggaggaagugggcacggagcggggggagggggcagggcccauucucacaccucucaacgacuuccccgcggcgggaagcggcuccauuuacaaguguaaaggcgaggcgcgaggugggggggcccgggggugucagauaccgcggcccgcggaggggccaggguggggccgccaagugcccugcggggggaagagggcacagcuggggcggggccgcgccgccagguguucuggcccgcgggggcggggccuccagguccacccgccgggaggagaggggcgaaccccagggauggagggggcuucaccuggggcucgggagccaggaaccccgggaccccgggaccccagaagcccggacgccaggaggcccguccuugcagcaggguggggcacccccgcgguccgggaaaugcaggagaccccgcccccuccagguagagcgcggccagguguggcggacuggcgcuccccgcaacagaaggucgcgcaggacaccggaagucguccuggagucagucugagcggaucgcagggguuccaggcgccccaggccccccacaccgcgagucacaggaacaaggaggaaaaacagccucuuuaugacuugggggaggcaauucaauauuucuuccuggcauaaaauaggaauugcucuauuuacccagcccgcaggagcgucgugaagauuaaugacugugaaauguuuuuaagaucaaaaacauucccagauuuuacuuguaggcacuuauaugugcauauugguaucuguacagcaaaauauacucuuuauugauugcccuccuagugugacuucuauuccguaaucugaaagccccgagauaaaggaaucaggucugucucugccugcuccugaaacacuaggaaauauggguaggaaaugucaggucagcugggcaucuacgcugagccucuauccaguccgcagggcagauagagcaauccagagugcggaccacagcugaacgucuggagaaagggaaaaaacuuuaagauuauuggucaccccccacugggaagaaaacacaguauccuccccagcucauuaggaggugcucccaaagccugagucuccaucagggucucggguguuugcagagccuuggcuggcacugggagccaauggucagccaaguucugccugugccaggagcccacgcagcccaucuggcccggcagcuccaacagcaaggccucccuguuccgagcagaguaaggccacaugaccgcacagaggacaauguugggcuucccaggggugucuccacuccaggcugaacauucucaguucccucaaccguuccugggacauggcuuuaagagcucucucgggcccugcccgcugcuggcgcuggcuguacuccaggugggcaggccugggagcuggcugcagcaacaccaagugggguguccaggauccagauggauuugcaagcacugcccccacccguucccuuggucucccuggaccugaacaagcagcggauaagccgacuguguuugcacuucuagacugcacgaaagaccauccaucagcaaaauaauaaacucacagcuagagcucauuuaaaaggaaaggugcacaaacuccuggccuuucacccccuccagcagagaaaccucgaaugcucuguuuuccccuccaaacucuucuccucucauuuccccucuccacccucccgcugccacacacacaccugcggcagguacaauacuaucacuuccagguuagauucuggccacuuacaccauaaaaugauucuuugcuagccucauuuuauagaugagauuuuuaaauuccaucuuggaaaaagaaaagccccauuaggccagaggaguugaucucccuccacggucuaggucuucgguuccuuccagagaaacuuccucagguuccaugacuccauaauaaaguuuuuguuuguccugggacgggacagauugcuggaggccagauuucaggcauggcuggagcacagccacgauaagcuggacuuuacaagcccugagcuugcuugugcugcaggaagaccuacacacacugucucugugacacauccuuuaacguggcccuuccaggcuucugccacaacgugggcuggaaugagacacagaaauauugccacuauuuccagacaaucuuuaaggcagcugacaguuucuuuuagucauaauuaaggauuuguuuuaaugcaagaagcacauuucugcugaucagaggagagcuuuggaggaagcacaaaucagcaauacaauggaagguaaguauuuuuguauuuuauaaaugagaaggauuuuuagaaccccacggaugaaaagcccagcccucccucuccccccucaccccugccuccagggcuuuucuggacucacagaaggcaacaaaaccaaaggcaaggcuggccaccaccaggaucaggggcagacaacagcagcuauucaggguucccauccuuuaaacaccaaccgaucuuugggaaaaacgaagucucuauuauuaccuaggacaaaagucacaauucucuauagaaacaaaaucaucacuugucccauucauaagaucccaaccauuucaucacaauuuuugugaauauuaagccaacucuaggcaaccaucuguuaaauuuaguuagguaaacagcuaaagcagaucacuuucuaaaacauucacugagggagggacuaggcauauacacaugcaaacuacaacugguucucaccgagugucguugcuaaaaaaacugaacaggcuucagacaccaacaaugguuaaugaucuacauauuaucuacauauuccacuuaaggugaggguuagaaagugaggggccaggaaugcaccucccuuaagcuacagaguugguuccacuuugggaccucggcucccacguggaaggagaagggcuuugugaaugggggaggagcuuuuuccgaaauggcagcagcuacgcaaaacaugaacauccagcaaaaacuuauuuuagcugcauucucccuaaugcuaccaacagauuaaaaacuacuuuaaagucaggagaggaguaaaaauaaacacaacuuccuccugugacuuaagaugccuccuuucugaaguugaauaucauuuccuaaaaucacauuucgaggggguagaaaaggucuguuuacuuuccuugaggaacucuuacuaucugccguuaaaaucguuccucaaaaaagcagauuacugagaagagaaagcacacgacguuccuuagcaguccagaaaagaccaccuucuaagaaaaacucuggaaagggggcaggccaaaucuccaugcccggcaaagacggaugaaugugccccugguucccaucccguccacagcuccugaaguuucuguguucuccagcagucagaagaaugaaggcgaaacuagcccuuggcucccauggucaacauuccacacaaacaauggccuggcucucucccuauuguacauucuguauucauuugugaauccccccuuuuuuuuuuuacacaaugugcaaagcccuucuuuucacaggcgaaguucugaaugcccaagugcagccauaauuuaggcuuuaaacauuaauaaugauagcuaaaagcaaacuccagauuaugcccaaacauuaauuugugaauaucauuagagucacacugauggcuuuuggauacucuccauuaaaucaugaucaaaagggccacugaacaccuuuaaaaugguucuuaaguuuuuagcaauuauuaaauauaauuuuccaaaccccaagauaggauuaaaaaaaaaaaaacucuuucauaagucuuugauacauauuccaucaaacacagacuugaaugaaaauuaacuucaaaagaugagguggggaggagaagccuugcauuuucccuucuuuccaggagugcuguaacuuuaacuugcagcagcguaaauuaagacaugcuuaccagcuguaagggagaaaacugauaucugccaggccgcacagucucuaaaaguguauccauuccagcauuucaugugcccacuaaaaguuuucagcaggguaaguucacacaagcauuccuccccuagcaauucauagaaagauugcuggggaaaagacaccccgagauuucaccacaugggucacuuccauuaaguacaaauacuucuuuuuccagggacagacacacugcccucccauuuuuuaguuacuacaaaaauauguuccacccuguguaacagaccuaccaucccaaaguggaaauauuaccugagcugugcccugcccaacugauaaauuucccuucccaaccaugugcuguaugaauauauauuuguggccugauucagggccacaggacacuagggcugcugcuuuucccugauagauuaacagagggacccaggcugcaugcacauacauuaugaugacagccccucucuauggaaaugacagugguaaaaaaaugacaacuggggcugccauucuaccauugcuguaaacucuuuaaauuuuuuccauuuagggaaagcguuaagugcaaaggguauaacuuugcuuucaaaaaugauucaugauguuagugaacuguuggcaaauggcauucuggugcuagaucucagcagggcuacucccucacucagagguguccuuuucgguuuuuuuucaauccgugaaucucaaggauuucaaauagugugagcuguuuguauuuuaacagcaaugguaacaauaaaaauaucauuuuaaaauccagugcacugcuuguucaguacauacuauauauauucaucauuucuuugccuuguagcuggcuacucagaaacuaaaaaguuguagguugauuuucugguuuuguuguuuguuguugcuguuuguuuguuucauuuaaucucucuuugaaacauuuuccagacuuaaaaaguaaaauuucuggaguuuuaaaaguuaagacugaaguuauugauuauucucugaaaggguaacugacaaacuaguuaauaauuauacagauagcaaguuuuaccguuucaucuuguguacacgaccagauuaacaauggcagggaaagcacacacaacuuggcagggacaggaacaggugugccccgacucucaaaaggccaaaauaucucaccaaguaugucacuggcguguuuuuuacaauggcaguaguguuuguuuuuaacuagccaaacguucuuacuuucuuaacuuuagagagauguacuuuacgaauaucuuucucuucacggaauugaugauucaguuccacacauaaauugcaacucgugcaaggaaaugauuuuuagggacaaugaggcuuuuuaaaaucaguuaagaaaagguaauucacccugccccuccccgcaggagaacacccauucaagggucaguuucaaagcucccaggcgaaaccguaaauaacucacaggguucugcauucaaccugcagacucuuauuaagguacaauuagagaggggguugucagguggggguuaaaaaaaaaaaaagagcgggggggagucgguauucuuuaccuuaucuuucugaacaggaaaaagaauuaaacccaaaccaccuagucagguucaaaacaagcuccaaacccaagaucuuuuaauucccucuaauaacugcuuuccacagggauguaacugggguccccuaccccuggggcacaaaaaaccaaucagcgccauaaauucccuuugccuucaacccucucucccuuuuacaggggggcaggguagggggagggggugacccaacaucaacacuuacacucuacagaaauaugcuggcuuauuuccuuuguuugcucauguuauacuugaucaagugugaacgauuaaacugguuucauuaaaggcaagugcauucacggcuaacauccaacuucaauggcaacuguaagcauauuuugcaagaaagagggccuguuuuuuugcuugaaaucuaccaucucauuaacuuuucuuuugggggcaauaaaaagggcacuagggguuuuucaggagaaugucagagcaguucagagaucugaugccagacaaaagaauauuuagcguuucaacucuacgauacagucucugcuaaagaaaaaaauucuguuucaacauuaaagcagcuaugacugaaaaugucuaauuagcauuuugacuauuacuuuauaauugcuguaagaaguauccuuugaaaucaagugauuacaaaaacaagauccuuuaaagucucauuacuucaaaauagaaaagauuuauauuuaaaaaaaaagggggggguuaaaaaccucagaauucucaaaguacaugaaaacuacccacuucuacuuggaaaacccucgaggcaaaacagcaaucuuagguacugaacacgagguaauuuuuaaacugucuucgaacccaaacaccuaguagagaaagcuaucuuuuuugaaagggugguaugagucgauauauuucgcccaaguuagaaaggcagaaagaaucacuuuguaaacuuccccaaaauauaacguccccucaaaauuauccaugucagauaaaaauauaccagucucuagaauauccaacagaauugcaaauaaggcguuuagcauuuuaaauucccaaugcauauuuauagaauagaauucucuugucuauccuuccagccacucgcaucagacucucuaagaacuuaacccgaucuccaaucuuuaaagaaaaaaggggguaaauacacagaaggauuguuuaccccggacagggcaaggaagcccgguaugacgacguaggccauugccagcagccuccaccacgagcacgcagagcggggauuucuacgaaaaauuccuccucuucccuauaaaauccuaaacgugggguccucugcagccaacugccgcuugggccgccuccggaaaaaguaccgggcggggggaggggggacaaccacaaacacucgcgcgcacacgcucacuccguguccgcgaccgucgucgccggcggaaagcgagccacgggagggagugugugcgcgcgugugugucucggcgcggcccgcggugaccgagcugagcucuugggcccgcggccuccgagccccagggcgcggcgugggcugcaggcgacccgccacgccgcugggccucccgcgggagaaaggcccaggcacgccccggcucccgcgcgccucugcccaacucgcccggggcgcugggggcagcgcgagggagagaaagaaaggcgcuuccccucggccgcgcggggccguccggcgccgcggagggcugggaggaggaggaaccgcggcggcccggcugucccugcgccgcaccgggucccugccgcccggggcgcgcccuagccagccccuccugcuaaacuuuuucuuuuugauucgccccacccgaaaagugcggcccgggcggggaaggugggggaggcgggcgggccgggcucccggcggcggcgggcgaggaggaaguggugcccgcgggagcgcggccgggcagaggaaaugcccggcccgcccggcccccgcccgcgcccgccgcccggcccgcccaggccccccgccccgccgcgacuuuggcgggccgagccccgcgcggcaguggcggcggcggcagcggcagcagauguggcccggcugcccggaggagccaacaaugcggggccggcaaaacaaaaggguuccacuucgccuccuuucccgucuuucacuugcgcucccggggagccgcgcgggaucccccgccggcaggggcagcgccccuggggaccgagagccgcucacgccccgacuuccccacggaaccccucuucuccgcgccccccccacccucgccucguaggcgcaaggcccgccgcaccccggcgcgcucggacuccuguuccccggagauccggccguauuguccccgcggcgcgucgcgcgcucggccugggucgccggcggcccccgggcgcgcacccaccgggcucagggagcaggagccgggggcgcccagggaaccgucgccgagacgccgccgccgccgccgccgcugcccuccggacgccgccgcgcucgggguuucuuuuuuuuuuuuuuucaacccugaugggaaggaaggugaccgccuacuucgcauucaucaacucucaucacaacaacaaaaauccuggcgcaaacggcggccagcgggcgcaaucgguggcgggggcgggcggggacccccgagccagcguccacccccgggcgccgaggggggacacgaggccgggggcacggaccaaagauguccucggaugccggcuccgcguccuucgcccucuuccuccuccuccuccuccucccugaguggcgcagugaggcgcgggcgcggcgcccccagcccgcggccgcaggugaggcgggggcggcggcggccccagcccucccccggggccccccuuaccucgucccggacggucggcguccacggcgaaaggcgcccacccuggaggcggcggcggcggcgucucccgccccucccaccccacccggcggcgguggcgguggcggcggcugugcggcccccccucagcgcggcauggcucccgguucggucccucgcuccucgggccgccgccggcuccuccgggccgcucccgagccaccuuaaaaugacacacgcacacagggacacacacacaaaaacuuaaucucuccagcuccccgccccucccccucccgcccuccccacccucccuccgcuccccuccccuccccacccuaccccucccuucccuuccaccuccuccccucgccgccgagccucuuccuacuuccccacccaccccacccccuuccuccgcccacccgguucccaauuccccccgcgucccggccccgcgcccucccgcccgccgagagggggcugcgcuggggguccccggcccgggcccgccccgcgccgcgcucacccccgagaggaugcuaauuccaacuuggaucgggggagggaacguccuggaugccgagcgccucccggcuauuugcucuucuuuauuuguuuucuccuccggggaaggagaaggaaaacggagagaaaaggaaaggaaagaagcggcgcuggccgcagcucccgguacccgcuggcugcgcaggagcuaggcgggaggcgaggugagggucgccgcucgcucacuccucgcuccuguuuuuggggggggggggcaaaggcggggucucuuuuugcaaaccaaugacacaaccccacaugggccggccucgcccccuucagauacuccucacuacaaaucggcucucucgggggauuaguggcuccgcgaaagugcacacaagcgcggcgggcgggagggccaggggccgggcgcggcgggcacucccuagcccggccccgcccgggaggcccucgggaggcgcgggggccucgguggcaggggccgagguccugucgcgguggcucgggguccgcugcuccccuggcccuucauccuccuccgccccuuccacgugggguaccgggcagccggccacgugggggaacgcgagccccggguggccccggucccauggggccccgcccagccagcggcgccaaccagcccccuucccggcccccgggcuccaacuuccuccuggugccccgcaccggccgcuucugccuucu

SEQ ID NO: 15442 - RNA, 27538 nt, Homo sapiens
ugggcacccgcaccuuccccuccuggaagaggcugagaaguaaagaucaggaacaaggaggaggaggagcuucccagacguguagagcuuaugaaguuuaggaagcagcuucccagacauguagagcuuauggagaggugagggagccaaucucagccacauucagcuuccuggagagaaugaccaaagggcgacgcuucaacccaccuucagacaaggaugggagauggguaaggaagaugguggccccuggugccuuucucaugccacguggguguggucaacagucugaggaguuccaauccugcuucuacuauuacugaagcaugaccuuugacaaaucacuucacuuuacucaaccucaguuucuucaucugugacaugggaauccucuaacacucuugcaaagauugaaugaaauaaugcauguaaaaugcucagcacacuggaaccucgugaauguccacuaagcagucauuccugcucuacuuuuucuuucuuccuuaacaucuauuuucuaacauacuacagaacuuauucucuuaucuauguuauuuuucuccccuugcuagaauauaagcuccauggagcugggauuuuugucuauuuuauucacugauguauccccagugccuagaacaggaucuggagcauagaaggcacucaauacauauguguugaaguaauuauauuauacuagaaaccucuaaacaaauucuuguuggcucccaauccaauuccuuuagccccuccggccuaugaaaugagaagaguccaggaaugcaucauuuacucaucuucaucacuugaaaacuuucccuuuccagcuucacgcucucccccaacucuugcucuucugaugucacuuacagagccugugggauuuuucacucuucuaccaucuucaggaaacauuugggucacuccuaagugugaggucuuagccuugucggccaagcacuucucuccuuugcucuucaacauguauauuucauggccgacaagccucaagccuuucccauuucugauuucuacaauucauucacaaaaagaauguuaaggggaaaucacagcaguagacucgcaaugagaaacauaaucagagaaaaaccugacgucgacuucuuuuaggguagcaacagguaaaaaauuguuaaaauuuuaauuuguuucaaagaaaaacagaaaacacuucagcaaauuugggucugaaggcuuuaaaaaacugaucuacccacuuggauacaaccuuggcuaagcagcuuagucuuucuaagucucaguuucuuugucuguaaaaugggagcauaauguaccaaggguagaagaccauggugggggauucacgacucauuaacaagugcucaguacaaugagugagcacauagaaaccacuuaacauauauacacuuuguauguauguguacauauacguguauacacacaaauguauaccuuguuucauuccacaaaaauuuaaagcauggaaaauguacacaauaaaauaauacaguauaaaucaaauagaaaguuauaacuaguuuuauaaauacuuuagaaagagaagaggcugagucugagaacacauauaacauagacauaauauuagguauauuuccaggauuauaugguagauauuugggcaccacauuugacucugaguucccuggcagccaaaguaaaaugagagauaaugucaacuccauaaagcuaaguucccaugaaaagaaaaauguaaguugcucagauuaaguagcuuucccucuagcuauuaccuauguaucaguuacaauuguuagccugaauuuuauagaaggcugacuaaagugacuacagugucuuaaccaaauagggauuuauauuucuuaaguaacaaugaaaccuagaaguuggccaucccaggcuaguacagcugcucaagggagucaucagcagcucccuuuucagcauucuguuuugccauccuuagugugggaugacuccagcuccaaacagugaauccacaacucaggcagggaaauaagaggaaggucaaaggacaaaaagauggaaggcgccugucaccuaagucugccccuuuuuaucaggaaaacaauacuuuccugccuucccuggagccugcucccuagaccucugcuuccaucucacugugucacauggccaauuuagcuaaaagggugucugaggagguguuuuuuuuaaccaaccacauggcugcugugaaugaagaaccugaauucugugguaagggggaaagcgagaaucaacauuucauaggaagaaauuuuauuuuauccuucuaucaagaccccagaaacguagcccagucccuggguuuuagggagaaaggcacuguuccccaaagcuuggcuugggccuuuggcaaaaauccuuucugcugucagcaccuaagagcauaaaaagaauagugcugaucaugaaguuucccaaaguaacuuguagacgaggagggaaaaauuaaagaaauuauuggcuuugagucagcugcagcccauuugggaggaccguaauugccacauuagaggugacagucauuuugcaguugaccuugcugguugcaaucuagcuauugccagguaggaaagacuuuuuccacacacuugccccuuccuauuuaauauuucagucauugagugacugaacgaagcaaaaauuucaccgccaacuuguuaaaaagcuguauuucacgguuacaauaucuaacagaaggguuuauuucacagcuaucauguuauagccauuaaauauauauuuuaaaagagcgaaauuaaaacgcuagagccauuuuuuacagugauuuagucuacagaccugcugaauacaaaugaacccaacucaguugucauuuaacuggugagagacaucauucuugauguuagaacagccucccccaacccccagccugauuuuccacaacuuccgagagggaaguguugacucagucagacuggaggaagggugaaggaaaagguucagaacccgaagacccuuuguauuauuuauauuuaccucuaaaaauauuucuuuggaaaacauuuuaaaaauagaagauagaaugaaugagaaagauauagguugacuuugaacacauuucuagaauauauuaagagaggaaagcaaggugcaaagcaguauguaugauauaaucugauuuuuguaaagcaguguaagucuucucacaggcauagguguuuguaugugaucauaugagugcuugguugcuaauauuguuaucugggguuggggagugcgacaggaagcagagaagaaagcaacccaaagcuaccguaaaauaauaaggcagaggaggggcgucaagauggcugacuagaagcauugcgugcccgccuaucccacuuagaagaaccaaaauaguguacaggcagucacacuucaaauauguuauccaagagagaacgcuggaauucaacagagaagugacaggaaacaccguacguggggaaagagaaaggaaaaaggcagccugccuggccgggaucggcugggagccaggagugacuucccaacauggggaaaggguaagugaguaagugagagacuuccggcagcccacaugcccacuguagaaauguguaacucuggccauggagaacuucucgacccuucucucccugaaacuaacagagagagucucccggaaacugugggauggaacuccucuagggaggaaggucaugcuggguuccuuucugagacccaggcugcuauagcaaggugccauuuucaaaucuaucuuuugacagacugcacgcucuccugggccccagaagcaucuggacugaggcauuauggaaacuugggcuguugcuacugggacugaggagugagcugagagcacuuccacaguugaggcuaagaagcaacugaggcacgggcugcagcugcagcugcuggugcuggguagugagcacugccaggagacuggggugugagcgaggcacaaauugacacuggaacuaaguugucagcuuggcgggggcggggggggugcuccuguagccagagccaaggggagcaagcuagacaugggcuacugcugccaagguuggagggcaaacccuggcaggacuggagcaugagagggauguguguuccccaugcaccagcccagacuguggccaccaaagacaaccccucccuccagugacagggccucagcacagcugcuaccaccucucagcugagcacuccaccuggggccugcuccugcucacgauggcuggugccugcugucauauuuugggggccugagcgcaagcccacccagccgggcuuugccuccucuuccaugacagaacacagagccucacguccuugagcuugcccaacccaucuaccaccuugaguacacuccucccagggaacucagauugggccuaaacuccuggccacuaccaucucagcuggcccccaugugcaagcaccaccugcaguccuagagacuggccugcccagcccaucgcaaccacugccaacaucaaugcacaccacucaggacccaaaaaauuauccugccacugcuacugccaucacccaugccacaccagcugccuaggggccugagaacccacccaccugccucguucauugcugccacuacuaguaucaaagcaagccaccgggaggcccaagaauuggcccaccaagaacugccaaaacaggugccagcuuauacuacucugaggcacaaagauagacaugcucagccaacugcugccaccaauggggccugaagacugaccuaccuggcaucucaguccccagcacaacuucaucacagccucuacuguuaaccacacccuaacacacugaggaaaucacagguaccacuaauugugguuacagacaaagaaaucauauaaagccugcaugacuacaugcaugcagaaucaaagccaaaguacucuauccaacugacaccauggaaacaucuucaggaaaauguccucccuuauaaaaguaaauuuaaaaauaggaagaagagacuguuacaccagaugugcagauagcaauguaaggacagaauaaacaugaaaaagcaaggaaauacacuuccaagagacaaaauaauucaccagcaauagaucuuaaucaaaaagaaauuucccaaauaccagauaaagaauugaaaauauucauuuuaggggcugggugcaguggcucaugccuguaaucccagcacuuugggaggccgaggugggcagauuauuugaggucaggaguugaagaccagccuggccaacauggugaaaccccaucucuacuaacaauacaaaaauuagcugggcaugauggugcaugccuguaaucccagcuacucaggaggcugaggcaggaggaucaauugagucuggguggcggagguugcagugagccaagaucgcaccacugcacuucagccucggcaauagagugagacuaugucucaaaagaaaaaagaaaaaaaaauucauuuuaaagaagcucagugagauacaagagaaggcugaaaaauaauacaaagaaaucagaaaaauaauucaggauaugaaugagaaauuuuccaaggagaaagauauuuagaaaagaaaagaaccaaauagaaauucugaaauugaagaacucauggaaggaaauacaaaauacauuugaaaauuucaacaauagacuugaucaggaagaagaaucucagaacuugaagacaggucuuuugaaauaauccagucagacaaaaauaaauaaaaaagaauugaaaaguaugagcaaacucuuuguuacauuuuggauaacauaaagugaucaaacauuuaaguuaucaggauccuccagagaaaagagacaaagaaaagauuagaaaaccuauuuaacacaauaauagauaaaaacuucccaaguccagaaagagaucuagacauucugguacaagaaauucaacaguccccaggcagauacaauacaaaaaggucuucuccaugaaauguuauagucagacuaucuaaagucaaagauacagaacaaauuuuuuaaaaaagcaagggaaaagcauuagucaucaauaaaggaaacuccgucagacuaacaauagguuucucagcagaaaccuuacaggucauaagacaauaggaugauauauucaaaaugcugaaagaaaaaacugccagucaagaaugcuauuucuagcaaagcucuccuuuacaacugaaggagaaauacagucuuucccagacaagcaaaugcugagggaaggacuuuuuuaccauuagauugaccuuuugagaaauacucaagggaucccuggaagugaaaggacaauauuuaccaucaugaaaacauacaaaaguauaaaacucacucguagaacaaucacacaaaggaggaagagaaaggauucaaauuguaccacuacagaaauccaccgaaccacaaugacaagcaguaagauaaaaagaaaggaagaaagaagauguaaacaacaagaaaacaauuuaauaacaugauaggaacaaagccucacauaucaauaauaacuuugaacagaaaccuuaaauuauccauuuacaagauacagaauggcuggcugaauggaauuuaaaaaaaaaaagauccaacuauaugcugcuuacaagaaacucacuuugccaguaaagacauauagauagacugaaaauaaagucaugauaaaaagauauuccaugcaaauggaaaacaaaagugcacaacaguagcuguacuuagauaaaacagucuguaagucaagaacaguaaaaaaaauacaaagaaggucauuauauaaugauaaauggaucaauccagcaagaggauauaacaguucuaaauauauggcuauccaacacuggagcacccagauucauaaggcaaauauuauuagauccaaagaaauggacugcaaugcaauaauaguggaagucuucaauucccuacucccagcauuagacagacaaucuagacaguaacucaaccaagaaacacuggauuuaaacugaacuuuaggccaaauggacccaacagacauuuacaguucauucuaucaaacaacuggagaauauacauucuuuucaucagccuauggaacauucuccaggauagaccauaugucaggccacaaaacaagucucagcaguuuaaaaaaauuaaagucauuacauaucuucucagaccacaguagaauaaaacuagaaaucaauaccaggaggaacuuuggaaacuaugcaaauacauaggaauuaaacaacaugcuccugaaugaccccugggucaaugaagaaauugggauaaaauuaguggggaggggccaagauggccaacuagaaacagcugugguuggagguuccuacugagaagaaugaaaauggugagugaauccugcacuggcaacugagguauccugauucugucagagacugacuaggugguuggcaugacccacagagagugaggaaaaguaggguggugugucugcccaccugggagccacaugggguugaguucccacccccagccaagaaggguggugagugaucaucuugcccugcccuggaaaccaugcuuuauccauagaucugugcaacccauggaucaggagaucccccucaugagcccacaccaccagggccuuaggucccaagcacagagcugugcagauucucagcagccacuugguggggacugccuaagacuaccgaguuccuggggggagggguggccaucaucaccgugggugccugcugccuaagacgacugaacuccccaggagaggggcagcugucaucacuguggcugccugcuaagacaacugagcucccagggggaggaguggccaccauugcuguagcuccagucugccauuuuuacccugcuggugcuggagagacuggaccauguggacccaggaggaauuucccacagcacagcauagcagcuguggcagaucguggccagacugccuguuuaagcuggacucugguccaucccucuucacuggaugaggacucccugcaugaauuucagcaacuccagccagggguuuaaggacagaacucuugucucccugggacugaaccccuguggggagggguggcuauggucucccuggaucagcagacuuagucuucuccccugcuggcucuaaggaaccugggcaaucuggaugagcggagauucccccagcucaaugcacccacuuugccaaggggcagccagagugcuucguuaagcagggcccugguucccaugccuccugacugggugagaccccucagucaaguuacacaggaguguuccugcugguaucaggucagugucccucugggacagagaucccaaaugaaggagcaggcugccaccuuugcuguucugcagccuccacuggugguaauuccaggugccagagggacccaggcaaauagggucuggaauggaccuccagcaaacugcagcaguccuguggaagaugggccugacuguuaaaggaaagacaaacagaaugcaacaaaaacaauagcaucaacaaaaaagucccuguaaaaauuccauccaaaggucagcagccucaaagauugaagcuagaaaaacucacaaaaaggagaaagaauuaaugaaaaaaugcugaaaacucaaaaagucagagugccuuuuauccucuaaaugauggcaacaccucuccagcaagggcacagaacugggcagaagcugagauggaugaauucacagagguaggcuucagaaggugaguaauaacaaacuucacugagcuaaaggagcauguucuaacucaaugcaaagaagcuaagaaccaugauaaaacauaacaggagcuguuaaucagaauaaccaguuuagagaggaacauaaaugaucugauggagcugaaaaacucaacaugaaaacgucacaaugcaaccacaaguaucaauaauuaaauagaccaagaagaggaaagaauuucagagcuugaagacugucuugcugaaauaagacaggcagacaagaauagagaaaaaugaaugaaaaggaaugaacaaaaccucugagaaauaugggauuauguaauaagaccaaaccuaugacugauugggguaacugaaagagacagagagaacagaaccaaguuggaaaacguacuucaggauaucauccagaacuuccccaaccuaaaaagacaggucaacauucaaauucaggaaacacagagagccccaguaagauauuccacaagaagaucaaccccaagacacauaaucaucagauucuccaacguggaaaugaaggaaaaaauguuaaggucagccagaaagaaaggccaggucacuuacaaauggaaacccaucagacuaagggcagaccuuucagcagaaacccuacaagccagaagagacugggggucaauauucaaccuuuuuuuuuuuuuuuuuuuuuuugagagagagucucucucucgucgcccaggcuggagugcaauagugugaucuuggcucacugccaccuccaccuccuggguuccauugauucuccugccucagccuccuuaguagcugggauuacaggcaccugacacgaugcccagcuaauuuuguauuuauagcagagacgggguuucaccauguugaccaggcuggucuugaacuccugaccucaagugaucagcacaccuuggccuuccaaagugcugggauuacaggcauaagccagugcccagccucaacauucuuaaagcaaaaaauuuccaacucagaauuucauaucuggcuaaacuaagcuucauaagugaaggaaaaauaaaauccuuuucagacaagcaaaugcugagggaauuugccaccaccaggccuaccuugcaagagcuccugaaggaagcacucaauauagaaaggaaaaaccauuaccagccacugaaguacaaagaccaaugacacuaugaagaaacuacaucaacaagucugcaaaaauaaccagcuaacaucaugaugacaggaucauauucauagauaacauuaaccuuaaauguaaaugggcuaaaugccucaauuaaaagacacagaauggacagcuggauaaagagucaagacccacuggugugcuguauucaagagacccaucucacgugcaaagacacacauagccucaaaauaaagagaugaaggaaaauuuaccaaacaaauggaaaucagaaaaaaacagggguugugagccuaguuucuggacaaaacacacuuuaaaccaauaaagaucagaaaagacagagaagggcauugaauaaugguaaagggaucaauucaacaagaagagcuaacuauccuaaauauauaugcacccaauauaggagcacucagauucauaaaacaaguucuuagagaacuacaaagagacuuagacuccccacaauaauagugggagacuuuuacaccccacugucaauguuagaucauugagacagaaaauuaacaagaauacugaagacucaaacucagcucuggaucaaggggaacugauagauaccuacagaagucuccauccaaaaagaacagaauauacauucuucuuggugccacauggcauuuacucugaaacugaucacaugaugggaaguaaaacacuccucggcaaaugcaaaagaagugaaauaauaacaaacugucucucagaccacagugcagucaaauuauaacucaagauuaagaaacucacucaaaaccacacaacuacauggaauuugaacaaucugcucuugaaugacuccuggaaaaauaaugaaauuaaggcagaaaucaaguaguucuuugaaaucaaugagaacaaagagacaauguaccagaaucucugggacacagcuacagcaguguuaagaaggaaacuuauagcaccaaaugcccacaucaaaaagcuagaaagaucucaaauugacacacuaacaucacaacuaaaagaacuagagaacuaagagcaaaugaaccccaaagcuagcagaagacaagaaauaaccaagaucagagcgaaacugaaggagauagagauacaaaaaacauuucaaaaaaaaucaaugaaucuaggaggugguuuuuuugaaaacauuaauaaaauagaccacuagcuagacuaauaaagaagaaaagagagaagaaucaaauagacacaaugaaaaaugauaaaggggauaugaccacugaccccacagaaauauaaccaaacaucagagaauauuaugaacaccuuuaugcaaauaaacuagaaaaucuagaagaaauggauaaauuccuggacacaugcauucucccaacacuaaaucaggaagaaguugaaucccugaauagaccaauaacaguucugaaauugaggcaguaauuaauagccuaccaaccaaacaaagcucaggaccagauggauuuacagcugaauucuaccagagguacaaaaaagagcugguaucauuucuccugaaacuuuucagaacaauugaaaaggagguacuucuuccuaacucauuuuaugaggccagcaucauucugauaccaaaaccuggcagagacacaauaaaaaaagaaaacuuaaagccaauauccaugaugaacauugaugcaaaaaugcucaauaaaauacuggcaaacugaauccagcagcacaucaaaaagcuuauccaccaugaucaagucagcuucauccccaggaugcaaggcugguucaauguaugcaaaucaauaaauguaauucaucacaugaacagaacuaaagacaaaaaccacaugauuaucucaauagacauagaaaagaccuuuaauaaaauucaacaucccuucauguuaaaaacucaauaaacuagguacugauggaacauacgucaaaauuauaagagccauuuaugacaaacccacagugaaugucauacuggauggguaaaagcuggaagcauuccccuugaaaaccagcacaagacaaggaugaccccucucaccauuccuauucaacaaaguauuuggaaguucuggacaggacaaucaggcaagagaaagaaauaaaguguauucaaacaggaagagaggaagucaaacugucuguuugcagauggcaugaucccauaucuagaaaaccccauaaucucagaaaaaaacuggaggcaucaugcuaccugacuucaaacuauacuacaaagcuagaguaaccaaaacagcaugauacuaguacaaaaacagacacauagaccaauggaacaaaauaacucagaaauaagacugcucaucuacaaccaucugaucuucaacaaacuugaaaaaaacaagcaaugggaaaaggauucccuauuuaauaaauggugcugggagaacuggcuaguaauaugcagaaaauugaaacuggaccccuuccuuaugcaacaauuaacucaagacagacuaaagacugaaauguaaaccccaaaacuauaaaaacccuagaagaaaauuuaggcaauacccuucaggacauaggaaagggcaaacaaauauuacaugauuaaaaugucaaaagcaauugcaacaaaagcagaaauugacaaauuguaucuaauuaaacuaaagagcuucugcacagcaaaauaaacuaucaucagaaugaacaggcaaccuacagaaugagagaaauuuuuugcaaucuauccaucucauaaaggucuaauaaccagaaucugcaaggaacuuaaacaaauuuacaagaaaaaaaccccauuaaaaagugggcaaaggacaugaacagauacuucucaaaagaagacauuuaugcggccaacaaacauaugaaaaaaagcucagcaucacugaucauuagagaaaugcaaaucaaaaccacaaugagauaccaucugaugccagucagaauggcaauuauuaaaaagucaagaaacaacagaugcuagugaggcuauggagaaauaggaaugcuuuuacgcuauuggugggaauguaaauuaguucaaccauuguggaagacagugggugauuccucaaagacuuagaaccagaaauaccauuugauccagcaauacuguuacuggguauauacccaaaggaauagaaaucauucuauuauaaagauacauucaugcguauguucuugcagcacuauucacaauagcaaagacauggagucaacccaaacauccaucaaugauagacuggauaaagaaaauguacauguacaccacggaauauuaugcagccauaaaaaggaaugagaucauguccuuugcaggaaucuggauggagcuggaggccauuaucuucagcaaacuaagacaggaacagaaaaccaaacacuaucacguucucacuuauaaaugggagcugaacaaugagaacacauggacacagggaaggaaacaacacacacuggggccuguuacggggggugugggagggagagcaucaggaaaaauagcuaaugcauguggggcuuaauaccuaggugacagguugauaggugcagcaaaccaccauggcacacuuuuaccuauguaacaagacugccucuccugcacuuguaucccagaacuuaaaauaaaguuaaauaaauuuuaaaaagauaaaaauuuaaaaaauucuuaaaacaaaugaaaauggaaacucuacauacccaaaccuuugggauacagcaaaagccgaggaauuuuucuuuuuuuuuuugagacaaaguuucacucuuguugcccaggcuggagugcaauggcaugaucuuggcucacugcaaccuccgccucccagguucaagugauuauccugccucagccuuccgaguagcugggauuacaggugccugccaccaugcccagcuaaguuuuguauuuauuuauuuauuuuauuuauuuauuuuuuuugagauggagucucacucuguuuccaggcuggagggcaguggugcgaucucugcucacugcaaccuccgccuccuggguucaagcaauucuccugccucagccucccgaguagcugggacuacaggugcacaccaucacacccagcuaauuuuuguacuuuuauuagagacaggguuucaccauguuggccaagauggucucgaucucuugaccucgugaucugccugccucagccucccaaaguguugggauuacaggcaugagccacugcaccuggcaacuuucguauuuuuaguagagacaggguuucaccauguuggccagguuggucuugaacuacugaccucaggugauccaccugccucagccucccaaagugcugggauuacaggcgugagccaccgugcccggccaagcagaggaaaauuuauagcaauaaauaccuacaucaaaaaugguagaaagauuacauaaauuaacuaucaacaaugcacuccaaggaacuagaaaagcaagaauaaaccaaacccagcauuagcagaagaaaagaaauaauaaagaccagagccagaacuaaaugaaauagagacuaaaagaaaauacaaaggaucaaugaaauuaaaaguugauucuuuaaaaaagaaaaacaaaauugauaaacuccuugcuagacuagccacaaaagagaaaacccaaauaaacaaaaucagaaaugaaagaggagacauuacaaguaagaccacagaaauauaaaagaucuguggagaucuuuuauuaaauaaaaaguuggagaucuuuuuuuaaauaaaaaaguuggagacuacugugaacaacuauaugcugacaaacugggaaacccagaggaaauaaauaaauuccugaaaacauacaaccuaccaagauugaaucaggaaggaaugaaaaucugaacagagcaaugcugaauagugagacugaaucaguaauuaaaaaaaaaaaaucucccaacaaagaaaaguccagaacugguuggauucacagcugaauuuuaccaaacaaaacccaaauaccaauugucuugaaacuauuucaaaauauuaaagaggagggaauucucccuaauucauucuaugaggccaaccagcaucacacugauaccaaaaccagagauagacacaacaaaaaaaagacaacuacaggguaugcagaggugccccaaccacacucuguccacagacucucaguuauuuuaggagaucccuggccaaagauuuauuucuguugacaaccaagggccuccgucuggauuuccaaggaagaaauuuccuuugaagcacuggaacuugccaccaccagcaccaugcccuaccgauauccagcauugacccuggagcagaagaaggagcugucugacaucgcucaccgcaucguggcacugggcaagggcauccuggcugcagaugaguccacugggagcauugccaagcggcugcagucccuuaacgccgagaacaccaaagagaacuggcgcuucuacugucagcugcugcugacagcugacgacugcgugaaccccugcaucggggacgucauccucuuccaccagacacucuaccagaagaaggaugaugggcguccuuucccccaaguugucauguccaagggugguguugggggcagcaagguagacaagggcguggucucccuugcagggacaaauggcgagaccaccacccaaggguuguaugggcugucugagugcugugcccaguacaagaaggauggagcugacuucaccaaguggcauuguguucugaagauuggggaacacacccccucagcccuugccgucauggaaaauaccaacguccuggccugucaugccagcaucugcuagcagaguggcauugugcccauugcggagccugagauccccccuaauggggaccaugacuugaagcacugccagugugugaccaagaaggugcugacugcugucuacaaggcucugagugaucaacacaucuaucuuggagggcaucuugcugaaccccagcauggucaccccaggccaucccugcauccagaaguuuucucacgaggagauugccauggugacugucacaacgcugcaccgcacagugccccccgcugucccugggaucacauuccugucuggaggccagaaugaggaggaggcauccaucaaccucaacgccauuaacaagugcucccugugaccuucuccuauggccgagcccugcaggccucugcccugaaggccuggggcaggaagaaggagaaccugaaggcugcccaggaggagucaagugagccguggccaacagccuggccugucaaggaaaguacaccccaagcagugagacuggggcugcugcuagagagucccucuucaucucuaaccauaccuacuaaguggagguguuccccggcuguucccaacacuccaggccccgccccuacucucuugaagagcgggccuucuccucaggucuccagguuggcuugcccgugcucuugccucccucgugacagugguguguggugucgucugugaaugcuaacuccaucacccuuuccagcacacugccaauaaacagcuauucaagguuggaggagggggggcggggagagaacuacagccaguauccccaaugaacauagauacaaaauuucucaacaaaauaccagcaaacuaaaugcaacagcacaucaaaaagacaauauaccgugaucaagugggauuuauagcagggacgcaaggaugcuucgacacacacaaauccguaaacaugacacaucacaccaacaaaaugaaggacaaaaaccauaugauuaucucaauaggcacagaaaaagcauuugauaaaauucaacaucgcuuuaugauaaacacucucaacaaacuagacauagaaggaacauaacucaaaauaacaaagaccauauacagccaacccacagcuaacaucauacugaauggaguaaaguugaacgccuuugcuccaagaacugaaacaagacaaggauucucacuuucaccauuccuauucaacauaguacuagaaguccuagccagagcaaucagucaagagaaagaaauaaaaagcauccaaauuggaaaagaagaagugaaacugucucuuuuugcugaggacaugauauuauaucuagaaaaaccuaaauacucuaccaaaaaaaaccccacuuagaucugauaaauauauucaguaaaguugcaggauacaaaaucaacauacaaaaagcaguagcuuuuauauauaucagcaaugaucuagcuaagaaggaaaucaagaaggcaauuucauuuauaauagcuacaaaaauauauaagaauaaauuuaaccaaggagguaaaauaucucuauaagaaaaacuauaaaacauugaugaaagaaauuaaagaugacacaaacaaauggaaaaauaucucaugcuccugcgucggaauacaucauuaaaaugaccauauugcuuaaagcaaucuacagguucaaugcaaccucuaucaaaauaccaaugucauucuucacagaauuagaaaaaacaaucuuaaaauucauauggaauaaaaaagagccagaauaaccaaaggaaucuugagcaaaaugaacaaagcuggaggcaucacuuauuacaagacuauaguaaccaaaacagcauggcauuuguauaaaauuagacacacagaccaauggaacagaauagagaacccagaaaacugaucuuugacaaagccaauaugaacuuauaucggggaagcagcacccuguucaauaaaugguacugaaagaauuggauagccacaugcagaagaaagaaacuggacaccuauaucucaccauauaaaaaaaucaacucaaaaugaauugaagacuuaaauauaagaucugaaacuguaaaaaacacuagaagaaaaccuagagaaaacucuucugaaccuugguuuagacaaaaaauuuaugacuaagaucuccaaagcauaaacaacaaaaaugaaaauagacaaauggaacuauauuaaaucaaaaagcuucugcacagcaaaggaaacaaucaaaagaguaaacagacaaucuguugaaugggagaaaauauuugcaaaccauucaucugacaggggaauaauauccagaauauacagggaacucaaacaacucaacuguaaaacaacaacaacaacaacaacaaccaaaaaaccaaguaauuccauuaaaaagugagcaaaggacaugaauagacauuucucaaaagaagacaugcaaacggcaaacagguauauggaaaggugcucaacaucauugaucaucagauaaauggaaauccaagcuacaaugagauaucaucucaccccaguuaaaauggcuuuuauccuaaagacaggcaaucacaaaugcuggugaggauaucaagaaaagagaacaccuguacacugcugguggaaauguaaauuaguacagccacuguauuagucuguuuucacacugcuauaaaggacuaccugagacugguaauuuauaaagaaaagagguuuaauugauucacaguucuguauggcuggggaggccucaggaaacuuacaaucauggcagaaggugacagggaagcaaggcauaucuuacauggcagcaggagagacagugagcaaagggggaugugccacacuuuuaaaccaucagaucucaugagaacucacucacuaucaugaaaacagcaagggggaaauccgcccccaugauccaaucaccucccaccaggcgccucuucugacauuuggggauucuaauucaagaugauuugcauggggacaaccauauuagagccaaaccauaguagccacuauggaaaauaguauagagguuccucaaaaaauuaaaaauagaacuaccaugugauucggcaaucccacugcuagguauauacccaaaagaaaggaaaucaguauacugaggagauauuugcacucccauguuuauugcagcacuauucacaauagccaagauuuggaagcaaccuaagugucuaucaauagaugaauggauaaagaaauaugguacacauacaaaaugaaguacuauucagccauaaaaaugaaugagauucugucauuugcaacaauguaaauggaacuggaggaaauguuaaguaaaauaagccagguauagaaaggcaaacuuuucacauguucucacuccuuuguggaagcugaguauuaaaacaguugaacucauagagaguagaaugaugguuaucagaggcuaggaaagguaguggugagggacauggggauggaaaaugguacaaaaauauaguuaggaugaauaagaucuaguaguugauagcaugacaggggggugacuacagucaaucauaaucuauuguacauuuuaaacuaaaaguauaauuggauuguuuguaacacaaagaaaugauaaaugcuggaggugauggauccuccauuuccccugaugugauuauuacacacuguaugccuguaucaaaauaucuuauguaccccauaaauauauacagcuacuauguacacauaaaaaauuuaaaaaauuuaaaaaaggagacauauaaaugggaaacaggcauaugaaaacaugcuaaacaucacuaaucaucaggggaaugcaaauaaaaaccacgaugagauaucaucuuaucccagucagaauagcuauuacuaaaaagacaaaaaauaacagauguuggcgaggauggggagagaagggaacucuuauacacuuuugguggaaauguaaacuaguagagccacuauggaaaauaguauggagauuucucaaaacucucaaacgagaaauuaccauuugauccagcaaugcuacuacugaguaucuacuaaaaaaaaucaauauaucugagggauaccugcacuugcauguuuauugcagcacuauucacaauagcaaagacauagaaucaaccuaaguguucauaaauugacgaauggagaaugaaaaugugauugcuauuuagccaaaaacauuugcaaacuauucacacuauuggaguguauacauuuccucuuuguaucaaaucuaccauaucagguagguauuauuauucccauuuuacagauagggaaaccgaggcuugagaaaguuuagucucucucaucaggcucaccuaggagauaggagagagaccugggguggacucaggaccucugaauguccagccucugacccaaccacauuaugcuuccuucucccuuuaugggaauuuucauugaauugggucuugucuuuuuaauuuccauucauuuccuccuagagaguccugcuucagagcucacuuuguugggguggcuuuuaagaggcaccauucaaauaacauuggggugagcuucucuugccauaagagcuagccacaccccccuucaggaaugaaagacucaucacucuggcugcugggagcauggcccucacugcccacaccuacaggucuguuaucugaagagagcugccucccuagggucacgccuucuucuggggguagcucaggaauaaauccaaugccucauugcuuggugcacagagacuggguccccucuccccagcucugaguggccacccaauguccagagcucccagccgggucaacagaggcccuuguugggacuaccccucuucugcccaguccuguuuccuucccaggcuuuuguugggagauugcaaggacauauucuagauaauccucaguccucauuuuucuugcuucacauccuucuacccccucuuuuucccuccuagacguuaccuccccucuaccauccuacauuuccaguggagaaucacuugagauucucuguuccuccccuucccguggucuuagggccaccucauaccuacauugcuggagguuggcucaucuccauaaacguggguuggcuccaagguccucaguacugggagcucccugaccacaggaaggaucucaaauaacacauuucugucuucucagaaugugucugcucacucacugaggaccacacccuccuuaccaggcuauggaaacauuuccaggcuccagcucagcagggguggccucuguaacuugaaacaaccggcagugauggcucugggccauuacaauguuuuuugucuuggaaagaauacuugaaaauuacaaaaauuaugccauuuccauugcaugccaaaagcacccaaauugcauuuuaaucacuguacaaaggaagcccugauacuuggcuuguagauucaaaugugucugguuuuaaucaaggcgugugcuguucuuccaguucccucacaucgggcuaacgcaaaagacaccagaauccaucaccagugcuacgucaaaagagccccagaguccacacuugccucggcaagcggaggggaagcugccgcccauauacaaaguccgggagaaggugaguccugaacacuggccacugccaugugcuccuguggaccucccagggggcagcgccgcuggcacguugggccaaacaauucuucuuuguaagaaacugcgcauuuacuauccuuggaccccuaaggguugguaguauccccaccccauacccuggugcucugcggcaggaacuacuuccugcuauggacaaucaaguuaggcuccuccacgaacaagaagcaacacccccuuccagcccacagcucauuaacaugcaccuccugccuccccggccaauuccugagcaacuuccaggcccugcaguggcacaaaggagaagccaggguccauuucauaccugccaggguuccccccaggccuugggccagggcucucaucuccugggacccuuacuggccagaugacagaguuggucuacacggccucaaaaguccuucccaguuuuuggcuccaugagccuguacacuuuuccauccuugcauccaaauaagguguuuugaaagauaauuuuuaugacuuuggggaagcuggaaauaaggugggguuucaaagcccggcgcugaugagcacguggauauccucccccuccugugucugcuccaucucuggggccagguuucauugucuuucuuagaggucgcuuugccucauccaucuuccuuccacaucacccgaucccaguucugaaagcaugcaggguucuaaugugugcucuuucccuuccaucccacuuuuccagcaagcagugaauaaccaguuccccuucuccgugcaugacaaucggcacagcuuggagaacucuggaugcuaccuugacuccgugaguauuucuuuccaaauuauuaauaaaacagggaacaacacaagggaucuugauuuucugggguguguugaagauagaggauuggccucaaaacuggaacaaggucaaaacaaagcgaggucuuaaacaagacucauaacagauuaaaaaaaaaauguucaaagcucucagaauuccacgccgcuuucaagaucuacaccaguguucugccuagguguaagugcgcuucauccuucugcaagugccuucccauaaauugucucuuuugcgagcuuucuugugaggaucugccaugggaaggagggacugcuaugcguaucucuggauggcagaaccaggauccacgaggaaaggucagaaggaggaggagcuuacauaauauaaggaaggauuuccuuguaacuggaguugccuuuucucuacagguugugaguuccccaucacuggagaacaugaagucugauacaguggugguucacacagcacugugugauagaaauguaguguaaacuguaugcauaauuuuaaaugcuuuagugguuacauuaaguacaaagaaacaggugaaauuuacuuuaauaauauauucuauuggcugggagcaguggcucagcccugaaaucccagcaguuugggaggcugaggugggaggaucacuugaggucaggagcuugagaccagccugggcuacauaguaagaccccgugucuacaaaacauuaaaaaauuaaccaggugugguggugcaugccuguugucccagcuacucaaaagauugaggugggagguucacuugagcucaggaguucaaggcugcagugagcuaugaucacgaacacugcacuccagccugggugucagagugagauccuaucucaagcaaacaaaaauaauuuauuuagcccaauaauucuccaaauugcccauucaacauguaaucaauauaaaaaauuaaugagauauuuuacauucuuccuuccaaaccaagucuuuaaaauacaguuuguguuuuacacuuauguaacaucucaacguagacaacucacauaucaagugcccaauggcuacauguggcuaggggcuaccagacugcacagcacagggaaaccuauuagauagaaagcuguaucaagugauaccugcaaauccucauggaaccugaaaguccaugauaaugaagguguuauuaauggcccaccauuuauaaagcaucugccauauaccaacaucucguauuauuguauucaauccucacaacaauccuacaggcuaauuacacuuaucaucucaauuuagagaugagcaaauugagauccaguaaaguuaaacaacuugccccaaaucccucuuucuucuagacuacagugucuuaacuaaauagaagugccuuaaccccagaaaucugguuuucuucuggcagaauguugaaaacaggaccagaauacccacuuugccugccucuguacauggggugcuuaauauuguuuuuuaaauaaccaaagcaacauauguccuuuaaaaaacugaaaucauacagaauuguauaaaauuaaaaauaaauucacacccuuauuuuccuuccucacaaucugaccuugacgauucacugcuaguaaugguuuuguggguaaaauuugagaguuuuuccaauucacaugcagauguacacacauaaauguauauuuguuaaugauauaaacaggauucuaccacuuguauuuugccaagguuaugauagucuucuagaaagccuuggaagcuuuccaacuuucucuauguucuggaauagcuuauauaacauuuggauuuucaguuuaauggaaguuuucaguuuaauggagguuagacagaauuugccuaugaaauaacuuggguuugguauauuuuuuagaguaagguuuuuaugacuuuuucuuucuuucuugauuauuaaucuauucaaacuuucuaucucuucuuggguagauuuugcugauacguauuugccuaaaauuuaucuaauucauuucaaauguacgguauaacaucucucaaaauagucuuauuuuguuguuccuuaaaauuuguuuucaguugaauguuuaguucacauacuugcaauuguuuuuguuaauaauuuauuaaaacuauaaguagucuuuagauuauugguuugacuacaucccaaagguuuuuccaauuaaggucucauuauuauuugcuuucaaauagccuaugauuuaauuuuuaauuuuucccuuuccuaaaaaaauuggaagaauguuuugaauuaucuauaugguuaaaaauuuuagaaauaaucuauucauugcuaauaucuaguuuuauggguuaugguaaauuucagaguauaaucuaagauucucacuuuuugaauuaugagauuaucuuuguugucuugugugugauuaacuuuaacaagugugucguggcuguuuacaaauaauauauauuccccccuguugguuacaaaguucuuuauauuuauuaauuuaggacugugaauuauuuaaaucuuucauauccuugucuuaauuuuuguauugaucugucaauuucugcuucuaagauuauucuugaguuucuaaaguuuuuuuugccugauauaguuuaauaccuuaucuuucugcaucaaaaauuuuuguuguuuuauuuucaugguggcuuuugccguuuaucaauaugaaguguuucucuuuauaugcauuaaugccuuuagccauaaauucuaucuacauuaugauacuggcauugucacuauuacucucuuuuugcuaauguuuguucuuuauguuaugggccauuccuuugucuccauaauuuguagucauuuugcuuugcauuugucuucuauuauaaauauaaugcagcagaguuuuaaaaaaaaucgaagaaucuauuucuuuauaugagaauuuagcccauucacauuauuaugacaauuuaugcuuuugguuuuauuucugccaucucauguuuccuauuuauuaugcuuauauuuuucuuuuuuucuucuucuccugacuuugcuagauugauugaauuuauuugcucacucugacuucuacugauauucuacaaguacuugcccucaaguacaaauauuuaauaauuauauuaacacuauauuacuguauguauaaaaauuaauaacuguagcuuuuccccaagaauaagguaagucuuccagcaugcuuuaucucacucacuuccuguuccagggcugcuguguugguggccagguuguauucccccaagcccuguaggugccauuccuggacuucagcugggagcucaaagauguggcccugauuucccuaaucaaguugaaauccugggauuucaguugcagauucuuuucuuucuguuucccucccuccuuuccauuuugugaauuuguacaauucaguacauuucauagucacauuauuagcaagcauuuagauuucaucauaaauuuuacuugcugcuuuccuugaagcucuuuccccuauuuucaucaugccuuucuuuuacuuguuuuucaauuugcuggaguauccucaagucauucuuuagaagccgacuuggacauugugccccgcgucauacacuugucccuccagucccacucuccucuucucccuacucugguucugggggcugaucuauguggaguacaucccuccccaguccccucaguccuggagccauugcacagccccuugggguguccuuacacacacccacacguauguagacagucccuuuauagacuguccucaaauuacucuaauuggaauguggcuugcaucuccugcugcaaaucugacacugacccuucaucacagaaaccucacuuuacugacgugaaaucuauguaacguaauguccauuuccucucagucacucaugucaguauaguguuuucuuucuuaguuuucaucuaguugugaacaaacagaauguacaauuuugaguacacaguaauuaucagguucgcacguaaggugcugagagugaaugaggaagccugugggccaggaccuaaaggugcuggguccuucagggagcccuuaggguugggaaagaauucagccuccucagacuuuucagagaaagaaucaucauuggucccacugagugcuggggggcagcucagugcuggggagcagggaaggucggggguguugggagugaagggaaccuaccugggucccuaggguugaggcuggcuaacagucuguuucuggcuggauugucucugguucugcuuuccaugucucuaaaagugcaggccccuugguggcaccagaagacugugaggacaauaacagaacccugccaggguuuugugagugucaauucauaaccuucaacagguuguuaaaggagaccuugagacagucgucauagugugcauuugaacauauacaugucaaguaacugauuuuaagaaagaccucagaacuaugugacugaggcugggcacgguggcucaugccuguaauccuagcgcuuugggaggcugaggcgggcagauugccugagcuuaggaguucaaaaccaaccugggcaacauggcaaaacccugucucuacuaaaaauacaaaaacuuagccaggcguggugggguccaccuguagucccagcuacucaggaggcuaaggcaugagaauugcuugaacccgggaggcagaggcugcagugagcugagaucgugccacugaacucuggccugggugacagagcaagacucugucucaaaaaaaaaaaaaaaaaaaaaaaaagaacuaugugaacuugaauauuuuccuucgaaucuuguaauucuucucuccagggccugggacguaagaagaucucuccagauaagaggcaacauguuucaagaaauuuuaaucucugggcaugugacuauguuccaucuugucuugauggcuuuucaaauaaccaaauaucauacguauauaaagaagccaugguggucucaagcuucagacgcuuuccacgaugcuauaaagagauauggaacgcuuuuacauuucuuccugagagaagcuauacagagguuuugaaaaagaagcccaaaguaagguucacuguugacaaaaagguuguuucuucacuggaguccuaauccucccagaagauuuuugaugaauuuuguaauacugguauuucaucagacauccuaaaaguauauguuuucugauccagcaccacuauuuaauuuuuaaaguacuuuuaugauuuuuauaaggucaaaaaacauucaaauccuugugaaaugaauuugugaugacauacgcauguguaaauaaacuuuucagauggccacauuuacuuuuggggaguuuuaaaaaguacauccuuaauauacggucacauuuucauuuugaaauuuca

SEQ ID NO: 15443 - RNA, 45912 nt, Homo sapiens
acuucuuccuggcagagaccggaagugcgguccgcggagcgucucuggcgcuuacccugcuuugggccugcguugcugcugcugcuccuccgcucccccgucguaucgccugcccuggaucgaagugaugggggaugccaaggaggccggagccgaggguccgccggccggggccgccgcucgaggagggcucagccuccugucccagggagaauccgaggaaucuucugcacaggugaguccuccgcggagggggaccugccagggaugugggagcggaggacccgcuccaccggggagggaugccacgguucccggcagauucuggaggcuucuccauguuucccugacacccccaaaacagggaguugaaguccaugcuccagucggcagguauucguauuaaaagcaguucugguagccgacaggugaauuagauacgaucuuuccucucaaggaggguacauguaaauaugucguuccaaaacguggcacagucgugcaaagcaggagggaagaaacggugccagguagugacucgccgagaaugagaccgaacuaauucacaaaggguguaaaauguuugccaugcagaagagguacugcgugaaagguuagaauauugaacccagacgccgaacuugcuuugggagugugcaagugcaggcugugaggaacgaacccccaaugccuuucuaugaaguuagagacucaagaguauuugaaccaugcaugcaugcaugaaccgaugcaucgauuacuaaauauuugcauuaaaacaaaaagcccaaauguucuaccagacuauuuuaugaaugauguguuauuaaaauuaaaauacaucuuuggccgggcgcgguggcucacgccuguaauccuagcacuuugggaggccgagguggguggaucaccugaggucggggaguucgagaccagccuggccaacauggcaaaacccugucucuacuaaaaauacaaaaauuagccggacgugguagugcacgccuguaauuccagcuacuagggaggcugaggcaggagaauggcguaaaccccagaagccgagguugcagugagccaugauugcuccacugcacccuagccugggcgacaaagcaagacugcgucucaaaaaaaaaaaaaaaaagaauuaaaauacaucuuuaauacugaaaauaggcuuuacuaaaguuugcaucuaguuaacaugauaccauugagucuccuugguuucugcuucuccacuuuacaugaauacauuuuaaaagagaugugggugguccauuuucuagcugauaaccauaaccaucauacuccuugacucaucuuuuuucuuugaaguugguguaaaagaacuaaguaaauguuaccauuuaugcucaaauuuauuaagugcuguuaguaacauguggcauacguuccuugugaagccuggugugacagguucuuguuuucuuuuuauaaaggugagauuuuucguucuuaguaauuuucauuaaaguuucacccaauguguuaauuagggaucagcuuuauuucuuggaggcaaugaagugaagagccgagcuguggugaaauacucuucugccccuccucgaacagcauuugcacgccuugaagagaaaacagacuugaaacucccaccugccaacugguuacgagagagugccaaacuagggccagcaggaacuaccauucuuggcaacagcaagaaaagcaagccauuuucaagguaaauauuaaucaguggcauuuuuaccugccccuccacccucacuuaaaacucuuauuugcuuuuaaauucaguuuguaaugccuauuaacuugucgagauuucucuuuagagaaagaucacauuugauuuucaaaggcuuuuuauucugauaauagaugauguuaaaacaugaagauauacauacaauaucaauugcauaugcuucuuuuaagucuacgucauguuaucagcaaagaugaguuuugacugccaaaguucaaucagcccuuucauuuuagccaauuugcauaccuuuuggauaugugaauacaaaggaucagcuuggugcaugaggaggaaaaccuugaacauuccuucaucuuuccuguggaguuuuucauuaaaugguggcagguugaucuggaaaagccagauuuaaaaacccagcauguugggugaccuacaccuugacuuugacaccagaacugaugguguucaaaguugagagaguagccugaggucuuauagagaaaaauguauuaauguacauacuguaggacauuuaauguguaggguucucuuuucuucuucccccuucucagcaacucaaucuaaaauauuuccauguaacuuguagcaagaggcacaaauacacuaauacuuuaugagcugguauuuuggaaauuauccuaaagccucagaaaauaaaaguuauauuugcaaaaaugcuguuuguuuguagcaucauuuauaggagcaaaaaguugggaauaacccaaauaucauuuuuuaaaagaauggcuuaaucaguugugauuugucaacauaauuaaauguugugaggaaauuugaauaauuauauugacucuauacaaaugcuguggcaaguauuuauaugcuuaucucauuuaauucucacaacaacucuuugagauaggcacuguuaauuauauugcaccugagaaaacggaagcugagaagagcuaaauaauuuggcucaagcauacaguaaaucacaaagcaugcuuugcuguuagguaguccuugguaaguguccugacucugccauuuaguaguuggaacauggugaugucggguaccuuucaggcuuauagacuauagaugugcuucaggugguacguggcaucaguuggcugcucaauuaacauuuuuuuuuaauuuccuuuuguggcugaauuggugucagguacauuuuuuucauguauuuuuuuaagagguauuguauaucacuagaaacacaaucucagaaaguaaaauccugauaaauguuucuguuucuguuuuucuuaucucuccaccuaaaaagaauaaaguuuugaacuauuuucccuuggagacuuugaguuuugugauuacaaaaauaaagaauaauuguuuuuauucuaaauauuuccuacuggaugcuucuaaugauuauuaccauguuuuaucaaaucuaagaugccauugacuuuaagacacaccauuauuuuaguaccacuaagaaaaaaaaacuugccaacugugauggugauacacauccugguuucagaguuguuaaaauguggaaaauguguauccuagaagcaaugagcuacaguauuguuauuaagcucuacuugcaugauuaugagcaugaccucauaaccuguguccuuuuuucucuuugguagcuuuggcauggcauaugacuuuauugauucagugggaaaugauguggauguugucucugacucugaaguaaguguuauuugucgcuuaauguaauuuuggagguguuuugugauagguguuuuauaucaugcuguguuuugcauaauauaaaugugcaagucuugagaaauuagugaugaaauaagauaaaacuuaccugauuauugaguaucuuuuuuguuguuaaaguaucauuguuuaccacauuuguauuuaaagaggaaggaauaaucaauccccaaacacuggcagugguaauaauauauugaugguuauauuuuaaugauaguaauugaaacugauaauaguguuugggauuauucuguauauguuaccaguugaguuacaaaugauauuucuaguaaaaucuauuggauccuuaguggcuuugaucugauaugcuaaaagccugggucagcauaacagugugacguauacacccuuaacuuuaagaaauccuaucauguaaaaauaaauguuugacugucacuaacauaaugugacucauaaaguguacgugauucugguuugaaagcuccguccucuguguguuugcauguagcuuuuuguuuaaaguucuauuuguauaaccuuaaggaaauaagguuuauuaugcuuuaaaaugaaugaagcuaaaauuuaaaagauuccaaaucacacuaaaacagucuuucuaaacuauuuuuucucuuaauuuuuuaagaacauaaaaaaacuccugaaaauucccuacagcaagucgcacgugagcauggcaguacaccgcauaggaaggacucucuuacuagaugagcuagauauucaagaacucuuuaugagaucgucucagguaaugcuuuugugaaaaaauccaacaaaacauuaacagcuuaagagcacuagaaauacgauuuuguuucagagaauggccaaaguggaaauguaguugaguacuucaacaaucgagaaauugaaaguuucacugaagauagaaaagcuugaaugaagaaaaaagaagagaaugagaauggugaagaaaauuauuuuauugauuccaacagccagauucuuuuuuacaagaaaaaagaugaagccaaugaagaaaguugugaaaaaaacugugaaauuuaagggacuaguuuaauauuuuuaagaauccuuuaacgucucccuuaaacagauucucaggaaacacagcuacuggaaaaugugaaaaauauuagaagcuguuccuaugaauaaauacagucauguucccauaaugacguuucagucagcgauggacugcauauaccgguggucccauaagauuauaauauacuguauuuuuacuguauuugcaguguucagauacacaaauacuucagucacauguacagauuuguagccugggagcaauaggcuauaccguaugaccuagguagggaguaggcuguaccauccagguuucuauaaguaacacucugcgauguucacaccaggacaaaaucaccuaaugacgcgcuucucagaauauauccccauuguuaaaugacacauggcuguaguuauuagaauuaauugaugcucuuuagccuagauucucaaauuguauguugguaaggacuguuuuucccacauguugagaauggauacuuuugaaaaacauaauaacauuguugcaguuucucaagaacuacccuccauaucuguacuuuucuugggcuggcaagaaauaguucauggucagucuuuaaagaauauuacuacagugcuuugauaaagaaaauuaaauuauggugagguaaaugacauuuaaaauaagugcuuuuuuccuuugaaaagaccaccguuuaguucaucaugugaguaugagccuaggcacggggaugugacagugaacaaaucacaggccuugcuccucagcaguucauuguuugggguuauaaacacauacacagaucauuucaauauagugugcaaagugggaacuacugcagcugcuaaggaacauguuauagagaagacucaccucucccagccuggcuuaggaggaggaagacggguuuccuuuaggaaacaaaaaacaaaagaaaggugguaugaauugacccagaaagauauguuuuuaaugaguauguguuuaugaaacuauucaaaaaauaauaggagccuuuucuguaagcuaguacuagguaacauuguuucgacuauguguguuguauuaauaauauguaucucauguuauccagacuggugacuggacaugguugaaagaguuuuaucaaagacucauugaucagaaguggcagaggaagaaaaagagcaaagagcacugguaucaaaaggcaauucuuuccaaguuuuuauauuacagguacuuggcuacuuauuuaucucuaaagagaaaaagggaauucugaucuaaaauuuagugugaagcuuaaugaaguuauaauuuaaguuuugccccugugauacuguuaacauuuguuucauauuucuuuuuuacaagauguaugcuuaauuacagauuguaguuuuuauaaacggguagacuguugcaugaaguuaacuuuaguaacagcaauccuuuuuuauuucugguuuggccaguaucaauggugauggagccgcucagccugucucauccaccgcagaacagcaggaaucguccaguucagaucagacaaaugauucggaaggggcuucauggccugcucccuucgaaaugccuucuucaguuucugaagaucccagugcuuccagucagguuaguacuuaaaugcuaauucuagaaacucacauaggaaaacaaagccuuuuuuaacaucucguuaaaaaaaaaaaaagaugaacaggacuaagaaauauucugucagcuuauggaaugggggaaaaaagacuucugucaauuuauggaauuggagaaauacuuuuuaguuuuucgcaauagaauuuacaagagcuauuauagguggggagaucagauuuuuuuauuaaaucgaaauauaauaguugacugauauguuuauuaauacugauuaucuccuucaagugaugaguauuauauagagauauaguauauuuuaauuauaaauacuagucauuuuuaacuauaaauacuauuuuaacuauaaauaucugucaauauuugauagacauuuccuaccaaauauugagacucagagacccauuuguaauuuaaguucuaaccuuuuuaccauaacuuucagucagauuguuagaccuaaaauaucccuuuaagguuuuccagauaaaauuccugaaacuuaguccacauucauguuauaaaaguuuuagaaaagagaaugaacuagguuguccauuuuaucucuuacauccuuguuucuuccuaaugcuuguuuauuuuuguacuuacuguaucuaucaaagaauaaaauaaagccauagauguaaauugugacaugucuauuuucaggaaaauagauugauaaauagauaauaagaucugugacuugauaaguuacgucuucccucuugcuguuguguucccacauauugagcacuauucaaccagauuguuucaaucuucacaaauuacagggagcagauacauuuaacucgauuuuaguuucaguagguuuaagauagagaaagcaucccauaaaacuccauaaugaauuuaaauuucuuucaaaagugagaaaaauguaaggaaaaggaaguaauuaauaugcaagucacauagugguaacaaccaagaaguagggauguucuaugauucagaagggagaaaagacuacauaauacaaauacuacccuccuauuacccaugucacccaucucccaguguuguucugucuuuaccuuguuuaggaauuacugugaaaacucuuggagagucgggaaucuguagacuugcguguugaggaagcaagcuggcauuuacugaauagcucuuaugccauguguauguuuguacaagguuuuuuuuuucauucuuggagcugcguauuguacaaauaaguaaacuaacgcucaucaaaagauguuucacauggucauacagcuggcgaaacucucaggcuagggcuuaaacccagaucuuucugccugcagaggccuguuccuccagcaguacuccacuguguccguguacuccacacacagcaaggcccuacuaacagucagaucaucguaguagugguguaucccuaggcacagcuagccugccuuaagagucucuuacagaguacuuuucuuauauugcuuaaauuucagcuuuagagauuuguuuauauuugcaagcuaucucugcacaaauucuuguuccaaaaacuaaaacugcuggcuugaggccuuuguuaagcaguuauagagguuaaauaggugacugugggaugguccuagagccagacauuuauugagaacguuguaaccuagagcucauacucugacuaaagcaacugccuggcaaacuguuuugagaaucgguucaugaguugauaacuugucuguguaaacaaauaauaaaauaaaaaagaguuuaaaguucucuuaggacuccugagggagaggacaaggcacaauagaagugcuagagagccaccugugcuuauagucacacacucuucccaagcaggugccaagccuacuggcacacacagaugacaaguaagacagauguuuguggaauaagcaacacacgcaugccugucuuggguucuguugaggcaaugacauuaaaagcuuaaaguaguauuucuuaauggcaguacuacuuuccuaaugauuggaaaauugagugguaggcugaguuuacccagugucaagagggcccaaguguauuccaaaaugcauuccaggcugggcgcaguggcuuaugccuguaaucccagcacuuugggaggccgagguggguggaucacuugaggcccggaguuagagaccagccuggccaacauggcgaaaccccaucucuauuuaaaaaaagaaaaaaaaauuagccgggcaugguggcacgugccuguaaucccagcuacucgggaggcugagguaggagaauugcuugaacccaggaggcggagguugcagugagcugagaucaugucacugcacucuggccugggcaacucugucucaaaaaaaaaaaaaaaaguauuccagagaauaucuuaagaacaaaaaguguucugagauuaaauacauuugggaaacauugguuuuuacaaagauaaaguagauuuuucuauugcaggauuacuuauuauauauuuauuguuuuaauaucaauaaauauuguuacuccacaaaagugaguaccugguaaacgucaucuuucaaaccugacucuggaaaauuuucauucaguuucccaggaacuaguguucugugaaacacucaucaggaaaugcuaaacuggagacuguuaagauaaugaguaucucaaacuguggcugaguaagauuucuuaggguuucuuuuuuuuaagagacagacucucauuauguuguccaggcuggauucgaacuccugggcucaagcaguucuccccugucgaccucccacauagcuuggacuacaagcacaugccaucgugccuggccaguuucuuaggaauuuuuaaauucaauauagauagaguaggcugaaagagcagugguaaucagaugcaccaaaaaagagaaaaaugaaaaacuuagaaaguuuagaauaaucuuuaaucuaucucucuugaguaagaucuaaaugugauucgcuucuuauaguagcuaugaucauuagccaaagcaagccacccaaugaggcguguuauuauuuguauuggccuaauaauucacaaugguagauuugaagugugugcuuugaauauuuaggugauacucucaaaagugggucaauuuuaagaaauguugacagcagaaucacuccuuauccuugcacuuuucacagggaagugagccucuugaacccucauacauaguggggcauguggccucagcccccaaagaacaaaaccugauuacuuuauucaaugacggggagcacagucagguaugcuuuccaugguguccaaggugacagcaaauccccagucuacuuugucauuucaaaacuagccuaagucgaaauugauagggaaaaacuccacuugauccugaaacugcuuucuaagcaucuuugugaucuuagcucuggggccugacuuugucuucuuugucucuuccuuuuucuagucuuuuuauggaucauggggggaaauuacagauugacuguuuauuauaauccucccuauuuuaaaucacagggucuuaaaaaugauuuuguucggaauauucuauggacauuugaagauauccauauguuggucggcuccaacaugcccauauuuggaggaggcagauacccagcagucagcuuacgucucaggugaacuaacaucauaccccuccucaagcuuaugguauuuaaauucuuccuuuagaaucaguguuccaucagacugagguugcagugagccaagaucaugcuaccgcacuccagccuaggcgaaagagcaagacucgucucaaaaaagaaucaguguuccaucuauuugggcaucuuccucuuucucuagguuuuuuccccucccuccuuccccugccaguugaaauggccacauuaaggaaggagcuacugucagcagaugcugaaaggcaggccuauagcugagucuucauucuagaccucauugaauagagccagagguuuguuggacuggccuagucuuaggucugaaucuacaacuugugagaauauucaagagaguuuauuuaauuaguuagauuccuacuaacuacuugugagcauuuuucuuaaugcuccacguguauuuguugauauuagccaaugugaauuccaacuuaagcauggucuuguaugguguucagucuuucuucaaguugugugugaggagcaggcaguaggcucaccguccuuuccuauuauauugucuucuauucuuacugaaaacuuaccaaugucaguuagaaauacaagcaagcuuuuggaaagauguuaaauauagcacaaccacugagcugcaugugcauaucuuaucagaaaagaaagcauagauggcauuuucuaucuagagaggacagcuuaagauacuuaaauggugaaauaacuuucagaugauuaauuaaggaacaucuuaauuaaaccaaauaacacuagaaauguauauuuuuagggauaacaacaaaccaauuaaugugcuaacuggaauugacuauugguuggacaacuugauaugcaaugugccagagcuugugauguguuuucauguaaauggaauuguacagguaagauacagugugauuuuucugaucucucaaaugcaaauugguacagagaguuccucaccaaagucuuuacggcccugaaguacuaaggugcauuuuugccagggaagauagcugugaauaaacugaauuugaguguacauuuaaguuggugauaacagaauuguagauguuauagaaguauaauuuuacagguaauuuggaggaaguucauaaauauaugaaaaccugcauuuguagccauagaacucuaauuuuaaugccaagcucucauuaauaauuaacugaaagugucuacacaauggaggcguuucuucguuaugcaaauaucuacucaguacaugcaaaguuuuagggaaaggucuuguaaaaauugcauaugguggauagcuuauauagcaaauucuuauugagcauauucuguuuagaagacacguauccccauuauaaguguugggggaagcuaggcguguuggcuuauuccuguaaucccaagcuacucaggagacugaggcagcaggaucacuugaagccgagaguucaagaccaaccugggcaacguagugagacccuaauuguagaaaaacaacgcacacacuuaguugggcauggugguacaugucuguagucccagcuacuugggggcuugaagcaggaggaucacuugagcccaggaguuugaggcugcagugagcuaugaucgugccacugcacuccaguaugagugacagagcaagacccugucucaaaaaaauaaaaaaauugagaauuuaaacaauaaauaauuguugaaggaaaacaaagaauaagcuugguuguuauucagaaagagauaaucuaaugggaaauaauaugcagagagaacaguaggagacagauaagaauuagaaguguagcacacagaaaucuagaucaucagagaagggggugagcacuuccauucaggucuggaggaaagacuuuguggaagaagggacaucuuaacugaguccugaaugauagcuaguaucucaaaaaauaagagcuggauuuuaaaagucuaguguaaauacaugaaaggauugauaauaaauccagcuagggaacacaggauuuauguagcagaauagcugcaaguaagguuggaaaagucauggucaaaugauggagaucuuaaauguugagcuaaggaguauggacuugguucaguugguaaucuggaaucagaaggcuuugcaucuaggaggggaaauuuguuguguuagaauauuaauuuagagauagcauauaggacagaaaaggaggacuuagagacaagaaaaccagaggcauuguaccauuuugcagauaguguaauguacuuuccacuagagaggaacuauuaagaaucaacaaugguaagaauagauagcauuuauugagugcuuauuuuauccaagcacuuugcugaaugcuuuaaaugcuuuaccuuauuugaucuucuuagcuaccucacaugcuguuauuccuauuugauggaaagagagacugaggaucaaggagcucaagugaguugcccagggucaacuuaguagugaguggcggugccagucuuugugccucucucuggcugaggacaugcuuugaaccguuauauuccaacccagugauucuuaaccugguugugcaucagaaucacuuguggucucugaaaaaaugcacuugcuugggcccccaguguucuaguaucaguaggauguguacuucugucuuuucugaaagucugcuguaugauucugguuugcagucuugauugaaaaccacuguuagaccaucucccuaaauggcaacauuuagugagaggcuggggugggaguggggagcaagagaaaagagagaggcagauaaagcguuagcaaggcggaggggaacaggagucaaaggagauuccaggguuuagggacuagaauaaugguggugccauuuagugagauaaggauguugaauugguuuagacagggaagguaauauguuuuugucacauguucaguuugaggaaaguauaaaaaugucuagugagcauuuugaaguugcagccauuagagaaauaaauugaagcaucaucugccuagauacugucagauuucaucaccagaggaaucuauuaaaaucagacauuggagccucuccucauagggguaaaaauagaagggcauuuagagagagagaaggagaacaagaauagcacagauuaaaauacaggaaaggagcauuuuaaggaaggaaauaaucaacauuggggacuucacaugaacaaaguggggugaaaaucaaccucagacgauuguguuuggucuuacauuccaguugauuugaaguuuccaguuuuagaguacuucagaaaaugugguaggagaugguuaggagagugugcacagaagauaaacaagaaaaaugcaaaggcacuuuuaaaauagugguaguaauguccaugaagccuuuacucuuauugccaccuccauuccccccugcuccaucccugugaaguaauaaaguccauagaugaagggaagagaggugucuacuggaaaauuuccuaaaugauucucucuccuugagucacugacuguaguuucuagcaaaaaaaaaggccagaaauacauguguuuuaaaaucuugcuggguaaagccuaccuucauuuaccaucuucccaguugaaaaccauucaaguggaauaaaaguagucaguaugauuuguuccauguuagaacagaaauaagaucaugccugaaucugagguucuaaaucugguagugauucuccauugaaauuacuccaauagugaacugcccuugcugaugggguggaugagauuccuuugggaggcuggggcagaaaaaagauuaaaaaccacugguuuaaacacuuucaugcuacauaggucucuguuugcaggacuucugcauuugguugcuuuuuaaaaagaaagguguuguuuccuuggguuuucucuuaaacugcuuuccaucugucuguauuuuacagaaauaugaaaugauaaagacagaagaaauucccaauuuggaaaauucuaauuuuucuacuaaagucauaaaagacauugcacagaauauuuuaucauuuuugaaaucuaauuguaccaaagaaggacauaccuauuggcucuuuaaagguaagcuauuaauacuucuugagugaacaauaauugauuuggguaacugcugugaaaugagucuucuuuguuuuucuuuucagcaaguggcagcgauauagugaagcucuaugaccucacuacucuuugugaagaaacugaagacaaauaccaaaauccauucacaaugccgguagccauucucuuguacaagugagugcuuuaagaauuuaagaugaagaaguagccuauuauauaaaguuuuaaagcauacagucacaguuuccaaaccaaggcuuuuaaaugcuuuuagguuuucauaguagggggaaaaauacacguacacauuguaccaaauauuacucagcuuucuuaugccaccauaguauaaacguuuuggggguuguggguaaaguguaaaguuuaguauuuuguuguuucuuauagcucuuuguuggaaagaaacaagagcacuccuagacuugagucuugcagacaacgaugaaaugggcaguaaaguugauauaaacucuuuuuuuaggguugcuugcaacaugaugaugaagaagaaucaaaauaagaaacacuauggaacuauuagaacauugcuucuuaauugucugaaauuacuggacaaaaguaggcauccucaaguaagauuaacauuuauguauucucuaaaacaauccuagcauucuaauaggagauuguuaccuagacaguaaagccuccugauucauauuccguaacugcccuauucagugugguagccauuagcacauguggcuguugaucacuuaaaaugugcuuugucugaauugacaugugcuguaaguguaaaauacacacugaauuuugaagauuggaugucuguaccuauuacauguugaaaugcaauauuacauauauuggauuaaauauauuuaaguugauuucacagauucuacuuuuuaaauguagcuacuagaaaauuuaaaauuucuguaugugacucauguuacauuucucucagacagcacugcucaaugaauuuagaauucauguaauucuaacaguagugcccuuaguucuuuguuuugucgcuauuagaccuuguuaccacuuuguuaauauaaauaggguucacauuccacacuucaggauauuaaagcaucucuuaaauaaaggccaguaaaauuucuuuuaaagagaaggggaaaaagcaucucuuaaaauauucccucagucaugcucccaacaguuuuacaccauccuuacccucgguugucugauugacaacuuuauuuuucacuguuaaggcuauuuguuguauccuguucaaaucaguaaagguauguaagauacgcaauuuuucuuugaagagccaaaguaauuuuaauuguagccacauuugauuuagagauaaagauuauccuagagaccaaacucagaaauguuuuugaagaaaaauaguaaaacauuuuguuucugacugaaauaccuaauugcugacugagguggcaguguuuaguggaacuugagugguuuauuuggauguuagaaaugguguuaaagacuauugucugugauuaagaacugauaaauaguagaauggguuaaauggucauauauaaaugcuaauuuuaagagauaucagaauggacuuuucccuuuuuaauguaaugguuuuuuuuuucuagaaccauagauuauaugauaaauauuaguuaccuauuauagagaaacuugaauuaauuuauaguuuguaaagaaaaauucugguuucucacuuggcauagggugguauuaaauuuuuguuaauauuuuaguuaugacacucuguacucaaaagcuuuuguuugucuccagugaaauucaguugacaccuuuuaagagggagggcucaggguggaguaauuucgggaaauaggaaaugcaucagccuauaaagauuuugcagagcauacccagaguaucaguagcuuugaacugggaacauuucuguguguguuacagucuauaugguggaaacagccugugugcagaccuccuccuaaaauucguuaguaugguaguaaaauucauguauuuuuugaugacaguaauuuacacauauuucucucuuuuucauaagauuauugcuuccgccaauuacaugcuuucagaacuuuuucaauuggaugaaccuaaaaaggaagaaaauucagaaucuccuuuaaaugagaauucugaugaaaguuauagugaagaggaggaagagaugcccgacagugaugaaaauggauccuauagcaccagcucugauccaucagaugauagcaaagcaguagcuauaaucaagucuguuggagaacuaucaguaccagaaaaauacaaaucuauucaucaaaucagaguaagccuuuagaauuuauauuaaauuuuuaucaaggaaacauaauuguuaaucgaauauaguuagccuuucaaaagauaccauuacuucaauaaaccuuucauggucuagcaucuaguaaucauuaguuuucugaauucuuaaaguugguuuuauaauuguucgaggguaacugacccacauuaugcaagccuauaguggacagguguguaaaccaggugucugucuauucuuaugugaaggauuuuccuuuccagugaccaguguguagucauagucaugucucauuacuagggcacuucuauccgguguugggguugcugggaaaugacauauauagauugcuuggugaacauagaguagagaaggggguggcucuuggaacuguauauggugagcucugguacauuaucccugugcuauauaggacaguacuuuuuucgugacucuuguggucaugucuguuguauuggacaugucucugcccuggagagggccagacagauuucucccuguguggauugcacugacucuaccaucaguguaucuccaggcaguauauaccuuucaacauaccgucucccuaugauuagauccaggccagccuuaagaguucuggcuguucccugaacugaaauacagucguauuuacagauaaucucuuaauuuaagcacugaguguaacuuucagauggaaacucuaagcaaguuuuugaggggcuaugucugucaccuuaaaacauugaccaucuuucugaccuucacuugcuccauugguuugccguggccaugcuggguuuuuuuucucucaaaagcaucaagauuaugcucauuggagggucuuuguauuugcuguugcuucugcuuggaauguaccuacccuaggucuguucauggcugccuuuuuuaaggcuuaagucuugacugaaauguugccucuucagggagauguucccugaccacucuggccaaagcaugcucuacuuuuuuguccuucaaggagccuaucuguuccugaaguucuuaauguuugucuugcuucacuagaacguaagcucccugcagguacagacccucuaucucccaugucuagaacacauuaugggugcucaguaaauauuugacuaaaugacugcaggaaaaagucauuaacuguccaucuaaauuuuaguucacuuucagcuugaacuuccacaguggagugaaaaaauguucugguuauaaucauugauugcaaaaguuacauguaucuggaaaacugcauuguaacacuaggccauggacuuacggggcaauuagguaauaauuaaagauguaaugaguuagugucacuauuuuucacagauagcacuuucuguuccguaucugaagcacucaaaaaaugcagucuuaguauucauauaaacaugucuuuaguuagccuuuccuuauccucauugaaugacuuugugguauggacagucagcaugagcuccagggucccagcuccccacucacucaccguguccucagacaaauugcuaaacugucugugcaugcuucucuucugugcaaugagaacaguaauuccaaccccacgggauucagcgaaaugaaaugcuucacagaagccccuacacauaauauccuucauaguuggagguugcuagcugcuuuugcuccuuaauuaagcaaauaaauuaaacaacgagaauauuggugauacuuguuauuucuaaauugacgcuaauuguuaauuguguuuuguccaguaucggugcuaauuaugaguggagcugaccuauuagaugaugucuauauuugucuaaaacauuacuacucuaguucuugcuuuuuugucauaauagaauuguauuuaaaauuguaaguacuuaaagcaacauauauguuguaggaucuuuuuaagcaagauuuuuguugauaaugcuuacaguaauuuaaucuucaacaaaaacaauauguugaccuuaauacauugguaguguauuaauaauuuuauguuuguuccucaagcccaguugugcauuuccaguuugccaugacacagaagagcgcuguagacuugugcuuagcuauguucuagagguaaguuuaaguuuagucuucacuuuuuucguaaaguuuguacuugauuaugcaaauuacacuuguuuguugguaucuaaauguuauucugaauuguguucugcugcgauuuuuuuuuccuuaagcauaaagugaaaaucagauuuguuuuucccaaaucuuucagaucaaacauaguuuuugaaagucuguuugugagauggaaauuuuccuaaacguauucaguaguccagauacugucuuauauuuaguuuucaguugaccugaaguuagauagauagugaaugcuuuuccuuuuuuugcaggguuuaaaaucugucgauagcagcaucaaaaaagaaagcgaccuuccagcagcugaccccagcacuccaaucccguuaaaauaugaagaugaauccucaagagggggucccgaggggcuagagaagcagauggccuuguuuuuggacaaaaguaaguugaauugaugugcaaauaaggccuucaauagaauaauacacugguucuuuaucaacagcagacuuaugucaauuaaggcauuaauugaaaggcauugagaaaaagauauccugugaacuggaauuagggguaguauucuuucauuugaaauauaaaaaggauaauuuugauguuucauggacauuucuaauaagagcauaaggagccugcaucuuccuguuacccacaguggggaacuaaugcuucagccugguggaguucucgcuggaucguguaggagccacagacuuagccagacugccuaacuucauaucuuggcuuugcgagggcaaguugcuccacuucuuugagucacuuuuuaucucuuucaaaauggagacgauaauaaugguuucuuuaaaggguuguuaaaugauuaaaugauuaauauauguaaagugcucagaacaguguacauaauaagcacuauagaaguguaggcuguuguuacugcacaguacuugaauaagcuacaaaugucacuuuuaaauuaucuaguucuucaggaauauaacaucaugaagaauauauggacuucgaagcagaaguugugaauuucuuauuuuaaccuaaguuguauuucuuuuuccaaccuuauuucuuucccccuuuuaaaucaguuucaauuguuuaaaaaaaaaaaaaguguagaaagccuguauguuugaaguacaucugaaucauaguggaagcgcuuucuggacccuucuucuuuuccugaacaaacaugguggagguaggagaggaauagauuuauuuccccagcauuuauauagugcugcugguaugccaggcuucggccuacaggcaguaaggagaucacaccaggacuuuugccauucuuuuuuucugaaaugccuuuucugucuccuucuccaucuccccuguugaaaauccugcucaagcucagaaucuccauguuucccucuguucuccaucagaauuacuugauucucuuaccacuuuguccugugagccugccuuaugucagaguuccagcauuaaaugguuuuacacacacaugcacacacacgguugugaacaagaacuucaucuuaauuuuaguuucucacaaugccucuuacucacagaugaugcuuauaucagcagaggaaaaaaauccauacacacauuaaaccauaaugaagacuaaguaccuuucauugccuugaaagacuuguguucuagcugauuaaaaaaugagaaaccuucaggcugggggaagggguggguguuuuuguuauuugcagagcaaaauuuuccacaguauuuuguucuuugucuguuaauuacacuuaacauauuuuguugugguuuauguuaucaaggauagaggccauauaacuucaugucacaguuuccagugccuggcacaguacuuggcagaaaaaugaucauuuguugaguaaagaagguagcgaugggcuggacuuuaaauaaagaguauuccuuguagaggaaacaguaaacuaagaugggagauaggaaaaacaggcauguuuauaggugacaagcaguaacuuaacauuggcugauggguaguaggauggacaaguaggaagugagacugagaaacaugcaacuagcuaaguggggagaagccguuuucauguuugaggacaggcuuucacgcugaucuaagcugugcuuuaggaagguaaacuuugacagguugacacauagacuggaaaaaggagacaggugucacucaugagguuagcuaugucagugacacuggaagagaaugacagaguugccgaugucagggaagcagaaggccuuagaacucccaagugagagucuuuuaacacggccauuucacuccaguguauuuaagcaguaaagcauaguauuuaccagucuugucaccuaagucuagaguguuuccaucaagaaacagaaaauauuuuuugugcaugagacuuacagucaaaugaaaugugcugucuuuuuuuuucucuccaugucacagugggcucccuucagaagggcaauuauuccagucaaucuggaaugaucccuggcucuuggcaacauaaaaugaaacuucagcugauucucaagucaucaaaggccuauuauguuuuguccgaugcugccaugagucuucagaaauacggaagagcauuacgauacauuaaauuagcuuugcaaagccaugguaagccacuauaaaugaauauguuuaauaggcacugggaagagagaacagagaaggcaucugaaucacaguggaaguuuacuccuauuuuucuaguaaaucuuuauuuuaaaaugacuguuuccaauccuguguguguuaccuucuauuuuaguuucugcucagugguuuaacaucucuuugcuuugaacuacaugaagccguaauauguauuguuggaccuaaaauaaacagaauagauacagugcuacaaagcguucagcugguaacacaguuucuucauauuuccuaugaucauuaauuuuuuucugcauuuguguuuuuucuucuucccucccuuucuaaacagauacuuauugcugccucugcaccaauaugcuuuccgaagugcuguuguuucucucucaauauuugacacuuuguggugauauccaacuaaugcuggcccagaaugcaaauaauagagcagcacaccuugaagaguuucauuaccaaacaaaagaagaccaggagauccugcauagccuucacagagaguccaguugccaaggugugccacaggcuuggaccacgugguucacagugggacugugcagucuagcucaugcuuauuugaguauucagaaaagggguagaaauauuagaguuuugauauuugcucuguauuuauuuauuuauuuuuugagacggaguuucgcucuuguugcccaagcuggagugcaauggugcaaucuuggcucacugaaaccuccgccucccggguucaagcaauucuccugccucagccucccaaguagcuggaauuacaggcaugcgccaccaugcccggcuagcccaccuuggccucccaaggugcugggauuacaggugugagccaccacgccuggccugcuguuuuauucauuuccuaauuuuaagauuaagcaugaucuuguguauuuguauaaaaugguuuuuaaguauuuuauaauuacuguuuauauaacuagaacuaaauauaaaguaagauaugaagacaguugugucaacuuuuuauuuuauuuuauuuauuuauuuuuuugagacacagucucgcucugccacacaggcuggagugcaguggggcagucuuggcucacugcaaccuccaccuccuggguucaagugauccucccaucucagucucccaaguagcugggacuaguacaugcgccaccacaccuagcuaauuuuuguauuuuuguuagagacaggguuucaccacguugccccagacuggucucaaacuccucaacucaagcgauccucccaccuuggccucccaaagugcugggauuacaggcacgagccacugcacccagccuugugucagcuuuuuacacucuucuuuucaugagguucuucuagguaacacuuguagucagcuaacaaagccauagguuuccuuuugaaagguauaacaguuggugaaggagguuaauuaaccuucugaaugauuccuuggggcugaaauaaagugaucauuguuuuuaaaguuaguucauagccaccugucuugcuuaauaugucacucuguuuggaauugucaggcuuuaaaacugggaaguagaauaaucugauccgcagcagcgauaucccucccucuuaccucagcacaguguguaaccacgcugccauuaacacagugaaugaaguaaaagaugagucuucugaaggugcuucuguaaugucucaugggguuguuuuauuaugcucuuaaauuguuauacugaauauuacuugauguuugccucccagaguuuuagacaauucauagcuagaggaguauacugggggagagggaaaaauguguuauuuuguaauaguuuugcccuuucuuccccucucuccgucuuucucaaauaaucauguuuuaauguaguaggaaaguccuugguguauuuuuacuacucccaucauagcaauuucaguuaaauauucuuuuuacucuaguccccacuagauggcauuuuuaaucuucgagggcuucuguagcagccucuucagugacuuaaaguuaauauugggacauuauuucaagaacuauuuccauuaguuaaaaauagcaacuuuacuuuguauuaguggacaacuuuagguccauucuaauaaacaaguguaccugggaaaaccugggucacagaaauuguuugauauucauaggcaggaaaauauuuuuauccaacauuaauaucccaagaaauauaauuuuauaaauaaauagaucuuuauuaugaaacuuaaauauuguuguauugauugaaucuugguauacuuacacuauauugcauuuuuuauuacuuagaauuuagaaucucagguucauuuggauacugaggaagaaggaaucacaugauucgcauugauguaucccuuuuuucuuuucaggauuugcaugggcaacugauuugucuacagacuuagaaagucaacucucuguuaguuguaaauguuaugaggcugcuaaugaaaucuugcaguuuagugacuugaaaagccaaaauccagaacacuauguacaaguauuaaagagaauggguaacauuagaaaugaaauugguguguuuuacaugaaucaggcugcugcauuacagagugagagacuaggugaguaucucuuuagauuccucucuauugcuuguucucucagaaaauuaugcuaauuuuguaugagucaagcaaagaacuguggcacuugauuuuauaucauaaagaggugcucuauuagagaaccucuuauuauucuuaagaaauagaauuaggaacacaugauuuucccuuggaaugaauuauuucaauguucuucauucuuacuuuuguacucacuccaucugaucaauucagaagcaaaugggacauccagccaugugccaggcucuauguuggauauguaacuggcuaaaauaugguucucucuucauguugggaagcuagauaggaacacaaagccucaaaaugcuguggaugaguaccgacgaaguauaaugggagacuggggaaauaagacauuuauggagguuauaaguuagaaggcuuuugggaaaguguuguugagcagggugaugcaggauguguagagcaucagccggcaaaugugaggaaaggagggcacuccagaccaaggaggcggugugaggaagaagccagggaucucaaagggugcaaguguacguuuagagggagcaagaggccugugugaggaagaugugggauaguggguaaguaagaugugggauggcguaguaagaugugggaugguguaaguaagaugugagaugguaaaccauuugggcccauguugaauuugaguucacuauggaacauguaugugaaagguauaauuuguagucaauuugaagugugcuaagagcuguagggcuagugagacagacugagaaccauucacauaaagguaauaguugaagccgugagaauagauaagaauguaaagccuggacacagggacagaacagaaaggggcugagguagaacugaggugagcagguaagcugaacaucugugggccuuugguuuugguuuugguuguuucuuuuuuuuuuuuuuuuugagacaggguuuuacucugucgcgcaggcuagaaugcaguggcauaaucauagcuugccacagccucgaacuccugggcucaagcaauccucucaccucggccucccaaguaauuuuuaaaaauuuuuuuagagaugaagucuugcuggguugcccaggcuggucucggacuccuggccucaggcaguccucacgcuuuggcuucccaaaguucugggauuacaggcaugagccacugcacccagccugugugccuguugaucugugaauaaugcuuggcacuuagggauacaaauguugcccucaaagaguucauugcuagugggagaaccugugcauuuacggugcaucuggagggggcagucagugagggagccuggaaagugguagucaggaagcuagggaaauuggauacaacacagguuguaaucucuucagacuccauggggaccacgcuuuuggaucuucacaaaauggcacuuugcucagauguuuuucuuugcuuauuuuaauaucauuugguuaauagugaagaggguuauacuuaaguguuguacaguagaccccacuuauccuuggaggaugcguuccaagauccccaguggaugccugaaacuggagaguuuuucagugcuuuuuccuauacauacauaccugcgaugaaguuuaauuuacaaauuaggcacaguaagagauuaacagcauuuacaacaguauggcagcaucguuacucuugugcuuugggacauuaagucaaaauaaggguuacuuguacaaaagcacagcaauauuguaacagucaucugauaacccagacagcuacuaagugacuaaugggugggccgugcauacagcaugaaugugcuggacaaagggaugguucccauccugggugaggcagagcaggauggugagagacuucaucaagcuauguuagugagcuggggcugcuguaaugaaauaucauagacuaggugacauaaugagaaauuuauugugucauagaucuggagacuggaaguucaagaucaagguggcagcagcauuggauuccucucauguuucuaccuuggcuugcagauaaccgccuugucaccguguccacacagggccuucucucugugcauagcccuggagucccucccucuuuaaaaggacaccagucauacuggauuaggaucccacccuuacaaucucauuuaaucuuaauuacgucuuuaaaggaccuguccuaaauacagucacauucuaaggaacuagggguuagggcuucaacauaugaacucauauggacacguuuaccuucauguaacaggcauggugagagcaaugagccgugguugacugcaggugacuggcucgccaccacacuccugucacugccauccuccucuuaucucaucaagagacagugcuaagguuuacacugaugucugcuuacacaguuguuuucuuucuuucucuguaaagugagcaaaucugugucugcugccgagcaacaguuguggaaaaaaagcuuuucuuguuuugaaaagggaauucacaacuuugaaucaauugaggaugccaccaaugccgcccuuuuauuauguaacacgggaaggcucaugcggauuugugcgcaggcccacuguggugcaggggaugaacugaaacgugaauuuucaccagaagaaggcuuguauuauaauaagguaacacauucgcguacauguugggccucacccauucacaccugucauuuauuuacauuuugccaguuucacuaaaauacuauaaaacuaaaaauaauuaaacucugcuaaugauacaacaccagacagaucgugaaaacacuugcaaccuggccuaagacuaguaagaauugaguauugaagaugacauguggaauuggaagggaaaagaugauucugcaaaugguuuguacaacgagcaugaaugucaaauggauuaaagauugacauggagaaagugaaacuguaaaaguauuagaagaaaauauagguagaggcuuauaugauagguuacagaaagacuuucccagcauggcacaguaagcagaaauccuggguaaaaguugaauaaacucaaauguguaaaauuaaaguucuaaaaugcacaaauguauaaaaaauaaagaucuaaaaaugcucaacagaaacugaaauugaaagcaaaucauagagaugagagguuaauauacucuugcuguauaaaauaagaaucauugaaaauaaaccacccaaagagaaaaaagagcaaauaaccuugaacagaaaauguacacauuuuuuaaaaaaaguaaauggcuaauauauauaaaagaaaauuuucaaaguuuaguuuuauuuauuuacuuuuuugaggcagaguuucacucuguugcucaggcugaagugcaguggcacagucuuggcucacugcaaccucugccuccuggauucaagugauucucaugccucagccuccugaguagcugagacuacaagcauguugccaacacgccugucucauuuuggcauuauaauauuuuuaguggagaugagguuucgccauguuggccaggcuggucucaaacuccuggccucaaaauugaguuuuauuuauuagauugccaaauuuuaugacaaauggucacacccacuguuggagaggguacaaagauaugagcacucauauaauggaggaauugaagccauuuaaaugacauuagugaagaauguugguggcauaaauuuuuaaaugagugaccuuuuuugauuuucuuuuuuaaauuuauauauacacagaaaagagugaauaaauaaacaccagaaauguagaaauuauugcugggugauuaagugugguuuuguuuuugguuucaauauaauggccauguauuugaggauugggguaacaagguaggaggagauacuucuuuuuacguaaaauuuggcaaguuuuuaaucuaauuuacuaguuauauaaacuguaauuuucauuuagaaagaaaaaaaaaaacaaaggaaacaagugcaucaucaugcucagccugagucagaaagcagcagcacggauuggcuucuuguagccuugagaugggaacacagaguggucuucagucuacucggaauaacuuucuucauugaaauauuuucauugacuuacuuuuuucauuuccucauaauauugucucuuuauaaauuaucccaaaauuaaauuaacaucuggguaguugugaaguguguuuuauuuuaaugcaguauugguauauguuuaagcugagucagaaauguacacuguuuucuccuuugcaggcuauugauuacuauuugaaagcgcuaaggucauugggaacacgagacauacacccagcuguuugggauucagugaacugggaauuguccacuacuuacuuuacuauggcaacucuacagcaagauuaugcuccguuaucuagaaaagcucaggagcaggugauaauauuugcuggaguauaaaauaaguucucaaucuaauucccuuguuuaacaaauauuuagcgucuguugucuuuucccuaauaagcaguauuuaaacguuuuaaaaacuccuacagucagauuagaagcuuauuuuuuucuucccccucaaaacaagaacagauugagaaagaagucagugaggccaugaugaagucccuaaaauacugcgauguggauucagugucugcucgacagccccuuugucaguaucgagcugcaaccauccaucacaggcuggccuccauguaccacagcugucugaggaaucagguauugucaguccaaguuaaguacagugccacaucaguuuaaaaguguucugggugcuuuuuguuuuuuuaacauggucauauaugucuuccuugacguccacucaggugaacugcuguccuaaauuuucugcugcgucugugccuuuuuuugugcugugccacuuaaacaauauguccgcauugugcuccauguugagcaugggaaaacgaauccgcuguugguguucuguggcuuacugccugucacuuaacaucguguuuuugagauacaucuguguuggcacacguagcuguucauuuucucagcucaguagucauuaaaugacuauaucuuaguuuaucuagucuaugauuagugaauuuugggguuauuccagauuccaguuugaugcuauuagaaauaaucuagugccagcaggauuguacaugaauccuggugcccaaaugccuguauuucugagaauaaucugaggccgaggauaaaggcacuuccuuccgagagauugcuuggcuuuugcugcgagucuugggccuguaguuucucagugauguuuuuuuguuuguuuuguugauuuuccccccccguaagguaagacuacuuaccuuacagucccuuuggcaugaguuuacuucuggguugccuuuauucugaaaaguaucuuuugagauacagcuuaaacuggagaaguucuuuuucuuuuuuuuugagacagggucucacucuguugcccagacuggagugcaguagcacgaucucagcuuacugcaaccuccgccucccaggccuccccacucuuuugcauauagauaucuaguugucccagcaccauuugcugaaaagacuacuccucugcugcauugucuuggcacccuuaagcuugcuuuugcccucaggauauuaggccaucugggcaaaccugaauuuugguugaggacuuccuaagucgaaguggaaagaaaucuucuccaguucaugccuguaaucccagcacuuugggagccgaggugguuggaucauuugaggucgggaguuagagagcagccuagccaacaugacaaaaccccagaaaaaaauuaaaaaauuagccaagcaguaguggcgggugccuguaaucccagcaacuugggaggcugaggcaggggaauugcuugaguucaggaggcggagguugcagugagccaggauugcaccacugcaucuccagccugggcgacagagcgagacccugucucaaaaaaaaaaaaagaaaggaaauggauuaaagaccuaaauauaaaagcuaaaacuaauaagaccuaguaagacccacagugggggaaaaauaacuaagaagcacuuagugaagccugaaguaguuaccgugaaggauuuguugcuuguuuugguuugguucuagguuggugaugaacaccuuaggaaacaacaccgggugcuggcagaucuucauuacagcaaggccgcaaagcuguuucagcugcugaaagaugcucccugcgaacugcuuagaguacagcuagagagaguagcauuugcugaauuucagaugaccaguaagucuuaauuuucauuucucagauauguaugcauuggcuuagugcuggauugucuuagaguaaggcaggccugugaaucuaaauaauacuauuuucuuuuuaauuugccccauaguuaaugacuucggguagagagggugagaaaucacuacauguuuugaagugcuuuuuaaaacuuagaggaauguauuagauuauguucagugacuagaaauacugagauauggcccaugaccccuaguuuggaaaaaaaauugacaaauaaauuuagacaguuaaagaauucaaucggccaggcacaguggcucacgccuguaaucccagcaauuugggaggcugaggcaggcagaucaccugaggucaggaguucuagaacaaccuggccaacauagugaaaccccgucucuacuaaaaauacaaaaauuggccaugugugguggugcaggccuguagucccagcuacugaggagguugaggugggagaaucacuugaacccaggaggcgaagguugcagugagccaagaucgugccacugcacaccagccugggugauagagcaagacugugucucaaaaaacaaaaacaaacaaaaaaaaagauuuaaaucggcaugaaaaauuugggaauggagaggcaacaguaaaggaguaguggaccuuauugaaccccuuaaacauagaacugacccuuggauugugguuccagaacagacacuacuguagagccugaccgaggucaagauaagucgggagauagagaagggugaaagugagaaugcuuucuuauguuauuuuccauggcauggaguaagcagauacuucaaccacuuaaugauuuuuccuaaguucucccccucucucucuugcucaccuauucuccucucccgcagaggagucuuuugagaaauaucuccugugugguaaagaaacaagaaacaauuauuugaagugcagcaguucauuuaguuuuucagucugcuguaaaauaagguuaauacuuuaaaucuguaugacuuaguuuacauaauacaguagccccugaaggaugcauaagaaacugguaacauuguucccuuuggggaggaaaccuggaaggccaagaggagggguuuugcugcauacccauuuggaccuuguaaauuugggaauguauuaccuaucuaaaacaguuucuaaaaaugguuuuuacuaaaacuaauuuuuugcuggcauauaacgcauggcuagaugugugggacagucaccagaauuaacaguagcucuuuaugugaggaagguuuggggagagugaucuucaguuuucacuugcaccuuugaauauucugccauguuugaauuccuuagaaugaucaagcaucuuuuuuguuguugggguuuuguuuuuuguuuuguuuuguuuuguuugagacagaguuuuacccugucacaugggcuggagugcaguggcauggucauggcucacugcaaccuugaccaucugggcucuagugauccucagccuccccgaguagcugagaucacaagugcuaauuuuggaaaaauuguuuguagagacagggucucacuauguuauaagcccaggcuggacucaaacucuugagcucaagcgauacuccugccucggccucccaaagugcuggaagauacuggaacaaauuugcuaagaugauaaguguguuuaauucucuccuuuaaauguuuuacuacugugaguacuuuagaaaauaauguaaauauuuuagaggguuuuguuagccagguuuguggguuuuguaagccaaguuaauaaaugcucuaguuugugacaccuuuuauucuaucuuauuuuacccaguguuuuuuuuuuuguuuuuuuuuucuaguacauaugauucagaccucccuuccuaaugucuauauugucuggucguugucccaacaacacuuucauacauaagcaauagcuugucuuccagaugccaaaucuaugcugaaaucacauugauccauugauuuuaaagagaauagguuguuuagaaagugugggauuauacuucuaaaggaagaaggcaacaguuauucucuccccacccgcagagucggggaguccccaagaccauugucacuucucacacuaacuacgagucugucggcggucuccaagaccacccucagguuugagaauuugcuaaaggacucacagaacucacugaaagcuguucugcuuacagccacaauuucuuaacaaugaaaggauguacauuaaaaucagccaagggaagaggcucgggaggcagaguccuggagaguucuaagcgcggagcucccaguuccucugcugcuggaguuacagauagugcuaacucaccccggcagugaugcaugacagugcucaccaaguguaucaaucaauacauguacaacugcggaagcucacccaagccuugguguccagaguuuucauuggaacuuggucagauagacaugguugacugccacguggcugaucuuugucuccagugccuccagaggucaagcuguuacccuggggcccaaaguccccacaguaaaucccauuguuaggcuauccauugugacccaaggacccccagguaaacaaaggcguucuuaccgggcaggacauuucaaggacuuagugguuaccuucugggagccaaggacaaagacuaaaccucuguacaagauuuaauccucuacugcacaccgcacacaauugaguucuaggagaacaggagcaaagguguccuguaguaucugauagcucuagaaaaauuguaguuagaaggcucuagaauaaaacaaaaccuuguucaucuggucugacuuccugccuuugaacagagauguaauaaacuauuuuacagauaggacaacugauacuaagugcuuaugugacuugaccacacaacugguaaaaugugaggugggccucgagccccagacucuuuucugcuggucccuuuuccuaaggcuccuguucugaaaaaguggccugucuugacaaaaccaaaugguggggcagggaaacaaugauuauuuauugcuuuguccagacuuaguauuuuugucaagggaauauuauuaaauagaaguuggauuuagaagauuuaagauucucauuagcuuccuuuauagcauuuugaaagucugaauuuucauuaauacauuaacauuagauggguuucuagauuuauauuaaagaaaugaacguuuuguauuuaaaacuuuaggucagaauagcaauguuggaaaguugaaaacacuaucuggggcucuugauauaauggugagaacugagcacgcauuccagcuuauccagaaggagcuuauagaagaauuuggccagguacauggagaaaaugacugucuuugguuuuugugugucuuaagcuacauggugaauguauauaguggacguguguguguauguguguggguauauauacacacauguacauauguaugcuaugcacuaaaacauuuuaacagugauuuguuauauuugccugguauucaucuccuuucuuuaauuugcaaguauuuuaaaauauuuuuaagaauauaucucaacaagaccauaguuaacaaauuauaaagucucuuaaguuuuuuuguugcuguuggugggaauuuguuuuguuuuauguuuuaaaagaaaaggccugugcccucuuuucuaauuuccacuagaaugccugggagcaguugaauggugaaugggccuaagcaggcuccucaggaaggaauuucucguuuucugggcauuccggcauucauuuuaccuucugcuguugcuaaaagcuuccugaagcccccauguugcgcccaccuauugcucuucuagcccugcuuggucaaauccugugugguaccguacauuucugcguugugucuaauguuggaaagucaggauuaauuucuucuacaaaagugccuauuggggcugagacauuuuaauuauguguuuuagucuaucaaaaugaucauaggugugcuuuuuguuuguuugucuuguuuaggguuaaaaauguauuggaugaaugaaacugcaguuccaucacuugguacgauaugaaacuacaguuguuggauagcucgaguaaaauaacuuuuuguuguuuuuagccuaagaguggugacgccgcugcagcugcugaugcuucuccuagucucaaucgagaagaagugaugaaacuccucaguauauuugagucucgguugucauuucuucuccuucaguccauuaaacugcuaucuucaacuaaaaagaaaacaagguaaauuaagugguuauuuguaggaauuucuuuccuagcacccuaccuauaaaaauuuucucuacuaacaucauaaagaaaaacuaggggccaggcacauuggcucacaccugcaaucccagcacuuugggaggccaaggcaggcagaucacuugaguucaggaguucgagaccagcccggccaacauggugaaaccccaucucuaccaaaaauacaaaaacuaaccgguaugguggcgggcgccuguuaauccuagcuacaggggaggcugaggcacgagacuugcuugaacccaggagguggagguugcagcgagcugaaaucacaccacugcacugcagccuaggcaacagagugagacaccaucucaaaaaaaaaaaaaaaggaaagaaagaaaaaaauagguuguauucugucuugucuucuauguggauaguagaauuuuaagugguguuccuucuugacuuguuaaacuagguaagaacccucuccacaaagccuucuauguauugaaauuacagaaagaaagaaaucuugcugccuaagggcaaauacucuguuguuaacguuuuccuugagggagaugaauaacccuggaaugaagaucugcguuucuagugaugcuucugaauguugucauuaauggagggucucgacuggaguuugaugcucagggccaagugcacugcagaauagaggacagaacacagaagcaggagagaagcaggagagaagagcgcacaccuccgcagaaauguucuaauggcccugagucaucuuguugcgcuuacauucuuuugucaaaguuuguuauuuuggcauuauugauuuaauuugaaauuucaguaguaaguacuagaucaggaaaguaauaucaaugauaugccuuccuuguuuuuaaauauaagugcaaucuggccauauuacaaaauuuggaaaauagagaaaaggaaaugacaaccauuuauccuaauacauccauuguuaccaguuaucuuauguauauuuuaccgauguauaaucuuaggguacagaucauuuuugucuguuuauuuuuuuauguuacauacaguaaaauggacucuuugugguguauacuucuucaaaccuugacaaaugcauauagaugugugccugccaccacaguuaugacagaaaacaguuccgucacuccaagaauucccuccugcuguccccuuugcagucaacccugccccugcccccaauuccucaggaucucagggagaaaguuuucagucuuuuaccauuaagccucauaucagcuguggggcuuuguagaggccuuuaucaaguugaggauguuuucuucuauucugaauuugcuaagaguguuucuaucaugaauggauauugaauuuguguccagugcuuuuauuacauuuauugagaugacuacaugguuucccuuguuuagccuuguuuaguggauuacguugauucuucagauguuaaaccagcuuugcauuccugggauaaaucccaguuuguugugaugaaggauucuuuuuauguauuacuggauccaguuugcugauauuuuguugauaauuuuugugucuaugcauaggggauaguggucuacagcucacuuuucuuauaauggguuugugugguuuggguauuagaacagugcuggccucauaaagucuguggguucauguucccucuucuguuuucugaaagagauuguauagaauugguacuaugucuucauuaaacauguaguagaauuuaccaguaaaaccaucuuaaccuggaguuuacuuuguuggaaguuuuuaaacggugaguucaauuucuuuucauggauacaguauuacucaggcugucuuuuucuugaauaaacgaggguccaucaucuaaauugucaaauguauagauucacaguaucccuuauuauccuuuuaaugucuaaggggguuugugaugauagcccuucuuuuaguccugauauugguaauccuucuguuuuucuuggucauucuagcuagaaguuuucgauuuuuuuuuuccaaucuuuucaaagaaccaacuuuuggcuugauugacuguuucuuccccucauuguuucucucuuuuaaaugucaucaauuucugccguucauuuccuuccuucuacuuguuuuggacuuaauuugcucuuuuuguaguuucuuaagguggaagccuagauuacuaauuugagacauuuuuccuuuuuaauauaagauuugcugccaaaaauuuucuucuaaagcacugcuuuugcuacaucucauauauuuuuguauauuuucguuuucauuuguuucaaaauaauauuugauauccugagacuucuccuuugacccauuuguuauuugaagugugcuguuuaguuucugaauauugggacuuguuagcuaucuuuugauauugcuugcuaguugaauucuauuaugugcugagaccauaacuguguuuguucucuucuuucacguuuguguagauuuguuuuauggccuagaauaugguuuaucuuggcacauguuccauguguacuugaaaaaucugcguguccugcuguuugggguaaagcauuguguaaaugucaguuagguuaagcguguucauaguauuguucaggucuucuguauucucacugaauuucugucuauugcuaucaauuuacugagcgaggaguguugaagucuccagcuacgcuuauggauuuaucuguuucuccucucagcacugucaguuuuguuucauguguuuuugaagcucuguuagguacacacacguaggauugugauaucugggagaacugaccuccuuauuacuacagauguccgucccucuuugauaauauagcuacucaacguucuuuugguuaaugucuuuuuuuguaugucuuuuauauuaaaauuggguuuccuauagguggcaauaguugggucuugcuuuuuauuuuuuauuuacuuauauuuauguuuaguuuuuuugagacaaggucucacucugucacucaggcuggagugcaguggcaugaucauagcucacugcagccccaacuuccugggcucaagcaaucccccaccucagccucucagaguagcugggaccacgggugugccccacgacacccaacuaauuuuuuaauuuuuuguagagauggggucuugccauguugcccaggcuggucucaaaacuccugggucaagcaguccaccuuccccagacucccaaagugcugggauuacaaguaugagccacugcaccuggcccaagggucuugcuuuuuaaauccagucuuacaauuggugucucuagaccauucacauuuaauaugauucuuucucugccuucuguuaauuauuuucugugauuccauuuuauuucacuauugauuuauuaugugccacuuuuuaauuauuuuggcaguugaccuaggauuuugcaguauacaucguuaaucuuucaugagaggccaccuucaaguaauaugauacugcuuuacauguacuguaaagaccuucuaacaguagacucccaauuccuuccucccgucuuuuguacuguuauuauacguuuuacuuguacauauguuauaaacagaauacacugcuacuaguuuuuaccuuauacaguuaucuuuaagagcaauuaaagggaacaggaaauuuuauuuaccuucauuuauuccauuucaguacucuuacuuuuuguguagguuucugucuagcaucauauuccuucugccugaaaaacuuuuagcauuuagcauuuguaggugugcuagcaaugaauucuaucuuuucaauugagagaguuuuuauucuuuuuucagucuuggaagaucuuugagcagaguauagaauucuggguuaacaguccuuuucauucaguacuuuaaagaugucacuccauugucucuggccuguguguuuucugaccagaagccagcuguguuuccuacuuuuguucaucuguuagaaaugcaucuuccuugccuguaggcgccucaccccccagcaguuuaacuaugauaggcuugagugugucgugauggcuuuuaccucuggcuucagcauuuuucuuucuucuguuccauucucucuccuccucuguagcccguuaugccuauguuagacuguuugauguuauuccacagcucuuggauauuccguucugguuuuuuugaugccauuuuuuccuuuuugugauuuuguuuggguaauuucuguugaacugucuucaaguucauggauuccuuacuugguuuugugucaucuacaguugaacuuuuugaaggcauucuuugucucuguuacaauguuccuuauuucuagcaauugcccuggguucauucuuacaguuccagcucucugcugaaaucaccaaucugaccuugcguggcauccaucuuguccauuagugucuugaacauacuaauuauaguccuuuuaaauucccuaugagauaguuccaacaucugugucauaauuagcugguucuguugauucuuugucucuuggaaguauguuguuuuuuccuugccuuccguauaucucuuguuuguugaaaacuggacaccuuauguaugauaguagagaccaagagaaauauuuuuuuuuugccuggaauuuuuuguacuuucccccugcuacggcuuuagugugggaaguggaauucauuuuucuagccuggaguugagcugugguugagauuuuuuuauugcgaugguuaccuuccauguaccacaggcuucaaguuuuccuagcaguccucguguguaggguggaacagaucugcagaaggugauucuuagugucuucucuaccuucagcucuaggucuuucuuuuguuuugcaccuuagagagggucugucuuuauacucucacaguucuuccagccauauuccacugucacugguccuucggugccuuuucgccuguuugggagggagcagggaguuagcaaggacuccauaguuguuuaagccucaguccaggcagacacucgugucccugagucucaggacuguggccuucccacugcuccugcacccccaccuaacccuucagaguguuuuuuucuguucccuuccccucucuucauugacuuuaaccaacgcccuaagguuggcaggguucauugucuucccccacccccauugagucuuuuguuucauagaggagaaggguccaggugggguugcuggucccucccauagcagcugcuguuacccugucauaggucuacagcaggagggucagucugucaggauucucacuggucuuuuaugugggcauuuggugagguccuuggagaaaagccaguaagaagaugugaacccccugacuccacagaggcccuauacuuucucaccagccucacugggcccccaccaacccauucacuauuuuagcuaaaugcuuacuggcaucuggcugcaucugccccagguaaggaaggacuguccuuucucucccuguaucagccugucucuccuuagauugcaggcuaguuggcugccccaccucucucauggauuuaagaagagccaugaccuuguaguuugcccugcuugagccagagacuuuuuccgguucugcaccaugaauagaaacuucuuucaauaauugccuuugaacuaagugccauggcuuacaccugugaucccagcuauuugggagacugaggcaggagaauuacaugaacccaggaguucaaggccacagcaagcucugauggcaccacugcacuccagccugggagacagagcaaaacccaacucuuuaaaaaaaagaaaaaaaauggcuuuugaauaauucucuauagucuaaggagagcuuuuauuugguuguguguguuuuuauuuuuauuuauuuuuuuuuuugagacagagucucgcucugucgcccacgcuggagugcaguggcgcaaucucggcucacugcaagcuccgccucccagguucacgccauucuccugccucagccucccgaguagcugggacuacaggcauccgccaccacacccggcuaauuuuuuguauuuuuaguagagacgggguuucaccguguuagccaggauggucucgaucuucugaccucaugauccaccugccucagccucccaaagugccgggauuacaagugugagccaccgcgccuggccuuauuugguuguuaauccacagugucugcaccauauccugguugugguacacagcagcggguguugauacacucacuguaauuuagcagagacauccaucuuuuugaagagcccuaaggcggagcagauacugcauaugguaacaaggcuuggaaagaauuccugccuuuuucuaacagcaguggguaaaguuuuuaaauuuguauugguuuccacaagaugguaauauaaauauaugauacaugagaaaaagugauucauugauuuuucacaagucaaucauuugaguaauugguaauagguaauaguuucaguuuuaucuuuuauaacuguaacagucauauguaugaccuaaguaauuuuuauuuuaauggaagguuuucuaagcuucuguuuauuuagguuauuaauauucugcugaaaacuauuguaaucuaaaguuuucaugcaugacacauacaaucuuauuuagcuaauuuauauugauuuuaagguuuauuaaacuuaaaugugauaauguguuaauaaaauaaacacuuugacaaguuucaaaacaaaaauauuaauuacuaagucagugacuauuucauuuuucacugaugugcaaaugaaaacaucuauaauuuuauuguuaagaggaaaauacccucugccacaggcuuaguuguuucacagugaauacaugaacauucucuuuugcaauauagagagaaaucagaaugagaccuaaaagaaagaaaaugcaaucagcccucuguauccaaggauucugcauccacagauucaaccaaccacagacugaaaauauuaaauaaauaaaaaauaauacaaauuuaaaaagcaauauaguauaacaacuauuuauauggcauugacauuguauuagguauuauaagucaucuagaguugauuuaaaguauauaggaagauguacacagccuaaaugcaaaugcugcaccauuuuauaucagggacuccagccuccucaaauuuuaguuuccuggaggguccuggaaccaauccuccacagauacugagaggccauguuaaacaaauuuuuguuuuauuuuuugacuacugcuuuuuccacuucaugcccucuggcaaaaaaauaaacaaggcuuaauaauuaaaaucuuaaguuuauuagauuccuauagaauuagagugaaagaugcauuuuacuuguuuaaaaaaaauuuuuguuuucauuuucaggugaugcaggcauuucaucaucauaugacaacugcauuggcauugaccugcuagaaauucuagcaguagcaguuuguuaggccaaagguuuucucuuuucucuuuuugaauuuagaauuuacucuucuacuguauuuuaauauucauugcuuucacagauccaggccucuuaacauuuugguggcuuugcgguuuaauauaaugaaauaccauaaaaaguagaaguaaucucugaagauucagggagcucucugcugcagugcuaagaacagauccuuuggauucauggguuguucccauuagauguguacauuuaauauuuuguuaagauuaguaaaaagggagaugaaagaauguaaguuaguucccuuuagaaaaagccugugagaugauggagcccucugaauaggggucauaggucagugaaacugcugauaagaaugcauuaaggaaggcgugauuuguagaaauuggaagaugaagauuuaagauucagaguuaugguuaggacaaaucaaaagauuuuaaguuuaugaucccugcagccaucaauuaucuuuaggcacccaacuauuaauaaaaugacagugugaugucauuguccacaaagaauaagucaucuuucaaaugccuuuucuaauuguuaagugcuaaugccuugauuacugucagaguaauuuaaauuuucuauaagauuaucaaagguuuugugacuguuaacuccccacaaaacuaaaaucuagccaaucuuaggcccagauuacagauagggaaugcauuuggaacagucacuugcuguacugugguuguugggggaaggcaggaggagauuugccugauaaaauaagugggaauuggaggggagaaaugucuaaaggcagcgauggggauccuguggaggaggaauggagccaggaauaauagaaaggggaacuccuggggaagggagcucugcaugcuggcugcucuguggcaggccugacuggcaagcccuugggugaagggagaaaauuuguacccugaagaggugaaagagcauagcauuugaaauuggaaaacaugacauuuugaccuuaguccaaacuguuaacccuucugggccuuagguuuuacaucuguaaauucaaaaugcuaguccuugccuaucugaggggaugggauuauuguaaggcucagauguguucauggacacugaaaagaguuguggaauuguuaccugguaucugguuaugugagccaggggucuccaccuggacucauuuaaaaaaaaaaaaaaagaugcuagauaugaacugccacguaauuacuagucuuuuccaguaguaacaaaaauagaauucaccgauccaucauaagggguaaauguuuucaggacaaacuguaaacugaaauaguuuucagguagaguacugucuaguacucuucagcugaggggcagucuucacacagaauugcacugacauuuucagaguaaacugagaugcagcaguucuuguaauucaggaauccauguuuaaauccuagguaguucuagcucuagagacggcaguacaacaguggcuuuagauguguguuuaugacacaggaaggcgcuuaggccgagcuugaggaacagaggaaauacugcauagcuccuucugugcccucacccggcuccacugcauuuucuucauggccguccgucugucacucucuuguuuacuaugguuucccccagugccuccccuccccucccccaaacuccuaccucaauaggaugcaaauuccauaaggcaggggcuucuuuuugccuguuuuguucucugucaagagcaauuccuaguacauaauaggcauucaaauauuuauaaaaggaaugaguacuggauuucauugauguauugaaauaaauguguagaaacaggcccaugagcaauauguaaaagaaggcaggucugaacccggcaggagaggaaugccugcugcucugugaagagugacuguugggcugucacuguccgguuuucuggaccucugaauugucgguaggcauugcuggucccuuaccugucucuuuuucuuuuuuaacccuagcaauaacaucgaagaugacacaauucucaaaaccaacaagcacauuuacucccagcuuuugagagcaacugcaaauaaaaccgcgacucuucuggaaagaaucaacguuaucguccaccugcugggccagcuugccgccggcagugcagcgagcagcaaugccguucagugacugcacagagccgugucccagacacgcugucagugccuucaacacggagccgguuuguucauucggugcuuuguuucauuaaauaauagggaaauauccauuuaaaacagguauaucaguggaaacacagaguuauuuuaagugacagacaaauuacgguugaguucuguggcuucuucacuugaagugcuaacaucagaaucaaacuuaaagcuuccacuauuuaugucuuugagaaguauguaguaccucgguauuaacagaccugcugugaugcaguuacacuuucacguauuuuugaaguaugucaagcuacacgggucuaagauaugauuauuuuggauaaaauguuacuuuggucaagagaacuuuuauccagaugacauuacagguucaaguggguuaaggagaccuccuguacaucuacaguguuuccuuuuaaauuguccagaaaaaagguguguucuucauaagcuucagugcaggauuuuucaaagacgagcuguugugcaauuugcuguauuuaaugcauguucugaaaggauucacuuuugacuuuauaugacaguugaucaagaacagguacuaccccuuuuuuucauuucaaacuugaaacugugaauaagguaagaaaacuauuuugaauaaauaaacuauuuauuuaaaaugucuuuguauuuuuccaauuuccauucuucacauugaguuuugauuugaacucagucuaaaauuaauaaacuuuacaaagcaaagcucaaaacauuaaaaguaaaauucugcuguccacuaaauucucccuagaauauuuuacuuauugcugcugcuacauggcucuuguccaguuacacacaaacauccccuguucuuuguaauggcuacagugcacaaggcuguuuucguucauaauucauauuuucaauuucaagacaguguaacagauaaaacaggcucuuucgaggugaggugaaggucuggacuucugugcaugacaccauuguagguaggucugcugcguaggccugggggcaggugcacuggagauucggccagcucccugcaggcccuccaugguggccagaacccgcucccacaccagccagaccucugaaggaauuccaacuauacuagaaaacugucuagaagaccuaguuuuaagccgaauuuuuacagagcuaugauguaaaagagacuucuuucucuuuuacagagauuuucagguguuuucauuggcugagauuuuuuuguuuguuuugagacagggucucacugucacccaggcuggaaugcaguggcacaaucucagcuuacugcaaccucugccucccaggcuuaagggauccucccagcucagccucccaaguagcugugacuacaggugugcaccaccacgccuggcuaauuuuuuguauuuuuaguagagacaggguuuugccauguugcccaagcuggucucgaacuccugagcucaagggauccaccugccucggccucccaaagugcugggauuauaggcgugagccaccacacccagccuacuaacagugaguuaacauccaucauagcuuagcagaauucucucuugccauuuguccacuugguuguuguuuacuuaguuugcauuuucccuggaacagauuuguaucgguuugcaacaauuaaucacugaaacauuuaaaguuuugccuaaauuguaaagcaguuguacgaauucagcaauguuucauuucaggaccacugucauuccguuuccccuuguagcaaguguacacacaucauaaaacugucuuugcccugcuagauaaaccuagacacuucuguugauuauaaugaaagaugauauaguaucuuuuggguuaaugaauucaaaaggauguuccuacuuagguaggaaugagcugggauuagggguaugagagaugcuuaucuuuccucccagccccucuccuugguugaaacaaccuuucagucacgaggaaaauuuguucugaagcaaguaagaauaaauucuaguuaucuuccuuugucaaagcaauaacaugaaaguuccuacaggggggaauaaagauccuuauaaaauacauuuguaacuugcuguuuuuaacuuaaaauuuccugaagua

SEQ ID NO: 15444 - RNA, 36281 nt, Homo sapiens
caggcaagagaugauagagguguggacuacgauggucucagaauuagugcugagaaaugucuggauaacaggauuuacugaugggcuggauauaggaugaggaaagggaggaauuaaaguuaagccccagguuuuggguuagagcagcuggugacuuuaggggccauuuauagaaauggugacgauuaagagaggggcaugaauuauuauacaaauucugcuuuggacaaguuaaggcugagguaucuauuuaaacauucaguaggcugaaggaucauucaguccuaauuguuuacuaaacaaauaauaaguaccuauauugccaggcacuacgguaggaccuagucugaagaaaggaacacaguucuaugagacuaugaaaccaaagauuuacccacgacuuggucagcugccccaggagccagaaaauacagccuagcugagaucugaagaaggaagggaaaacugcaggauaaagaagagcauuugaaaaggcuucuacgguagaacgcggcaagagccuucaagaaacugagggcccaagugagugccgcccgcagagugaagaggaggacagcugcugccccgaggggagagggcccccucugcgagcccgggguggccgauucaggaucugaggcuucagccugagaacuaaagaggacgagaagaacacaccuguuguggcgggcuuuuucggggaggacgcggguugggagauuaacuggaccggacuagaccuuuaaaaaauaacuacuauggcugcaguguguuaaagaccgaggagaaaccugagaaagaacuuaucuccaguuucuccucacagacccucagggucagggaagacccuacacuauuuuuacacagccugggcuugccaaaaaguuuuucucagguauaaaccaacuaggggagcguguccuucucaccucgucaaugaccucguccucuucauccuuuuccuugucacugucaucaucgucuucauccucauuuucgacuucuuuuuccucuuccucgucgcgcuggacugggggauccggcggcugcggaaccccacuuuccacggcacgccgcuuagaccuggacgccauguugccgcucacacugcgccugcgcagcuuccccuugccugaccuuccggaccagcccauaguagccaagggggugaggaacuacgaagaagcucggcgcugagugcacgucaaccccaaugccccugcuggauuccgcagccaugaccccuuacagucacguccagcuugcggucccaucuugcuuuuuucuuccgcuuuccacccuccaucacuccucccaaagcuuccccuccccuucccguagugguucaacccaucuaaccucuggccucauuccguggccuggauggcggugcgcaugcgcgagcgccuagcugcgcgcagccacccacgcgaccccagucugaggugcgggguccuggggcccggcgcggguggccgccgcggccccucgggcugcguggggagggggcuuccgccccuguugucauugcuccugcagccuuuucgcugggacugcgcgacaccgccccccgaccgggugcccgcugugugccaggccgggugcugggcacggucccgcgagguaggugucgccgcccgcuguaccgguacggacgccgaagcccgcgggcgugcaggggcccggccccgggcggugugugacacaguggggccagggccccgaggcuuccgcggaccugggccugcccaggcggggauguccgcugccgcuaccgcugcgccggugacggaaggcgccugcccagccuacccucgccgagcuucuggagcgcauuucuugaccuaaaaguuuuuuuaaagccggcaccgcaguuaaaaaugcuucggcggggggccgggcccggugucucgcgccuguaaucccagcacuuagggaggucaaagcggguggaucaccagaggucaggaguucgagaccagccuggccaacauggcaaaaccucaucucugcuaaaaguacaaaaauuagccgggcgugguggcggacaccuguaaucccagcacuuugggaggccgagauggguggaucacuugaggucaggaguucgagaccagccugcccaacauggcgaaaucccaucucuacuaaaaauacaaaaacuagccaggugugguggugcgcgccuguagucccagcuacucaggaggcuaaggcaggagaaucgcaugcccccaggagacggagguugcagugagccgagaucgcgccaccgcacuccacacuccagccugggcgacagagguagacccuaucuaaaaaaaaaaaaaaaugcuucggggccagugggguagucuagguuaaagacccgagccuauuuggagagaagaguggaggggacugcggccaacugcagagcgagcgccagccccuguggcagguggggaugcagccuggggcagccaggucuucccauugcgagagaaacaggguucaucagcuuucuaggaauaagaucugcgguucucaauugauuuuucucuguaaaaugagggggguggguuggauauguuugauucuaggaauggugugagcugcgcuaauaggcugcuucuguuuaagcaggguaacaucugauaaaucagugauccuucaucaguacgagauggcgugcccuaaagguccccaggagcccagauugcccauaaucguguucugugauuucggucuuuccugggagucucuugucuacccagccaugucauggauauuaaaguaauacuuacacaucagcgcuccacaucugauggggcagcuugaaauggccucuuugggucgcacaacugcaaaaacauguuccuguaauggagaagagaggaagcugucaaaaaagacccaucaaaaggcuaagauuagaaaaaagacucagaaagaccaugugaacauaucaacagaguugcacugagauaccauagccaauuuuuuuuccuguuucuuuauacuuuuuuuauggugguaaaagauacauaacauacauuuuaccaucuuaacuauuuuuaaagauacaguucaguggcaugaagugcauucacauugugcaaccaucaccaccacuauccauuggcagaacucuuuucaucuagcaaaauugaaacuguaguuaaacaacucccuuauuuucccuccaugaccuuucuacuuuccaucuuuauuaauuugacuauucuagaaaccucauguaaguggaguaacacaauauucuuccuuuugugacuauuucauucagcaugaugucuucaaaguuuaucccaugcuguagcaugcauuaggauuuccuuccuuguuaaggcugaauaauacuccauugcauguauagaccacauuuuguuuaucuacuuaucugucgguaaacauuuugguuacuucuacauuuuagcuguuguaaauaauguugcuaugaacaugaguaucaaauaucuguucgagucccugcuuucaauucuuugggguauauauguagcaggggaauugcuagaucauaugguaauucuauguuuauuuuuuugaggaacuauacuuuuuuguaguuugcaaaucuuucacaguaaacaggaucacuuuuguaagacaaguaggggaaaaagccuuacuuuaugcccucagauuaguucccaguguugagcucauggucaaagugugaauuagaauagugaaugugaaaguaaauacaguacugacccuagggaacugaacucagcagguaguagauugcuuaccacucguucaguguucaucuuuagcucagaauuuaucuuaaugaggcagagggaugguagcaagugguuaggagacugagcaugggcuucagaccaggauccaaauuccaucucucccacuuacugugcugugugaccugggacaaguuacucaaaccucccagggacuugguuucaccuccugcaaauaaggcuaacaccaccuaccuugcagguuuaagugaggauugcagucuugcauguaaaaugcuuagcccagugugauaguuacuuuuacaugucaucuugacuggaucacggaugcccagauaucugguuaaacauuauuucuuggugugucugugaaguuguuuucagaaaagaugagcauuugaauggauagacugaguaaaguggauugcccuccccaaaguaggugggcagcauccagucuguugagggccuaaauagaacaaaaagccaaagaaggaagaauguguccugucuccuccugcaugcuugaucugggauaucuucugcccuuggugcuccuggugcugaggccuucacacucaggcuggaaccuacacccuuggcucucaggccuucaggcuacaacaccagccuuccugcuaacaagucuccagcuugcagacagcagaucaugggacuucucagccuccauaacugcaugagcuaauaccuuauaacaaaucccuuucuagauguaaauauaugccauugguucuguuucucugaagaacucuaauacacccaguaauuaacaugaguaaaugcucaguaaaagggugacuguuguuauugcugauacccagaacaccaugacauagaagguacggguuugagguuugguucuuucuuaccaguaaggugcccuuauuccagucauuuuuuuuuucuuuucuuuuucaucaaugauugaugaacauaaguaugaggguaaaauggcagagcaagcauuagacuguaaaucuagagacagguugagcccucuuuuuaccagugccgaggugaguuucauguuggaagcuucaggagcagcuucauuucugcuggggcuucucccgccuuuuucccccucaaugggaaauaacagguuucguuauuuucauuggaaaaaaaggcagaggaaaccccagacacugcacgguuuuuaggcccuagccucaccagucucaagccuccuaucaaggagggccauauagugccucugaucugcuugaugcagacccuaggguccuucccacucccaugagccacccaccagagugagcuaagaaaucaacuggcagagagcagagucacguauggccaagaggaauuguucuggggguuguuuaguaagcaggagagagggaggagaagaaaaacugcacagggaucagaugccuccagcagaagaaagcgaggcauagagaucccuuaccaucugagucacguggcaccaaauauguuaccaguggcaaaucaguagacaccugcagcaaccucaaucuugucuccucagaagaaaauucaacugggggcauaaggcagaaaaagugaccgaggcaagcuucagagcaggaguggaaguuuauuuuaaaaaacuuuaggccgggugcaguggcucacaccuguaaucucaacacuuugggaagccaaggcagccggaucacgagguuaagagauggagaccauccuggccaacaugcugaaaccccaucucuacuaaaauacaaaaauuagcugggcaugguggcgcaugccuguagucccagcuacucaggaggcugaggcaggagaaucgcuugaacccgggaggcggagguugcagugaguugagauugcaccacugcacuccagccugggcgacagagcaggacugcaucucaaaaaacaacaacaaaaaacuuuagaacaggaaagaaaguagaguaugcuugggagagaccuaagcaggcaacuugaaggacaagugcuccauuuuacuuuaaggaaaauuaaucauucuuucuguuucaaagaugcuggguaaaauugaaauuguuguuuucccacaaggugagcaaauaaugagcaucuacuacaggaaagaaaguccaucaaaaaagccaacaauggagaggcucacagccccuuuccaauguacaggaaucugaaacugagacugaggcaagagcagccuagaccagaacccagacacuggcccuccugugcaaacacccucuacuccaccaagccucuuccuaaagcccaagguggcgacauguuaaccuaucugugcacgcuucucaauugauuucuuucccaaucagccugauaauaugugacucuagcacagcaaagaaucaucaacaacagaaccuuuuaauuuuauauuauuauuauuauuauuauuauuuagacaagauccuucucugucacccaggcuggagugcaguggcacgauuauagcccacagcaaccuugaacuccugggcucaagugauucucccaccucagccuccugcguaguuaggacuacagggaugcgccacuaugcccggcuccuuguuaacaacuuuuaaaauuuuuguagaaauggggucucgcuauguuguccaggcugaucuuggacuccugcucucaagcaauccuccugccucagccugccaaagugcugagauuaccaggcaugaaccacuguccuggccuaauuuuauauuagaaaugcuuucaguguuugggaaugauuguauacaggauuaaaaaagaagacaaaugcuuucagugacgucagauaaaggauaaggguaguaguuggauuuuuauuugcaacacaucucagggagcucuuuauuauccagaagccuaaacuucaugccagcaucgguuuuauuaccuaagagaaccacagauuagaacccaggagaaauauuuucucuguuuacaauggguagauugauuuuucuuugggguguuugcauaacuaaacuaagcacuuuguacuacagugauacuuuauauuuuuauaccucuauuuuucccaaacauuuucguauucaaaguguaugugaggcauaauauagcguaggggguuaaaagcacagacuuuggagccagacugguugggugugaaucccagcucugccacguagcaauucugagacuuuggaugagugucauccucuguacaccucagcuucuuccuaagccucguagguggacuuaaugcaugugaagcucuuagaauagugccugggaggcaguaaguucaauagaucuguucgcuguuuuuaucuucuuugagucacucagcaacccuaaggcuugguagggcagagguuauucccauuuaacaugggaaaaaacaagaucacaccaugguuaagucauaaagcugagaccagagcucagguccguuggcccuuaguccugugcuuauucugugacaccauacuuccuuccuuauauuaucaccuuagagaagggagaagguaaaagggcaagcagaaaugaggaaaagagaggagaaauacaucuauaaggcugggugcaguggcucacuccuguaaucccagcauuuugggaggccgaggcagguagaucaccugagcucaggaguucgagacuagccugggcaacauggugaaacccugccucuaaaaaaaaaaaaaaaaaaaaaaaaaauacaucuauaaacaagaagcuucccguugcuauuaagauaagagccacauucccuaauaugacccaacgagacccaaaagaauucuagugugagcaucuuuauguuaaucuuuggacacauuuaucaguauugcuuuaguauucuuagaagugaaauuacaggaagaaagaagaugaaguauauaaagcuuuugaugucaacaaaucguuuuccauguuguuagacucucuuaugauacuugacguuuagaaaacaucauuuaauaaguagaagagucaauauaauuauuucccaaagugcuuaugagcuacuuagcauauuuaucuugaaauggaaaagcuauuuaucuccuuaaaacauaagauaccaauuucucuguuuguuguugauacaacccuaaauuuacaucaguucucuuuccggaaccauaaacguuuggcauaggacacuuggcuuucacuaaugguuucaucugucuuuccaagugauaucaacugcuaacaugcucuuucuuggccuuaucagugacaggggucuucagaaagaacaagcccauuagugcuaagucaugguguaggagggauaggucucuuccacaagcauuugauugccuucuucuuguguaccguccccaucggaaauugcuuaggaagagucuuugagaucuaauuaagaucuguuuccuugcucugucgcagugcccuauaaggacugccaggcaauaaugaagguucuuuuacugaaggaugcgaaggaagaugacuguggccaggauccguauaucaggguaaguggccugagacuccuuaucccacaguguccuuucuacugagucaaggggccuggagcaggcagggauggguuuugcaaaaccucagaggaacugacgcagaauaaauuguuaauguucccuuauuuuaaaaacagcccuagccaauccagaacuauauucuuucauuucaggaauuaggauuauauggacuugaagccacuuugaucccuguuuuaucguuugaguuuuugucucuucccaguuucucugagaagguaaggccuguugugacugagcaccauguuaguguuugauuucucccuugccagcugaagccagagagggacuauuuuacugucuucuuauuuuauucccaaacuuuaaaacauggcagcauaacuucaccuggcuccaggaggcugcugcuguugggagguucugacugagccucuaucagccccuccagaaagccacccagacucagagauuggggcccaggagagcaggucauggugagagcagcaaaccugcauugcucucagcaguccuagaacccuuucacucauccucucauuuaaucuaccccucacccccaacuucugcaaagcaggccagggagguauuauuuucccguuuuagagauuggggucucaaauuaggcaacucagcuaagaccucuagcaaguaagagacagggcugggacucaaacccagggcuucugcccacaacuucaguucuucuuccagugaggagugauaaaaauugcaggagacaaguccaguaaagccuuccaaaugcuucagagugaaaauucagugcccacagcuucagugaagucagauauguacagcagccuagugccuggcucagaguaaauguucgguagaugauaucaccauuauccucuuugaaaaucaggacuucagcauugauaucacccccugaauauucccauuuuuauuacagauucgggucaagucuucccccacuaccugcaccccacucuaaucccaggcugcgucaggcuuccccucugugcugcagugcacuuaucacccuguguuucacugucucugcccuagacucugagcuuccugagggaaauacugggaauaaggaauucaccuguguacccuaaaaguccuagaauaaauaguuccaggcacauaguaagcacucaguaaguguuggggggauggguggaaggaauuaguuugccuacuacuauugugaagcauuuggaauucugagucuuagcuccuuggaagauguugaacauagccaucguauaaaaugucuuuauugcuuuuuggugugcagcuuucucauccugaagauuacgggggacucauuuuuaccagccccagagcaguggaagcagcagaguuauguuuggagcaaaacaauaaaacugaaggugagggugggucugcuguggauuccacuggacauuuauuuacucuuauuucuccugcugggagacuaaauuccagaagcagcugcacuucuaagagaagugagugcuuagugguaucaggucacagacucugccuugggaaacaggagaacagggcuaucuccuaaacucccagacagaugacccugaggaggacuuuccccugucuauucguuguucaccuccuagggacugauauauccccuuagaagguaucaucugaaaauaggauaaauacuacuuuccugaaagagagaugaugaaaaaaucuaacuaugagaaaauggucagugccaccaugucaggcacuuagugacccagucaccucuuugacuugucuucccaccuccgucccucacuauuagaacaguaugaaaauggcagugcccauuaacagaacccuggguuucagccugagcaaacaccuuaauaaaugcaauugaacagcuuccuagcuaacaauuauggagugccuguuguaugucagacccuguguaaugaauacuucacguucauuaccccacuuaacccuagauaacaauccagaggcacacauugcuaugaucuuaugucuuauguuaccauugagaaaacugaggccaggauaguaagcacagaacaagucagugcagagccaggccucacacucgggccacccaccuccacaguuacacugaugagcggaggcagcgggcagagugguuaugcaagggcuuuggagugaguuaguccuggguuuaugcagccauuuggacauuaaugaguuccuugaccucucaucaugggauuacuacuaauaguaaugggauuaucuacuaacaguagacuauuaguuagguagaacuuacugaaugcucacucugugcgagacucuguccugaauacuuuuuccugugagauagaugugcuuaguauuuucacuuggcagaugaggacccuggagaacaaaggguauggaacuuuccaggcccccacaauguguaaagcacaagugcaggauucaagcugcagagucugagucccaaaggaaagcauccaggacauuaccuggagcagagugggcauggaguaagugacaguggugaguuuugguuauucugucuccacauuuaaccaggcuucgcuguagccuaaacaucccaccuucuuggugauuucauacacacauucaccucuuguugaaaagaaagcgugagaaccuaagaaacucagagccagccaggcgcaguggcucaugccuguaaucccagcacuuugggaggccaaggugggcagaucacuugaggucaggaguuccagaccagccuggccaacauggugaaaccccaucucuaccaaaaaauacgaaaguuagcugggcgugguggcacaugccuggagucccagcuacucaggaggcugaggcacgagaaccacuugaacucaggaggcagagguuguaugagccgcgauugugccauuauacgcuagauggggaagcauguguacucuuucccaguggugcucugggugcuuuuucuugcaguuguauuuuuucuuuuuguguauguuuugaggaugaagauaaugaaaaagaggaaaacccuagaaaggucacuauaacucuuucuggugcuuuauaauaaaguuuaaaaugcauuuucccauguauuuucuuauuuugauucucacaacaaccauagggaauaagcaguaggaguguaguuaaucccaguuaccuugaugaagaaacagacgaggugcguuaacugacuuaccugggacacacacguuaaggggcagagcuggcucuguggaaggcuuucugacuccacccagugcucacuccaguuguucugcugugaggcuuggaaaguaguuuguuuacaugcuauggauaacuuuugaauaaauacuauugauauuuaugggguaggaagcaaaguggaacucaaucuuugguuaccauuucaaagggaauuucccuuaauguaaaggguagaggaaugcucuugaauuuaagggaaaguuauguucauaaccagauuuuggaaaggaagaaccauuauuucccuguuuucuaaaaauguaaugaaugcccaguagcuuuaugauauauuuauacaauccauuuucucuuuguguuucuuuaaucuauauuuaaagauuuuguuugaucauaaaaugauaauauucuguaucaaauuguguuuguuaauugaccugaaauuuauuauuuuuacuuugguguaauggauaaaugaacccucuccucugagauuacaguuuguugacugcuuucagauuuaugucccaaauaaaccaauuggauuuccuuguuagacauuuaaguugcuuuuuuuaaaugaccagugucuuuuucuuuaaaagucuagauuuaaauuuuugauuucacuaugcagauuaauucuucaaguuauguugauuucgugguucccauuaaaauucuucuaguaccaacuguggagauaggcuaauauuucaagcaaggaguacuaaaacauuuaugaaagcaauuuuuuaaaaauugccuauaaaacaugaacaaagugaaaauggaauuuuaguuugagaugcuguuuuuuacauuugguugcuaauaguuugcuuugcucacaguuucuuagggugaacaagcagccuugggcaacaguccaaauggccacuuugguauuugcaauucacauaucauuucauguuuuacagucugggaaaggucucugaaagaaaaauggaaugccaagucaguguaugugguuggaaaugcuacugcuucucuagguaaggagucaagguaaaaauaaaacaacaaaaaauggcuuagccuuuucaguuuuaaaaaacaguuuaacucaguuuaaaaauauuauuuuuugcuuauuaaauuugcaaaaauuaauuaaguauacgauacuacugauaagaaugcagugaaacaaauauaaucaaacauuuccaaauggcauuaaaaauugguuuacaucuuuugagaaccacuuggucaguauguaugcaaaagcuuuauuaaaauguuuguacccuuuggcugacuaauuccauugugaauguacauaaugccacugaauuaugcacuuagugauuaaaaugacaaauuuuauguuauauuuuuacuauaauuuuuuuaaaagccuaaaucuccagauagugauaucauaguuguuuuuuuuugguuuucuuaauauuuugugcauuuuuccagucuugagucuauuuauucuucuuaaagcauaaaauguaaauaguaaucauuaaaaauuaacauugagcauuuuaaauacuuaaaacaaugcuuagcaauugucauaaauuagccuguaacuuuguuucagaacaguucaauuuguccagugaauuugaaaauauuagaggaauguauaauaugagugaaaauaguuuaagaauuaaaagcacauuuuccagagaacaaaaugaggcuggggaagaaaccaguugggaguugcuaagcuaauuaaaagaugauuccuagaucuucugagcagcaugacuuuuaccacaagcucagcagaucagccagggaaagggaauuaguggcuugguugccaaggaaaccaucuucccucccgcacaucucucuccaaaaauaaguuaagaauuugcuuguuacuuucuuuuaucauuuuuuccugaaugagaagaggaaagaaaauagccaguuucuuucauucucuauauuuccuaccaaaaacucaacuaucaaauauacaguauauuuauacauuuuccaaacuuucacacauucacugauaagcaaacauuuugagcaucacauccccuucaguuugauuucgguagcaucacuaugcauuuugcugucacuguccugucauaugagaagaaaaugagaaaaaagacuauggugauacaaugaaugaugagcaucuaugucuugagacuuagaguggcugagaguggaccauaucaagugcagcacaagcagcagggccuuggucucaguuaggcacucacuggacucagucuggucccuguuuauucaguugugaaggaaaaggacauguucuaaaugcagggaacauauuaucaaaggagagaggaaauuagaaguguuguaacuuuuaaaaaugucuuugaaaggaaaccacauuuuuccuugacaugaaagucaaucacccaacuuugaacauucuauuuuagcucaccuuuucagauauaauaauguacaaaggagcucuuuugaguagguacagggacaaggcauugcuugaacucucugagguuucuguucaacuagaaucucagcaggagccuggagaguuaucagaaguugagcaccaacagcugggaggagaccaggcccaauguauuaucuuugcugcguaacaaauuacccccaaauuaccccaaaacuuacuagcuagaaacaggcauuuaucaucucaauguuucugugggccagaaucugggcaugauuuagugggcuucucuguaaccaggccauggucaagcugguggucagggcuacagacauuuugaggcuugacuuaggggagggucugcuuccaaaaucacucacauagcugucaguggccucagaagaucugcuucccagcucacucacaugggccucccgagagggcuaccuaagacauggcagcuggcguccccugucgcaaggcaauccaagagagagcaaaagagagcaccuaccacugaagccacagucuuuuuauaaccuaaucuuggaaguggcauccauuucuucugccauuucuuuuggcuugaaucaaguaaguccagcccacacucaagcggagggaugacacaggggcauggaucacagggaucauuaggagccacuuuccacugcccacaagcccucuagucaagagccaccccuggcucccuagagccugggaaucagguuaggaaaguuggacauuugaagcaaagagaagacaagguagacauuuuucuugaaguagaaaugaaaacaaggguccagugaauagcaagggauuucgguguggaaguccagugagagaagaugccaguauuucuuuauaaauguugcacgcugacauaauuuuacagguauuauugauuaauaauagauggcaaaaaguacaugcuggcugggugcaguggcucacaccuguaauccuaacacuuugggaggcagaagcaggcagaucacuugaacuuaagaguucaagaucagccugggcaacauggugaaacccugucucuauuuauuugaaaauaaauuuuuuucaaaaguacaugcuauguaacauuauacagaaaguccucacuuaacauuguugauagguucuuggaaacugccacuucaagugaaaugauauauaaugaaacaaauuuuuuuuuccuuaucaauguuguaaugaaaacauguugaaugaaacgauguuauucaaggaccugcuguaugucguuucacuuacaguggcaauuuccaagaaucuauuguugacauuaagugaggacuuacuguacuuggucuacauaaaaucuccugagaacauuauuugguucaauaauauaugcauauuuuaauaacauuuuaauuuuuauugaaaaagcaaagaugguuggcuugugguuugauaccuugcaacucagccagccauauccuaggaaagccuuccauuuggcugcccaaaggucaggugccccaacuuucccaucugauugcaaaguuggaccugggcgccauuuaguaggcacuguugcuuggccuuguaaacccagaccagugaugucacagaagauagcuuagcaauuaacaacuuggaauucauaacacagaaagacuguaccagccugggcaacauggugaaaucucuucucuaccagaaauaacaaaaauuagccaaacuugguaguacauucuuauagucccuuuaacuguggcagucagugucuuaaccucucaaauauaaaaaauacucucuggcagguuuauuuaacacaguuggagacaauuugaaguuucacugucagcuuuuacuugggcagggcccuuaagaugggcuuacccagccagaguguugguugaaauguuguacugacuugaagcagagucagucuugccacaugcagggacugagaccuuagaccaaauaugcauuccccaaacauuucuugagagccaucuguggacugugggguggaccggguagccccagucucugcccucacaaauagagcuggccacugcuuaauagcuuccuucccucucaaguacaguaguaauuguucuguucacaggguuguggugugaggaucaaaugagcaagugcuuacuuugugaucagcaaagcuauauaugagaguuaauguucugguuaugguuauuauuguuucauuacuugggaaaaaugcauauuuaugucaauauugauuaccagcgucacugcuaaguucuuaugucucaguucaguuccugugggauuuuuacagguuuuuuuguuuacuuuuguuuuugaugcguuuagcucuucuaagcucagacaggagguccagccucgguugccacuguagcauaagcaagggcuuaguuccugaacugaguuacagcuuuauuuuucuuuugauucagcauguuuuuaaugauccauaaguuaaaagcugcugguguuuuuauuaaagcugccauuuguuacuaaccaggcucugugugacuccuaaguggaaagcccacagcacuuccuuccucagaggcauuccacauuccugugagcagguagcaguguugacugagccagucccuuaggccucccuucaucagcacgcuuuguggaguggccaaguguuugcugucuggaaaagugcagggggagccugagucuguuagcuucuuacuugguucaugaauagggaucucacaaaagugcugguauagccccucauccuaaaugacuuguauuuguagcgcugugggucccuguuagcagauuauuaugaaaccuuuccuccccuuccuuccauuuuagucuggccaugucaagccauaacaccuuucuggauguggucuggccacauccucccaaaaaaaugaaggcucuguaaugccgauuccugcaaaaaguaccaaaugcccaucaucuccuuccugacugaagagaaaacagccuuuguugagcaccuucuagauggcaagcacuuugcucuuauuaucugacacgauccuuaaaacaguuccaugugguugguuuuucccccucuuguagaugagcuauguggggcucagggaagcuaguuaaggccuuacuuacccagccuacacaacuggggugcagguaccaggaccugaugcuuucucuucugaacagacacuugugaucuucccucaguagcuuucaagaaaagacauccucuaugugauuuguaaacugcauaccuguguauuugcacguuaaaaaauaacgcuggaacaaaaggacuucaauaaccguguuaagaaauacauuucuuugugguuuuccagugaguaaaauuggccuggauacagaaggagaaaccuguggaaaugcagaaaagcuugcagaauauauuuguuccaguaaguagaaaaacaucacuccaaaugaagccauuuauuuuuuguugaccucacaaccacuaccuagggaaaagaauauuuccucagugcauucuugguggugagauugauuggugagcaucguauaacccacucugggagcauagccuauuuguauuuguguaugucuauacuuugugagguuuagcccacuuccuucuacccccuguaccaaagaacuugacuugaacauaacacaaaauaaaacauuugggagauaaaaacaguggagagaucacuugagggauuccaaagagagcagaggcaggaggugugaguggguacucuccccuuacugaggacuguccuuucccuucucaggagcuacuucugucucugaauucccucucccagcuugcucccagguaaagaacugacucaugauugggcugccuguggacuuggauuuaaaguggcacuuguucuagggguguuagcauuuaaauggggacuuagucuuaaacuaauuauggaauuguaggcuucagaagauacauaggcaaaaauucuuggagcaagagggaugggaaggcugaccgucuacuuguagggcagccccaccucuaaggugcaucucccuuccucucuguucccugaauguccaguacaaccgcaagcucuuacacccuugucauuugacuccucugcuguagguguaagaucauacacccccaugagagcaugaaguagaacuaucuuaucuuagauugcugaagaggaggaaauccaggcuuuccuagagaucaugagcuggcaaacuucaucuguuaaggauauuuugggcuuugcaggcaaauggucugucagaacuacuaaucucugcaacagaagcaugagagcagccauaggaaauaaacaaacaaugggcuuggcuuugaccccaggcuagaguuuucugaccccuuucuaaaauugcuugagugucugcugagcugggaggccagggucagaugaacugcugacagcugagaguuuccucuaagguggucccaggagagggguauaugccuuggcccuuggguggugagaucaggaugagugguauagggagagaguauaccuuaaauaggucucuuuauggcuucugaaacagugauagaugguuuuguuucugguaaaacaaaguauuuauguuauuuaaaaaaaauacuccuaaaggugauguuggccuuucuugacgugcaaacuuguacacuaacgucuuauaaggcauuacuuacaagucuuccugccguaagucauugcuguugccugaagguucucuagcuuauauuuuucuuuguguuacugggagcuuguucuagagaaaguccugcgucuuuuucuacacuguggucugaggaucccuggagcuuaauuaggccccugacagagucgucuggguugggggcggcagugagcagucagggaacagcagagauacugcugggcucaguggauccuuuccaaguucuccaauucuccuuuuuucucuuuucuaauuucuuuuaaaaauaacuucguuguaccuuuccugagucacuacaugcucgguguuaacguugaagacuagcauuuacugagugcccagcgugucucggguacauagacacguggccuguaugaugucauuuaaucuucaccaucaccccaugaagucagaaucguguccacugcaagcugugcuggccaguacaguagccacuagccacauacggcuauuuaaauguaaauguaaauuaauugaaauuaaauacaauugaaaauuuaguucuucagucacacugggcacauuucacaagcucacuugucacuguggccaguggcaccaaauuggaccacacagaacauucccaucaucaccaaaaguucuuucugacugugcugcuauagagacucuuggggguccaaggcccagaucuuguccaaggucacaagcuaugaaguggcaggcuggaauucacacucagcacagcaaggccacugcucaucccauggccugucacauucagaggccugacuggcaucugcuccaugccgaccugcucucaaggagaugcuggccaagcaccuccauccacucugauuuacagugacuggggcuccugcagggaugaagacguaagugugcuugacucuguguuugaaucuggugggcagaggcuuaaggagccuccgguuuagaggaacuacacgggccuuuucuggccacucagaugaauaagcuguagucccagaguguuucggccacuuggcaauccugagccugugcacuccuuaguucaguggaugugcguucaucggcucggacauggcuuucagguauuaaugcauugacugacgccucucuugccccaccccccauauugcuucccacaucacaggagaacaagucaguucaauaugguucggcagauguuuacccaggagcaccugugugccaggcccuuugcagggcguugggacugaagaggaguuuaacuccauuccugucuucuggaaguucccagccuagcuggggcuggaggugggguaggguggggaacauauacaucaguaaccgugauaaggcaggguggauuaagugaccagaagagguaugaacaguuuuuguauggugggccugcuauuaagauaccuguuucuaccuguaaaacacucaggauaccaaauaggugggguuuuuccucauaucaaugaccaauucuccaaugcuccagauaacagcuggguguccuacaacuuaauuuugacauuacccagaauuaacccagaccccacagcuuuaagggcucagucuuagcaaacugucccccacuuuagauacaaguauuggaugcugagggaccucuguccaaguuggcuacaagucaggaguucucacgacucccuacucagguucaguaauuugcuagaauggcucacagaacucagggaaacacuuauguguacugauuuuuauaaaggagauaacaaggacacagauaaacagccagaugaagaggucuggaaggguccugaguacacaggagcuucuucccccauggaguuggggugcgccacccuccuggcacauggauguguucaccaacccagaagcucuauaaacucauaguugagggguuuuauggagguuccauuauguaggcaccauugauuaaaucauugaccccuggugacuagcuccaucuccaacccuuugaucacaugguugugauccucuguguggccuucagcccccauccugaagcuuucuaggggccaccaccagucaccucauuagcauaaacuccaguaugguuaaaagggguuuaucaugaauaacaaaagaugcuccucucaccucuaaugggaaguuccaagaguuucagaagcucugugccuggaacagggaggaaaacgaaauauuuccucuuguaucacagugucaugucaggguguccaaaagaaggcagaggucuucaggaaagucuguacaaaaggcauggccuccucuccacagagaagggcaggcccucccucaggcaguagccauggccaagcccucccacucagagggagccacugagcagagacguggaaggagaggguuuuccuggagaguacagcauggcaggggcaguggguggcaagcuggggagcacugaguagccucugagaguugaccggagcccugaggcacggggccuuacaucagccccugcgggucagacucaggcuggauugguccuccccaggccuagacgggaacacaacacugccugcucccucuuagcgggcaucacuagguacagccaggauugggcccaaaaggcagucacuggauuaggacccaguucucuuguuccugggacuuuuuaggagugucucugaaauuuaucccuuaaguaaaaagagcauucuuuaaaaccuacagagccaucgcagucuaagagcagggccuggggugcuguggcaggucuugccuugaaggagccgucuucccacagcucagugugcuccagggcuugcuggcaggcagcuuccacgggguccuggaggcucugggggcauaacagaaaugcuaucagggaguuugagggcccguuaugagucugacauacauuggcauuuugugcaugccuuuaauugucugacauauugugguacugagcugugacaugggaacgauuacuagaccugcuuuugcucaugaagaaacugagcucagagagggaaaacuuguccauaaggaacagagcuaauagugguaggcuggggcucaagccuaggacuggcugacuccaaagcucuuccugucucccuugcucugugugcuucuaaaagauacuuaguccaaguccaaaauaugcucauuucucuucccucaggugaagaagucaaaggaaucuuuugaagugaagaaaguggguuuggacgugcccuuaugcugaugaaucauuggaguaauaucugggguuuagccgcauccuugguggcaaggcgguggggaaagccccugagggugaggccagccugagccccaagggaaaggggcugcugggaccuccugaccucaacucaucuccaggagcgcacagggccucgcacagaugccucagucuguaccgcugggaguucgugccaucucagaccuacccucccuaccugggcuguaccuaaagagauacugcuaggcuuucucuagaauguuucaugagccagcacugugagacauuuucaagcuaaaaacauacaguucaggagacuguaaucugugguagaaaguguucaccauuugcugcuaguaaagacgguuggcccugugcuucucuggccacuugugccacaugguguucucggaagaggccucuccaugcaccaguguggagaagcccucuggaggccaauucaaagagcaucugaggcuaagcaacugaaaggaaaaggccugauggccaacguguugcuuucuguggaauguuccagacuggauugcugggggucauuuucuuuaacagcagccuagacaggcagugacucucuuuuauucagccagguguugaaauagcugcagggaagccacagacaguuguuccagcuuuccggaucagagagcacugguugggccccgugccauguggccccagccccaugggaucgcuccucaggucauggagccacacaucaguguggaggguucgcuccagggguuccugguacaggaugcagaugggucuugucuggcuccaggcuuuuuguuucuaauguuguuucuagagagucaucaucaccgcauaaaugguaucaaagcccuucuuuuaaaaauguagaaauaaauguaaaugguagaucuugacauugcuugugggauuaaguucuacaaagaauaguaauuauuucuauggguggcugacaauuagcucuuuaauagaauagguggcuccugccuguuuucagugaagacauugagcuguacccacaguuuguuuguaaggagacagaagugaaccucugagucguuguucauuagaagacccagaaccaucaggcuggugucccugcuuugcaaacacaagacagaagagaucaaugucacuucugagugaucacauugguguuucaguuaacugacucaaggcuugguuggauagauauuaacauauucugaccuuaucugggagaauacuggucugcauucuuugcaaacuucugccauuuccucuaauuuauuaccagcauaucuauggguccuaauaaaucuuccauuugcaauuagaauauccaaauaaaaauccauguugacugcuaauaaggaccuucaccuuggcuuuaccaaggcauuaaugauuuuucuuucucaguaaacuuugaugccugauuuuaaaagcuaaaaaucuaccucuaaugcuuguaguaaacaggccaauucauagcuaugccuauuuauuuuaguuaacacuuaacuacuuugugacaggcacuauuguaagugcuuaaagcuauuaauccauuuaaucugauaacucauuguucugauagauucuccuucuuucccagauaucuccucuaaugggaaaguaauuacacacuaaaugguaaaagguagaauacaguauaacuuuugaaaagagagagaaacugugugggcagaaagauugcacugcaguuuauuugaaauguccuccuggauugggaaaaucucugcagccuggcacacuuacugggcuuuucuuccauuccuccgaucagccuccucauccuuauuaucagcacucaggcgcccacugucugcucgaacugauucucauggcagugcccgagagggggaagucauuguuaacuuggaaguuguuacuguucuacagaugugugcacguccuucaguaagaugacauuuuaaaaagucagugucauugaugcaggacuuuuugcuccuuaauucagcuaaaucuggguucuugucucaugaccaggaaaaauuaggcauguggacacauugaagggugagaagggcagaacuuauuaagugaaaggaaagcccucagcugggcgcaguggcucacuccuguaaucccagcacuuugggaggccgaggcagguggaucaccugaagucaggaguuugagaccaggucaggaguucuggccaacauggugaaaccccaucucuacuaaaaauacaaaaauuaccugggcuugguggccgcgucuguaaucccagcuacucaggaggcugaggcaggagaauugcaugagcccaggaggcagagguuguagugagcugagauugcaccacugcacuccagccugggugaaagagugagacuccgucacaaaaaaaaaaaaaagaaagaaagaaagaaaagcucucaacaaagagagggauucuccaagcagguuucucccucauuauugaauaccagggguaccacacaugagcugaugaggccaggcuccuccccugcguaaggugcgaauccuagugacuccgccccguucccccagcacgcacacgaggaugcccagguaaaccauagguaguaucggaaaaggcaacauuugauugguuaaaaggcauuauucggaaagaaucaauugggaaagggcagacaaacgggcagacguucugccccugggucgcugguuucaucugggaccagcaaucuggucuuucagacuucaggcuguucugggcuugaaggugaggucucaccggggacccuucccuaucugccuaggcauuugucugccuccugcuuguaucaucauuuucuuaauugccugcagugacuuuaucaagcccccuccugagcugcguaauaauaauacuguguuaggauuuucaguguuauuacucaucaucagcccggacagcccagaauuccaggccuucuuccuguuaaacgaacggagagcagagccuuugagcuccacaguucacuaucucugugucagccuuaaccaucccauuggccuguuggggcugaagauaaauccccaggcauuaagcauauuccaaaagggaauaacuccuuugucuuuggcuuuuugaagugggcuaguuuucaggacauguaguuguagaucucuccucaccagcaaaggaggacucagccaggacauuuucaauuuucuccuuucugcugacaggguggugccuuuucagugaagucagcugagcugguuggacauuugugggcccugugugccugcagagccaagcucucugcaaggcacaggugguggagagauagagacaagcagcugcccucagggagccgcguaccccuucggcccagccuugugagucagagauaagaaugagcagcucaggacuccacuggacccucacaagaggugcugccaagggaagauuccugacucuuuccaaggccccucgcacaccuguggggcugggcuugcugaaaaacuggacuguaguucucuuacuggauccccaggaagagcuuuggccccuaacaucuuccacccugcauuccccaacacacacauagacacacagaaacggggaagaaaauugccucugaacauggcuuugaaaauaugucucuagggaugcagagcaugaaaacauuuccucgcacuggaagagagaaaucagcaggcaucuauuaacgaauuuaacaaucucccaauucauuauuuuauuuuauguugguacagauauuuacagagcaguuuaaauaaagaaaacauucaccaguauguagccuuuauacacuugaaauuaaguggccugcaguuauuccuguuguuuggcugcugcuugcuagaggugguacuggauggaaagggguuguuuugcuccuuccucucguuguagucaccagagaagaugugaucagagagaucauaaggaugugagaaaauauacaauguguaugaauaacgcccauuaaaauuucuuaugucuuacggauggaugugggggguaauggcugguucuacuaaaaugcuguguuuucacauuuggggaagauucuggcauuugacaacuuaucagcuuuuuuggacaguauuguugcaaauuggcauucaaauccuaugcuguccucacuauucugcaaagaguuaagggcugaaaaugcccuuaagucuucccagaguggagaugcugggagcagagguuguggugaaaggagaggcaggccguucuuagcaggcuucucucucuaaggccugugcauucgccuuuuggcacuuggccuaguggcuguugguguggcuagaagaggagugggcagugagcuugucuuuguuggggguggcugcagagccacuccuggcugccgguuaccggcugccuccugagcaugagcccuggcucaucuggagccucuuuaaagguagaaaauguuugccccagugccagucagcaccaggccugaucuucaccuuccugacuuaguuaaggugcaaagucugccuucuaaauagugacugcaggcuagggagucacuucaggaucagaaggaguuaaaagaauguggcuaacuuguuuguguggauguucauuuucugagcaccuccacacacauuaccucuuaugaucuucauauaacaacccuucaaguucggcaagguagcaggugcucuuccuguuuacagaugcugaaacugaguccuagaagcagagccaggccuggagcccagggcugcuucccccuucccaaagcugccccuccccauuccccugugcacaggcacuggcccugaguuuucacaaagccugguuauuuauucacaggggaguccucagcacugccucuucuauuucccuguggaaaccucaaaagagaaauccugccaaaagcgcucaaggacaaaggcgaguagaaugcuuugacugcaucccuuaccacuuugggauccaccaggagccuuugcagugauagaaguggguggcccugcagagagcacacaagggagagcagggcuggguuggauaagccaggccaggagacacagagaccaugcucaugggaagaguggacgugcagucugcacuuuccuuucuuuggauccacucuucccagcuuguuagcucaagcuaggagcacacagugugucuccaguccuucaccaagaggacaggagaucgagauguggagguggccccugggcagauaacugaggugacaaaccauagaauugguuccacauguagaagaaagucuacaaauguagccgaucuuauaauagcaugcagcacccuccagccgagccacacaagcuccaccugccccuccagcuccaccugccguggcucccaagacugucagcaccuagaaaccaguucuugccucugaagcaugcugccguccucgaugcagaugucuuagcugucaccugcgcaccuuuugcugucacauaguuagucugggagcaaagucuaucagugguuuggaguaccagcuuucggaugagauaaaaacagauuugaauucucccucuugcuguuuauuagcuaugugaaugaagguaagugauguaaucucucugugcaucaguauccuuaucugugaaauaugguuaucuguacauaaccaugguaccugccucauagagguguucagagaucauguagcaugacaccuuguucuccaaaggcaagcucuccauggaacuaugacuguuacugucucucccaggguuuugaagcucuaauaguccacaugagcagugugacccaggaugaccuuagaccuuguaacuuuccccccguauuaaaauggagcuagaucguaucccuucuacccauaucaucugucuucuaaagcuaccaggaauaaaggcagaggacauuagguaauaagaucagcaaaaucauuagcuuuucgggaacaagaaaauaccaggauaaaauaagagaaagcuuggucucaguuacccuuaaagaaauaauauauaaaucagagguuugauacuucaguuuauuucuuuaguuuucagggauaugaaauggcaauagguugcuguuuuaugcugaaguuaucauuucuucugagagaguuucccauuuuauuuucagaagccugaguuuucacuacuuuucaccuaccaucuggcugccccucauaagucaauaucugacugaaauugcgugagucccuucagugccuagcgccucaucaccagcccugaaaaccccugggaauauucagagucgcugaauggcacagggaggaaugugggaaaguccacggcuuaaucaguucuuguacaaguggacacacugaggcccagagaggggacgcguggccauguggaggcacagcuggagugcagccggggaucuggacuccaggccucucccaagagcugcccuuccuacacuugcuggugucaugcaaccagucugugugggauccauggagugacuagggacggccuuguguggacaaaccuacauaagccugggaacaaaaggcauucuggguacaaaugaaggcuuugguuucugggccuuuguucuuuuucugccgucucagccuccucuuccaccggaccacuccacagcguuuagcaggcugcagaggacuguucaaggccucucugcugagucuggccucucagcuuccaagcagcucguuccaggaggguggugcuguauugggagguuucaccaacugugcugugaagugguggaggccccauugugugcccagugcgguaaagucuuuccugcuuuugauugugcccagggauugccauggaaagcauaacuguguaucagacaguugcacacccaggaauccaagggaaccugaacagcuacuauucccagcagguacguggcguuugggggcgguucuggcagggugggugcccagguggggaagcagagggugaagggcacgagcugauagauguugguucuauaugugguuucacuguccccagcugucaccugcaugccuuuuccugucacauaguuggucugggauucuagaauuaggaauggaaacaauuuugugguuguuucaugaaaugucuauugcaagcugguuugaaaucagugauuucgguaagaggugcuuguaguagguggucuaugaaaucucccucuuuggagagauuaauguggugacuuugaggaagugguaaguuuuuauagggguuaaaggagauaauuuacgcaaagcuuuuuguacagcaucgaagauacauacaacccugagguaaauaguggccuugauguuaucauugcuauucaucauacggggaugcugguggagcuggaggggcagacacuggagagggaggcugagcccauagugggaagagcugacaguggccaccaaggagucuggauugaauuugggaguccguggggacuguuggaggacucaggcaggagaauggauagcucuugcuugaguuccuugaugucuucagcauuuauaugcaguaaaacaccucccuuuccucucccagggcaagcuucugaaugucuugccugguauugggagggccugauaggacaaaccaaaugcaaaaaggccaggcaggcuugucugcuugcucugcuuccagagggagggagcauugacagggagccagcacugccucacaccacugccucaugugaucagugccguaugaccacaggagcuagaggcauugucuaggcugcugggcacaugagcuccgggaugcccauguccucuggccaggcagacacagaccuggggcagcaccagcuuucugauggcagccugcucuuuccaacaguucccuaccagaauccugccucacuggagcagaggaugccagcaucagccgggaaccacuccugugcuaaaaccgccuugguggccuguggcuugaggucuugaugcggaugaagccggaggaauguugucucuccucagucucauggcaaggacugaucuuguuuucuguuccccacaggggguuccagccagcaucacauuuuuuagucccucuggccucacauacagucucaagcacauucaggaguuaucuggugacaauaucgaucaaauuaagguaaguuauucaaugagcuuuuggucuuuuucagauucuuuuuuuuuuuuuuaaucuuuaugaauuauccuagggcuucaaugucaagugagacaccccuggccuagcaggugccuuagaauuggaagggcagcucuaccuccugcugggcuguugcacagauugcucaccuucucccagcccguuuccucacuugcagcauggggauaauugucucucuguggcuuucauagacauguguauggucuucccugcuuaggaugagucucaggauuacaugagggaauuugaguaaaguccugaauuagcucagggcuugguacagguguuaacauccuuuccuuccuuucccccaucuuauguuugccauuauugucuauucuaaaagcagucaccuuuuucauaucuuuuaaaggguuuacauucucacuuacuagggacuguauuuauuaugagucuacaaauaaccacaacucuugugucuguaauagaaacacccuugaacuggcuccagagggacugaggagagggugcaggaugugacccagagcccaaggacagacacugccacucacugcagucaggaagagcaaaaggcuucaccugccuucucacaggugcaucucauguggggaguaugcaccgcucucccaguuuuaaagauggagcacggggcucagagacaucauauggccugucuguaggucacacugcugagaaggaagagcugcaguugaaccugggaagacugauuccacauugucagccauggugaugccuugccauggucucaggagcugcugagcaguugaugcacuucugggcaguaacugauacaauucucacaccaguccagugguggguauccagaaaaagaggucaguguuccucauuacaggugaggacacugagggcuagagaggugaaacaacuugccaaagucauguuuugaguuccuagaaggcccaggacucacacaggucaccgaggaagaaaaacaauaucugaaucuugugguuagaaagauuagagagaggccgggcgcuguggcucccaccuggaaucccagcacuuugggaggccucaggcggaucaccugaggucagguguuccagaccagccuguccaauaugaugaaaaccccgucuuuacuaaaaauauaaaaauuagcugggcaugguggcaugcgccuauaaucccagcuacaugggaggcugagacaggagaaucgcuugaacccuggagacugagguugcagugagccgagaucgcgccacggcacuccagccugggugacaagagugaaacuccguaccugccccauaaaagaaaaaaagaaagaaaaagaaaaauuaaagagauaggacccauaaagugcuuagcauggcaacugguccauaugaccagcgcuuacgucauauugcaggucaggaugggucacggugcugguccugcucugguucuugucccucugugcccugcugccucuccccugggccuguaggaggaguccccaccuccaccccacccacccacccccaagucacacaaugcugugagaugccuggugguauaagccuaacacaguuuuccccaagcuucuuaguguuugccuagaggaagaacaaaagauuuauacucuaucuucuuucaaagugagcauauuuaaaagcacaaauggauacucagcaucugaaccaagaacucaggccuuucugaauagacugcugccugcauuguccacacccauggcagcugggggcugagugcguguuccuauccuguaucugucacacccauuucugcagcccuccagacacucugaggagcucucaguagcccccucgccucuuacuacagugauugauuacccugccugccaguaguuaacaccucugccauugcugaggaggagaaagugacagagcuggccuugcucacagugacuauggacugcuugggggccacgaaggcacuguguguggguugugaguugucccucgacacugggacuuggcgcuggauagugaggugcuuucaagguucacagaggacacaguccuagcccgugaguugguaguuaggcuuuucugucucagcucagccucagauuugcuacuguccucccuccccaggagucccuguagggcccacuguuuguacagcauugcacaacaugcaggcgcaccacaaaagaucaaagggggugacuuccgaccugaacuugcuacuuauccauugacuugggaagaccacgcacuugucuauaaaugccacagagaugucacugcaaagcaguagguaagcagauucguaaucaccaccaccacacuaauggcagcagcugaauuuccuguguacagcaaaaugcccuugcagccugugagguggguaucuucacaccuagugcucacuagccacaguggcagagccaggcugugaacguggcugcugcccccaaagccaggcuggugcacucacguccaguuugugccagggauggagaaagaacguugaugcugggcccccucgccuggccuggggaagacugcugcucuguggggcagcaucaugugagcauucauugacacaggagugaaaggcuccugugaaaaagcugcuguuucaccaaacuguugauaccccugcucuaggacuacagucauguuugccauuugcugguucccagucccagggaguuucuuuuuuucaaauuuuuaaauagcuuuauugagauguaauucacaaaccauaaaauuuacuuuuuaugauuuuaauauguaaacuuaaaaauuuuuuuuuuauuuuuuuagagauggggucucacuguguugccuaggcugaucucaaacuccuggccucaaguaaucuucccaccuuggccucccaaaauguagggauuacaggugugagccaccacgcccagcccaauauguaaacuuuaacaugauuuuuaugagagucacagauuugugcaaccaucaccacugucuaguuccaggacauaucaucaccccaaagagaaacccgguacccauucgcagccaccccucauucccucauuccucccacuccuuggcaaccacucaacuguuuuucaucuccauggauuuaccuauuccggacaucucauauuaauagaaucauacaguauguggucuuuuguaacugacucuuuucacuagcauaguguuuucaagguucauccaugcuguagcugguaccaguacuucaucccuuuuuagugccaaauaauaguacaugcugaggaccguuuuauuuacccauucacuaguugauggauauuuggauuguuuuccacuuucaggcuauuaaauaaugcuaaacauucaaauacaauuuucuguguggacauacauuuucauuucucuuggguguauaucuaggaguagauuuacuagaucuaagguaacuuuaacguucggucgaauuacugcuauuuuccaaagugguugugccauuuugcauugucacuagcaauguguaaggguuccaguuucuccauauccuccauguccuuauuuuucugucucugauuauggccauccuugugggucugaagugguuucucagcauguauuugauuucgauuucccuaaugacuaacaguguugagcaucuuuuuauguguuuguuagucauuuuuauaucuucuuuaaagagauaucuauucaaauccuuugccuacuuuuaacccagguuauuugucguuuuauuguugaauugccagaauuccuuauucugaauacaauuuuuuuuuuuuuuuugagauggugucucgcucuguugcccaggcuggagugcagugacacaauuguggcucacugcaaccuccgccucugggguucaagcuauucuccugccucagccuccugaguagcugggauuacaggugcacgccaccaugccuggcuaauuuuuguauuuuuaguagagauggggguuucaccauguuggccaggcuggucuugaacuccugaccucaggugaucugcccaccucggccugccaaaguguugguauuacaggcaugagccacggcgccuggccucugaauacauuuuuuuuuuuuuuugagauggaguuuugcucucguugcccagguuggagugcaguggcacgaucucagcucacugcaaccuccgccucccggguucaagcaauucuccugccucagccucccaaguagcugggauuacuauaugcauuuuuaguacagaggggguuucaccauguuggccaggcuggucucgaacuccugaccucaggugaucugcccaccucggccucccaaaguacugggauuacaggcaugagcuaccaugccuggccucuaaauacaaacuuuuuaucagacauacgauuuguaaaaauuuucucccauucugcgaguugucuuuuuacuuuuuugauaaaguucaauuuauuguuuuuuucuuuuguuucuugugcuucggguguuguauccaagaaaccauuaauuuaguguugcuuuaauucaguguuuugaagauuuacuccuauguuuccuucuacgaguuguguaguuuuagcucugaacuuagguauuugaucuguuuugaauugauuuuuguguguugugugagguagggguccaacuuuauuuuuuccucagggaguuuccuaagcaaugggugcuuagcaaggcaguacugugggcggggugggagcggggccucugcaggacaguggccucccuccccucguucugacucagccggaggaaggagccucagucccgcagcauccgagguuaugcagagguacagguggcuuguuaccuccacuaccaccuggccugcugcucacuugcugggagggaggaugaagcggagugcugggcaggggcugccaauguuggaugcucacuugcucccaaacagguuugggguccacagucucaaugcagaggagagugggggaugaggaccuucucucauuuaacccccacacuagcccucugaggccaggguaacugugccccuuuuauaggugaggaucagagaggcuaagggacuugcacuaauaacagcuagcagggggcagagccgggacagaagcagugcuccaucccaggcgaggcucugcacagaaccaucgagccuguggugcuuguucagagagagauguccuguggaugaggccagugccccggauuggcugauuggaaguaucacgacaacauaggcagcagcccaugacggucauugagcuuaucucugggccaggccaagugguucacaccugucaccucauuugauccccacagcagcccagugaagaguccuguuaucuuuucgguuugacagaugaggagauggaggccagagaggaugggccacgggccaaggucauuguccuguggagcugggauuuaaaucccaacccugugcccacagagcccugaccuugauggcucuacuuucuuggggauucagucacugccccugccacaccauccuccccuugaucagacccagggcccccaacacccgaagaagaacugucugcagcuagagccucugaggaaggacugcacugacacagccgugauggugagcaccagccuggggccuucaagucccugccccucaccugagccuggcgacagucgcucaggguggcagacugaugagagcguggaugcagagguauuuugcacgcucagaagcugggcuagaaucgggcaguguugucauuuuuauaaacacgucacaugagcaguaacguccaaccgcaaagcuggcugacggccccugcacacauccagcugccugcugccccagccccuccuggugugcugaagcccuguuuucucuucugucuuuauaguuugcagccaucggccccacuacggcucgcgcgcuggccgcccagggccuuccuguaagcugcacugcagagagccccacgccacaagcccuggccacuggcaucaggaaggcucuccagccccauggcugcugcugagucagccaccuagcgcuggccccaugcagccucccugggcugggcuggcucuggauggagccaggcaucggcaagggcucucgggagcugcugccgucagacuccugccucaagccugaguggaagcaccugaggaccggggaucgggaccugaccuggggcuggccucaggcccacgugcacgugacugcccucuguggaagccagcuuaaacccuagcccugugagagcuuccugugcccagcaggaaggaagucaaauaaaccacacugacuaccugugcuuacugaguguaugguugcugugugucauuuuaagugcaaagcuguguucagggaggagacagguaugcccaccucugauaacccacaaaccugcuaugaaucagaaaauuugcucuauauaaaguagguuuauucauucuauaaaaaggaccgugaaguuccugcuugugagccauggacaacugugguucaaauauagaaagacuugcuuuc

SEQ ID NO: 15445 - RNA, 2316 nt, Homo sapiens
uuuuuuuuuuucagaucugaaaauaucuuuuuuuuuuuaggaaaaagauuccaggcagguuaaaaauuaacaauagaggguaucgaugcagaauuguagucauucuaagcauucaagaaauacgggaauauaaauaucuggaaaccggcucuuaguuuucaaaacaaaagguguaagucauuccuaacuaaucugagcuuuauagcauuuuccuagauaggaaggggaaaaacaguuaacauuugaaaguccugaaagcuuuuucuuugguucauuacguuagacuguuuaccuuugaucaaauuccuucuuuuuuauuauuauuuuuuuacuuuuuugaaacgaagucuugcucugucacccaggcuggaguucaguggugccaucuucgcuuucugcaaccuucgccuccuggguucaagagauacuccugccucagucucccgaguagcugggacuacaggcgcaugccacgacgccugcauaauuuuuuguauuuuuaguggagaugggauuucgccauguuggccaggcuggucucgaacuccugaccucaggugauccacccaccucggccucccaaagugcuuggauuacaggugucaaccaccuugcauggccaaauuucuucuuuuuuaaacacagauaaaaauauuauacagguccacuguuaaaauagacaacauguugcaaauuaauuugauauguauuccaaaaaagcuuagaaaauaaagguguuaaaguugcuuuggacuaaguuuaauagucaucuccucugcugacaacuucuuuacauguuggaugcaacacuaugguauguucaaacugcacuguguaugauccuuuacugucacacaaugguggauacaauuuccaagucacagauucuucagagccaucaagaauuuccuuucucccaagcaauccagccaucuguggcagaaggugagggugccaaaauuuucacugaugacauuuaacaauuauuuuguuuagaaaccuuacugguacauguccaacaucaaaauuuuucauguaauaugaacaucccauaucaucauaucuuuuccuguacuaucaaugguuucaauugcauacacuuccuuuccuccauucuuguugcuucuccuccuuucggaauggacacuguuuuuccagcauguauucuauauuucccgauugaauguccauuuagguuauggauugguuucaccuguugugucuucccaucuauuucaacuucauaggacuccauaaauuuuuggauggacucaccaacaucacacagaugaacaucaauuccagcacacuucauuccaguaguagcagcaucuuuuacagcuuuuaaucauguaucauaauugggauuaaaagugacaguaagaccacagucaguagucaauauuccuaccacuuauaccgauuccaaaaucuauuuuacagauguuaucuuacuguaauacuguugugucaccagcaaugggaguauaaugggcagcacaauuauugugagaacuuccagcaggaaaugccaggcaugcauuuaauccauuuucauuuauuagauugugugaacaguuuuccaacuuuucacagauuucuaucaucccaggcuugauccagcucauuacauauauucucacuugucaaugugcuucugcagcuucucaaaaaucauuccaaaucucuucccuagccugaucuaacacuuucuuuucuucacucauaauucuccauccaucuuguguguguggguauucacuuucuuguccuuugggaaauacacgacuaggauacagccacauauuggaacugagggagggagggucuguuggaauuuugguuguuucuucuuccuccucuucuucuucuucuuccucuuccucuuccuccuccuccuuguucuucuuccucuucuuccucuucuuccuccuccuccucuucuucuucuuccuuuucuucuucuucuuccuccuccuccucuuuuccuucuucuuuuuccucuuuuccuucuucuuucuaguugcuccaucuccaucaccaucuccgucucaucaucaucaucucuuucuuucuuuuccaaugcuugucuuuccaguugucuugcuccuucauccacugaggcucuuaauccuuuaucaguuuccugcugcccugcugcagccccuuuacucuucuuuuuccuccaucuguuuuucuuggcuucuuccucaguuguagaggcagcuuccuccucccuuucaucuggauccagguugccauucauguagcucccaaaggucgcugccuccuccaugccugccauguugccugaaa

SEQ ID NO: 15446 - RNA, 656816 nt, Homo sapiens
  misc_feature (22104)..(172103): n is a, c, g, or u
caugacgccgccuccgccgcaaacuuuuuccuccccauccugucgcggcucgaaaggaauggaaaauggcggccuagacgcggaguuuccugcccgacccgcggcggcuccggcggcgccaugacgcgcugggugcccaccaagcgcgaggagaaguacggcgugggugagcagcgccgccgccgccgcgccucucgccccaagcccaggcuccggcggggcgggugugccgggcgccuguugccgccgccccgagcggccgccgggccggggagaggcgcuuccgcccgcgcccgcgccgccgccccgcucgcaaugcccggcgaccccggccgccccgcgcccccggcggcgucagcuccagccccggggaugcgggucgggaacacgaggggguggggugggaaugggggcgggcgcgucccucccuaggguguccccuccgacgcccgcuccucuggaccucugccguggagccccccgggcuacccccaacuccccggccccggccgcugcuaucugcgcggcugggcccgucagggaagcccaggggucacugucucgcggcggcuucugcuucuuggaugaacuugcgucccgcguccgggcucugggugggcgggcucaggucggcgcggucccagcggauaauuccgcccuuucccggcggggaggagggggcgcgaccuggguggccagcgccccuugccccucggcggucucgcuggggaccgugugggaccuuggagagaaggcgagcggccgagcgccccaguggccccaggccuggagacccuuccgggagagcgggggccuguuuuugcuccgcggcucuuugucgcuuccgaggggggauggaaggagucggguugcaaguuuacauuucggacccgagugcgcauuccugagagggaggcuuucccuugcggcugaauagacgggcccguccgcgugggacccgcauccuugcgccccggggacccgcagccggucgccgaggccugcggacgcccaccucuucgugaucugcgcgccuggugucgggacugggccguggcuacucuccugcucucccggguccgggaucuucccaguugguuuucgggcuugcuauuccccgucccaccauccacagacauccuugaccgccugccucauccaggccacucgacccgacugggaagaccuuugguggucucgccucccacagcccaggcuguguccuccaagggcaccgucucagcagcagccccgcgcccauucugugccuggcccgugcuggaccugcccgacccucugcuggugugguucgaauccuggcucucugacuuuugggaagcgcccuggcagcccuuguccccggagcgcucuccuuucugugaacaguugcuucucucugcugucaaugacuuacaguaugcccugaccacggagccagcuggacaguggucacggggacaguccugggacagcccuggguccuaccgggccugcacuuagcuuguuccacaugcugggaggcauagggggccuccuugcuucaggaccauuaugacugagcuuccuccccaucuccccauuuugcagaugaggaaacugaggcccagacacauucacaaaagugcaggagagcucaucugacugcagacucaguguguaaccugcacccugugcaccaccuaauggauucagucuggggcacuuggcacgggccuucagucugcaucagaggcgagagguucgggguggauauuccaccugagaaugcuuggguuguggcgacagugggggucccugcggggguaguguguagaggagagagcugaggacugacucccagggaaccuagcaccagcacacgcagagagagaggaagagguggauaggcaggagaggcaggaggcuggcagaggagcaggcaucccauagcccuggcccugcugaggaagcaacuuaggugcccauggccagggugcaguaguggccauuggggguguagugggggccaucggggugcagugggggccaucacugcucccauucuacagaggcaaggaagagguggauugcuugccugaggucacaucaccaguaaguggugccuccugggugugaaguguggccgcccuggguucagcugccacaguguccugugcuugccugcagauggggagggcuucucuuugggacgccacauuuuaagagaccuuguuacccuucgucugcccccagagagaccuggauggugucaguuaggauccuauaguguagcuggauggucuggagaagacugaaaagaauguucguagaugggagaacggggucuccuugcuggggaggaggcugagggccagaacagggcggugcgcuugagucucacaccuuccagaagcuucaccagcgcucaugguggugacuucuaacaucacaccucuugcuaauacuuugguuuuaagaaaacuccauguuugauuauuaagaaaaaauaaauuuaaaaaaguuaaaaaaagaaaaaauagaaaacuguuggaaaauuuuaaaaggcgaaaaguaucugggaugguuuugccaggaaaugcuaggaaagaugugaagggcugaagguagagaagagaguggcugcugugcuuccucucacugggugcagaugacagcuugcuggguagacaguaaugagacagcaccacuccaucggcauccagaggcacuuuaaccagagucccccaucagggagggugggaggggagcugagcaugagcgcaauggggccaucccaggcuccccacuugucugcaagugugcagugggaggauuuuagugguucucacgaaggaugcugacugggaaggauguaggugcugggauguagggauuuauugccaguaggugauuggcuguuuccaccuaagggaaaauuacuggaggaccccuccaccauccuuaccaacuccagcauuuuucggagcuuaacaacagggcuguguuucccuggaggcgcucugguggcucuguggguggaccacacuuccacucuggccacuuggcccaugaacgaaucacgagggguaagaaaaugauaaaacuccaucucauuuggaaacaugaaucacagcuuauuguuugcaaguacuuggaaucuguuagaagcauuguuuguaaaugagauacuucaguuguauauuuauuuuguaaaauugggaaaggaguaaacagcugaucugggguuccuucugcaaaggcaggaaaugcugguuccucccaauucauuccacugggggcugccugugaaauuuaccagcccgcguuucccccuugguuuugaguuggugggucauguuuacgggccuggcauauuaacaggcauaaaccuugacucagcugucacacuggccagaugaucuuuucucucacagcccaguaggcaguuuuaugucccgacgucaauaaaauuauguugccauggauccuguuccuaagauuaggugaaaagaugcaguauguucuagaaucacacgugaggaccaugugcucacucacucacaucucaacaaugguguugaaggcagaauaaugguccccaaaaagguccacgcccuaauccccagacucugugaauucaauauguuacauggcaaaagggacuuggcagaugugauucagguuacuuggaauucguagaugggagauuauucaggaccauccacgugggcacagagaacuuuggcugucaaaguugugaaacaggcagucagaagauccuauguuuggaagcacaguugcuggcccugagauguaggggcucacuugcaaggaccagagagaggccucagggagcuacgggaggccccuagcuaaugaucggcaguuacaaagaauuggauccugccaacacccugaaugagcuuggaaacagauuuccuccccagggccuccugcuaagagcccagccagccaacaccuugauuuugagacccugagcugcugggcguguggccuguggaacugagauaauacauuugugugguuuuaagcuggcuggguugugggaauuuguuacggcagcaguggaaaacuaauacagaugaugggagagaagcuugcagggugaggcucucuugcacccuugagaucuguuacuaaguucauugaagguagugaacccaagugugcucuucacuuuggccacuuccaagugcagcucucaaaugggauggggcauuggcacugcucuuacucauaaugggacccuugagcaaauuacucauacuuucuuagccuugguuuucucaucugugaaguggaaccaagccugcuugcugccgagucgugaggacucgcugagaugauguuggcagagaauuuagcccugcguuuaagauaugccaaguacucaacgaagcguugcuuuuguuaacuuuuuauuuaauaaagcauaaaguuuagaaacauagugacaagugacuucugugugcgguuaacggguugcuggaaaaaugccuuucuucaaaaguugguuucuugauaguguguuuugcuuccuaauugggguagaagucacauuugcucagugugaggagccugacuugcgugccuucacauuagcucuaagcaaugauaauugcuaggaauagugugauauccaaauaaauuugggagcgugggaguugaugagagaucucuuuuguuaucuagaguagcaagcaagcugcuacuuuggggaagaaaaauuagauuugaucauaaguaaauagaaaugcaggcauuuucauucacuggaauugcagcaaaaccaaaucagggcauauuauauuucuacaaaccugauuuuacuuuggaaacauaagaaauuuaaauuuauuucuaugccauuguuugccuaggauaccagacaucugaucaggauugucuuagugugugucaauaguucugucucuuuaucaccucuguggaugcagguagugaaauggggaggaagaaauaggccacgugguguccuuugcuggguguggcgcugacgccccagggccaucgcuguagcaagcgcacacuuguacgcuguucccacccuccuucccucccucccuuuucccuucuuucuuuucuuccucucuguacuuuguauuuucagaugauugcauuaaacuuuguauuuucagauaauuauagccaaaugcggguguaaaauauaauucagggagaucaugaguagccauuacuaguuucaccuaagguuacgucuuguaaagcuguaguacagcaucacgacugggauauugacaucgauagucaagguacagaacauuuccagcaccacaagcaccacgccuaccucccuccacgccuuucuccccucaaauccuggccacccuuugccuguucuguguuuuuauaauauuguccuuuaaagaguguuccguuagugaaauugcauaggagguaagcuuucgggauuggcuuuuuucacucaguaucucucucuggauauucauccggguguugcuucuuuucuuugcugaguaucauuucauggucuggauaugccccagauuaacuguucaccugucgaaggacaucugaguuuggcugugacaaauacagcugcugucaacaagcacauacagguuuuagugugaaccuaagucuucauuuucugggauaaaugcccaggagugcagaggcugagucgucugguaguuggauguuuagcuuuuuaagaaacugccaaacuuuccuggaguaacugugccaguucacauucucaccagcaguguauaugugauuguagauuucucggaauccuugccaucauuugucaccguccuuauugcuuguguagguguguaguugucugucauugugguuggaguuugcauuugccuugguuucauuugggagccagcgugcagcucccugugcugcugcgguacaggagaaggcagcccacccagggggugcuggugggagcgcuguaugagcggguccacugagcugugaaauuguccaguguauucagggaaggacuuugauccaguuugaagagacaucauggaguggaaggcugaccgggcacaugcaccaguguggagaccacgguuaacaccagguggucgcuugucaagaugcgguugucaagauguucacuuuucaaacccuucagugcauccggaaggccuucagggaggaaaugaggaggcgcccgaggaggggucagaguuugaguuuuagcccugacaaggccacuguucaugcauaugacccagggugaguguuugaaccucuuccagccugguuucugcguuuuuaagcagcgauguucuggaugguacugugggcuuugcuucacugagguugggcugaugggaguugacaggaacuaauuaauguaucuuaaggcaguuuggaaacauuguuaugcaaauggauugcauuugccaucagccacuguuccucaauuugcuuuuauugauaugaugggaagugcuuuggagcugacguugaaaucacaguguggaauuuguguguuaguugacuggagcuaccauaacaaaggaccacaagacaggguggcuuaaccaacaggacuguguuucuucacaauucuguaaugccggagucaagguguuuuggugguugguuucuucugagaccucucuccuuggguuacagacagcugucuucacccugucuucauagggucuuccuucggugugugucaguguccucauuuccucuucuuacaaggccacuauggccagccucgguggcucacaccuguaaucccagcauuuugggaggcugaggugggcgggucaccugaggucagggguuagagaccagccuggccaauauggugaaaccccaucucuaguaaaaauacaaaaaauuaaccugguaugguggcgggcgccuguaaucccagcuacuggggaggcugaggcaggagaaucacuggaaccucggaggcggagguugcagugagccaagauugcgccauuguacuucagccugggcaacaagagcaaaacuccaucucaaaaaaaaaaaagagaccgggcgcgguggcucacgccuguaauccuagcacuuugggaggccaaggcggggagaucacgaggucaguagaucgagacccucccggcuaacacggugaaacccugucucuacuaaaaauacaaaaaacuagccgggcgugguggcgggcgccuguggucccagcuacucgggaggcugaggcaggagaauggcgugaacccgggaggcggagcuugcagugagccgagaucgcgccaccguacuccagccugggugacagagugagacuccaucucggaaaaaaaaaaaaaaaaagaaagaaaggacacuagucaugcuggauaagggccuacccuaccguaaagaccacacuuugacuuagucaccucuuuaaauucccugccuccaaauacagucacacauccaggaugcugaauuucugagguuagaacacugacauauggauuuggagggacacaguguagcccauaacaguaugauuuugauaacauaagacuuuucaucuacaguuucccucugucuuuaguggccuuugaauuuuuuuuuuuuuuuccugcaagcccaugggucccuggugcuacuggacucgagggagguaaggagcuuucuaaugggacuccaauuuguuucuguucagaucuggaaauuccuuguaaucaaauuagugacagaacaaugcaaucagguaguuugagauccaaacaggaacuucagagcaguucuuuaagugugaucauucuccugugaguguggcucagucucugagcucaaccuaccugggcuuaagcugcauuuagcauuaggauauucacacauccugcuuggacuuaauuccaguuucuuaccauuuauguuuuuguagcaugaguagggcagccucauauuggcucuggaaucccaguuggacagugauggcaaaacccgggcuuuggugcuggugucacacacuuggugacccagggcugucccacacaacuccagggggcacuguucuucuccacagcccacgaggcuggcuucuguccuccacucgcaccuugcguggcccuccguggccuugggccgucagaaaagcgcuuuaauaucaggagcucauggggcaagggagggggcuuggcucgugacaaauaaaugacaccgggcuucuugaugaugacuuacaagcucaguuuuggccugccacucugcaguuauccacaugcccacaugcacgugggaaacugaguauccacgcaggcacucccugucuucaaaaggcagaugguuucaccccagacagaugucugucaguucguugaauuuucauuugggugccuugaggagaaaaagaugcuuucucuuggcauauagugugugcugucaaaacagcucagguuaggggucauagagauccgucuuugaauaucagccuggugucuuauuaggcaugucaccuuggggguuauuuaccuuaagccugaguuucuccuuuguaaaacuggugauaacaccaaccucuuugggcccuucugaggagaaagagauaaccuagcccaaaccgggcccauggucugugcuugauaauguuaguuucuuucauccuuuauugauugcuuuguaaguagaaggcuguguugcuugggacugaaucucuagcuuaauucaggcucuccccagcccugcugcaugggccccauugcuucuguagccccugccuguugcaaagugcuggucagaauuuuaauguuagcucugagguuagaucagggacuguaguucuuauugauugcugggggguccugaagggacaggaugaaggcagaucucuacaucucucaucagaaauguuaccuugagucuuuaucuagaugcaguugcuguuuagaccuaugauuuguugcugcaucuccugaggagugugaugcaagauuuuuaugccauccugagugauuuguuucaguuuuaaauuuuauuuuauuuauuuauuuuuauagacaggcucuuggucuacuggccagaccagagugcagugaugcgaucauagcucacugcagccuugaacucccaggcucaagugauccuccaacccuggccuucugaguagcugggacuacaggucuagcuaauuaaaaaaaacuuuuuuaaggagauugggagagggucuuguuauguugcccuggucucaaacucuugaccaaagugcagggauuagagaugugagccaccacacccaggggagugauuuaacuuaauugguuacacuagguaaacuuagguguauuuauguaacagucaugauuuccuuucugacuguuagcuagcugcuguaacaaacagccccaacauuuugcuggcuucauacaauacaaguuuguuuuucauuugugucaaagugggcgguggggagggugagcaggggcucugcucugcccagccauucagagucucuggcuccuuugacccugccagucugcccuccacugcccuuccccauucaaccuguagauggggaaagaaagagaugaggauggugcauagauuuucuuucuggccuggucuggggguggugcccaucccuucugcucacauuuucucaccgugaccugagucucuggucagaccugcagcaaguggggugggaaauguaaucugacugugugccucgcaggaagaggagaauguggauuugguggucuccuccacguguuccuauugaugcuuauuuuccauuaccaggaagaauguuagucuggacucuucagcuucauuggcguugagcauagagguuguacauccucaggacuuucacccugaaagucacuuggcagaacagauguucaugucccuauaaagacggaagugaugccaaggacagacgccgccuuuuuccuugggguguauuuugcuacuuauguccuauagauuucaggauauucuucaggguauaccaagcccgagagcagugcugcuuucucaaugugucuuuuucuuuuuugggggcgggggggggauggagucuugcucuguugcccaggcuggagugcaggggcacaaucuuggcccacugcaaccuccgccuccuggauucaagcaguuuuccugccucagccucccaaguagcugggauuacaggugugcaccaccgcaucugguaauuuuuuguauuuuuaguaguaacacgggguuuaguuacuaacacggguuaguaacacgggguuucacuguguuagccaggauggucucgaucuccugaccucgugaucugcccaccuuggccucccaaagugcugggauuacaggcgugagccaccgugccuggccucaguguguccuguccuuuucauaucugucuggcuguuccuguucccaccauccaaaaacacaugcacaccccaggccccuuuccugugcuguuuaauucuuuuggccucagaaggcuguguacuaaagcuugcuaaugagaaccgugucuuuguuuuuaaguguuuuuugucuuuauagaauggaaucucuauauucugaaauaacucuugucuaugaguauguaugcaaugagaaaggcuauaaaguuaaaucaaggagagcaacagugacuuaaaaguuaggcguugggacacuaugguguggaguuuagagcacuggauugacagccugaauaauagggucugguauuccuggguacagcacuuaacugcugccaccucugcccucccugagccccaggccccuuaccuggaguuagggcauauccuagcacaucugugcaucucagcucugcccaggggagagagcaggaccguguguguggaagagcuuugagaagagaaaguacuacuuaguguuggguuauucauguuaaacuauuauacagucaauauuaacuucuuauagagaaaauauaugauuucuggugauuguuuuaaauuggaaaaggacaguguggcauugugaguuucacuuuccucaaaguuuuaugauuuuuauuuuacuuacuaguagacaaguuuucuaguaauugauuauguugugaguagaugaacaucuugcauaagcagcuagccugggcugcuguguaaccuauguauagagacgaauggugaugaagccuguauguuucagccucgguuaggaaaccuucuguccuaagccacagaaaaguuaaagaagacucugccucgaaauaacucauuucuucccucccuucuccccuucuucccucauuccuucuguccuuucuuccuccccuccuuccuuuccuccuuccuuuccuccccuccuuccuucuaccccuccuuuccuuccuucccuucuuucuuccuuccuuccuguuugcuugccagcccuguucuuagacauugguaucuggagcugcccucaugggguuuauagucugauacagccaacucuuccauaucugaaacucucgaggccagugguguuucagaauuccaguuugucacagugcagagagacaggugggagcugugugaggccagcgguguuucagaauuccaguuugucacagugcagagagacaggugggagcugugcgaggccagcgguguuucagaauuccaguuugucacagugcagagagacaggugggagcugugcgaggccagcgguguuucagaauuccaguuugucacagugcagagagacaggugggagcugugcuuguggcuccugugccagacaccccgagcagcucugggcaacacccuggagucgagcauauugauucugcugccaugagcgugugaacauucacagcacgagggaagccauccguaauuagcuccucuccgcucagguuagacuuuugcaguuaaaugaauuacagaaaucucuuuggguuugggaacuuuguggguauuucgggcuuguggguaaugaacugucgauguuguauuuuuucacagcucaaccaacauauucagguuuugucuucucagggccugucauucauucugguucucugaucagauuuccucagacugugggugccugcagccagcccggaagcccuuuaaaaugcccuucguggccauccuggccucauucccagauccacuccuguccagcugggugccuggcugguccccggucacagucugcaauucccacuccccugccucagcuucacagggucuguggcugauccgagucaggcccugggcacugcuggccucaucacauuggccuccggaccccuucuggaagagacuuaucccuuuguuccaccccgggcuguggggacaagauuuugcgagagcugagggcccagugagaauggucuugaguccuuagggccugggagcccuagguggaagugggaaggaggaggaggagaguggggaggagaugugaggacuaagcgcacccagggccaguuuaagaggucagggucgaggacauuagaggccugucucccccaggcgcauaaagcugugaguuuuccuucuucaguuccuuaggcagaaccccuaaagcagauucuggggugauggaacucuggguaugaguucuuguuagccaggcauaguuaggagcuugggccugcaucuggacgagagagacucagcugugcccauugagagcuugugcugccugcaaagugaccugccugaggcucauugccuggucccugugaauauuaaguggcuucaacacaaagaagggacuuccaggggaggcugcccgggauugccagugcaguggggcuccgcugaugcucaggaucaccagcgugcagcggggacuccacugaugccugggauugauugccagcaugcagcggggacuccacugaugccugggauugauugccagcaugcagcgggggcuccgcugaugcccgguauccaccagcgugcagcgggggcucugcugaugccugggcuugcaugccgcugccgcugccuacuggugcguggcgguagccgccugugcccagcuggugugcuuguccaaggugaugacgguacuuuuuauugcacagaguugcuggagaguugaaugaccugggucaugucagcacaguuucucagucccugcacuguugacauucugggcaggauaauuuuucacccuggggagcuguccuguaccuugcuggauacuuagcagggccugcccaguagaucccgguagcaggaucccccuccagcucuguauguucuucagaugauuuggggauaucacugguauuuuaauaaguucuagaauuucccccauugacauugccaggaugucaagccaggaugucucagccauugccaacugucccggggguaaguggggcgggauggccuaacucaugguaaacacucaacagcugcuuacuguuacuaaugauacuguguuauuagcagcaaagucagcgaagucacuucuguauauuugggaagaaaagcuagaaaccccaacgacuuggucuggcagggugugcaggugggcacggaggauucggacaggugggcacggaggauuuggaggaggagaaagucaaggugcagaugggcacagaggauuuggaggaggagaaagccgagagggagugugggggcccuucggccaagcuucuuggcugucuaaagaucauuaggagcuggcuguguuucauucuccuucugagagacaaacaugaguuucucuugaggccaggagugaugugcagaugaacacgaauuguguggcucaucccaacauguccuuuaagaaaccccaugcaggcugcuuagagaccuuccuaaacgcaggaacucaagcauuugcuucuuggaguuuuauuugcuggaauaaaggcacuuaucaaccucuuuuuuauuuuucgaaaauaauaacuuauuuucuuuaacauaauugacuucaccagaggcaaauaccgauuuagcaggaaggaaaugugauuauuuuccuuucuaauugcugugcuucuauuaacuucacaagauuuguuuucaaguccuccuaacgucauaaguguuuuccugacaauuuuucaaaggcaggaaucguccuguuccuccaggcaccguggccaaguggccagauuucuucacauuauucuuggggguuguugcuuugagaaucagcccagugaggccaaggggaaggggaggugggggugugugcaggaggccugagacuuaggugaccccgaugacggucugugcuauuuccauacucaggcucuguggccgucagcccguugcucugagggacaaaagcuuucuuaucccaacccaggcuggaugaccccccgaucccgcguugcucucugcaguucugcgacaugcuuccccuccagucccccugggggcaggugguggcuccguguccccugcuagacggagggcccucgagggugaggccuuaauccuguugcuuucucucuucccagcaccugcuguggucccuggcacaccuugccguacauugaaugaaggcaaagggagagauuucaucauagcaaaaugucaugaacugccuggagaaccaugaguuuucuguugguggggaguuacgucuuggagggggcaccacuuccaggacuaaggcagugucggcucagcucgagaaugcagugggugacggggucagcagcccuaaaacucccuccaccccggcugugggaagcacccacugggggcuccaucccgaugggcuuccugagcuaaaaugggugcuuuguccaugcuggauaaauauguggcgauguugguggguugggcaagucaguuacacgacucuguauguucuucagaugauuuggggauaucacuguuauuuuaauaaguucuagaauuucccccauugacauugcuacaaggcaauuaaauuaaauuaaaguuccuucuuaauaaaauguuccaguaaaacacuuuccuaguccccuuguugauacguuugucugcagugacuggauuagcuggcgggagaauagaagaaaaguggauuuugaagggagauugugcuugagucacgcuuccagcuccuagucauugugggaccccaguggggcuccccagagcuuucgggucuugaucaucuguaaaaugaggguccugccaccagucuuuucugcucccaaaugcaguaaugaaaagccaaugaaaucaaaguauauaauauauaugcuaaaguacuuuguaauuauaaagcauuaaacagcuaaaaggaauaauaaauucuguucagagcacagauuggcaagcuuuuucugcagagaucuagaaaauaaauacuuuagguuuugcaggccaagaggcaaaauggaggauacuauguuaagacauuaaaccuagaacuaccaucugacccagugauucuucucuuaggugugcacccagaagaaguagaaacaguucacauaggcugguccgagugcagugguguuuacaacuagcugaucacaaccaguuacugaugucauuguuccuucuccacucccacugcuucacuugccuuuacaaaaaguucaggccgggcacgguggcucacaccuguaaucccagcacguugggaggccgaggcgggcagaucaccugaggucaggaguuugagacuagccugggcaacauggugaaaccccgucucuacuaaaaauacaaaaacaauuaguugggcguggugguucgcaccuguaauaccagcuacuggggaggcugaggcaggagaaucacuugaaucugggaggcagagguugcagugagccgaggucgcaccauugcacuccagucugagcagaagaguaagacucuaucucaaaaaaaaaaaaaaaaaaaaguucaaacaaguaguuauuuacaauuguucguagcagcauuagucacaauacuuaaaagguggaaacaauucaaauguccaucauuggaugaauggauaaacaaaacaugguaugucccuauaauggaauauuauucagccaugaaaaggaaugaaacaccgaucaugcuacagcaugggugaaccuugaaaacaugcuaagggcaagaagccagucacagagggacauacaugauucuauuaauaggaaaugugauucuguuuauaugaaauguccagaauaggcaaaucuguaggcacagaaagcagauuagugguugcccgggacuaggggagggcgugauggggaguggccucuuagugggagugucagucuguuugcauuacuauaaaggaauacuugaggacgggugagagagagagagacagagauuuguuuguuuguuuauuugagauggagucucgcucuguuccccaggcuggagugcaguggcgcgaucucaacucacugcagccuccaccuccuggguucaagcgauucuccugccucagccucccgaguagcugggacuauaggcaugcaccaccugccugguuaauuuuuguauuuuuaguagagaugggguuuugccaugucggccaggcuggucucaaacuccugaccucaggugauccacaaggcuagguaauuuauaagaaaagagguauaaggcuggacacagugguucaugccuguggccccaaaaccuugggaggccuaggcaggcugauccuuugagcccagaaguuggagaccagccuagacaacaugacaaaaccccaucucuacagaaaauuuaaaaauuagccaggcgugguggcacacaccuguagucccagcuauucaaaaggcugaggugggaggauuaugucccuggagcccaggaaguggagguugcagagauugcaucacugcauuucagccugggugacagaguacgacccuguaucaaaaaaaaaaaaaaaaaaaaaaaaaggaaagaguuauaauuggcucauguuucuguaagcuguacaggagucauggugcuggcaucugcuucuggagaggcauccggaaacuuccaaucauggcagaaggggaagggagagccaaugcaucacaggacaagagcaggagcaagagaggggaggagcugccacacucuaguccagucuagaccacacacuggucuagagucuuagaaucuuuuaguuuuagaauaaugaccauuauuuuuguaacaaccagugucucgggaacucacugaguaagaacuugguccucaccaagaggauggugcgaagccauuccggagggaggcgccaugauccaaaucccucccacaaggcccaucuucaacauuggggaucacauuuccacaagagauuuggaggggacagacauccaaaugguaucagugacuuugggguuuccuuaugcagugaugaaaauacuuaagaacuagacagagguggugguugcacaacauuaggaauguacuaaauauuacacacuacuaaauuguauacuuuaaaaugguuaauuuucuguuauguuaguuuuaccuccuuuaaaaaaaaagaugaggaccggguacgguggcucacgccuauaauuccagcacuuuggaaggcugaggugggcggagcaccugagguugggaguuugagaccagccugaccaacauggagaaaccccaucucuacuaaaaauacaaauuagcuggauguggcagugcaugcuuguaaucccagcuacucgggaggcugaggcaggagaauugcuucagcccgggaggcggagguugcguugagccgagauugugccauugcacuccagucugggcaacaagaacgaaacuccaucuaaaaaaauaaaauagaauaaaagaugggaaccauucuuagcuuaugggcaguauaaagcuaagcugugggccacauuuggcccauaggcuguaguuugcugaccucuggucuagagucuuagaaucuuuuaguuuuagaauaaugaccauuauuuuuguaauaauauuguaugcuaguuauuaaaagauugcaaacuauauuaaaguuaaaaggauguaaaaaacuuaggcauggcugggugugguggcucaugccuguaaucccagcacuuugggaggccgagguggauggaucaccugaggugaggaguuugagaccagccuggccaacauggugaaaccccauaacuacuaaaaauacaaaaauuagccgggugugguggcaggugccuguaaucccagguacucgggaggcugaggcaggagaaucgcuugaacccgggaggcggagguugcagugagccgagauggcaccacugcacuccagccugggugacagagcaagacucuguuucaaaacaacaacaaaaacaauaaaaauccuaggcauucuccaagcaaucugccacggagaaaggagcgccauucucggcaucucucuccaugugcgaugguccguacccucccccuccccacuucauacacagaaaccuaaucaccaaggugaugggauuaggauauggagccuuugggaggugauuaggucaugagggcugaggguccuucuaaaagaggccccggagagcuuguuccuucuacccugugaggacacagugagaaggugccuucuaugagccaggaaacaggcccuugccagacaccaaauccaccugccccucagucuuggacuuucccagccuccacaacugugggaaaugaauuuccauuguuuguaagcugccugguuuaugauauuuugauauggcagcccgaacagagguagauaccauguguagagagaaacaggcagagaaauaggagaguugaaggguaccccacccuccuugauuucuaguugaggaaauggaggcugugagugcuggaacugagcggggggacuugagugcuggaacugagcagggggaacugaaugcuggaacugagcagggggaacugaaugcuggaacugagcagggggaacugagugcuggaacucaguagggggaggcugugagugcuggaacucaguagggggaggcugugagugcuggaacucaguagggggaggcugugagugcuggaacucaguagugggaggcugugagugcuggaacucaguagggggaggcugugagugcuggaacucaguagggggaggcugugagugcuggaacucaguagcgggaggcugugcaugcuggaacucaguagggggaggcugugagugcuggaacugucucuggggagcccugucuggagccuuaaaaaaggcaaacggcccuugaaacggcaggguggggagaguugaccaaaagguuaaaaagcaauuuaacagaaauccaacucuucaggauucuugcuucuuccaccguguugccuccagaagaacagaaaaugaaaucucauuuugcaguuuucgucugaccagcaguuaccauggagggccagguguggucaagggcucuagaacguuugucugcacaguuucccucuuugaucucugugauuuauagacaggcacuuaaaggugggauuaauguguaaagagccuucagagugaaggaucuaagucccuggaaaugaaggauuggaugaaaguguuucuuaaggacaaacuuuuaauaauuguggcauacauacuguagcauuaguacuuccauuguacaaacucaguauuugacuuaccugccaaagucuacugcuuaccugcacauaggugcaucagcuuugcagauucuuuuuaaaugugucaacccacguuuuuaaaaacugguuuagaaaauucucacugggcuucccgccucuaucacugaucuagucaugauucaucuuauggcugggaaagcaucacuagccuggagaaacugaacggugguguugagucuuguuuucaguuuuuauuaguauuuccuguuucauacagcccaccuuucugggcaauaagccuaacauaccauaggcugauuuucuaaaacacuuuuauuuaugcacacacacauauacauguaguuagagcugggugaaguccugccaguaaccagaccugcuuuuucauuuuauccaucagaucucuuggugucuucucuuacuacucaggguacucaugugaacauuuuuguuuuguuuuguuuuuugagacggagucucgcucuguuuccaggcugcagggcaguggcacgaucucagcucacugcaaacucugccucucggguucaagcaauuaucuugccucagccugccaaguagcugggauuacaggcgcccaccaccacgcccagcuaauuuuuguguuuuuaauagagacgggauuucaccauguuggccaggauggucucgaucucuugaucucgugauccgccugccucggccucccaaagugcugggauuacaggcgugagccacccuggccggccuuaugugaacaugucuaaacacauacacacacauugcagagucugugugugugugugugugugugugugugugugugugugugugugugcgccuaggugcaucugcagaaauaggucuacaacuccaggcuauagcuggagaaucuccaggaugggcuuaugucacaguagggugugauguggggugugccugcuauguguguugggugggguuggagugggauggguugagcugguaacacugagaaucuuuggcccugagcuccauaaacugaacccgugagggaggugccuagcugggugcaaacuccuuaauuccuguuugacuuuggcccaguuaguuaaccgcucugagccucaguuugcacaucuguaggguggggauaaauaguacuugcuuccugugacuggagaaaagagugaugugauagggguaaaauguucagcaucgugcccgacaccugguagccaccugcuacaugggaguaccaucggggcaccauguaagccugaaaauugauccggugacagagccaccgaaguguuuugucuucuguuuucuuuucuuucuuucuuuuuuuuuuuuaaauacuagagagcuguuaagaaucaucagauuuccacauaaaacacuugauguuugcucucagcucgaaaauagguacaaacgucagugugaauugagauuuccaggaaaaguagacaaaagaaaaaaaagaacuuugaacaacauuuucccguaaguauuuucauauauuuacaugucaacuuaagggaaaacacaacuacuuaucuugcaguuuuacgacuguaucacuuaauaaacauucuaugccagaggagguuauggguugaguccccugaaaagacagguugaaguccuaacccuuagugccucagagugugaccuuacuuggaaauggggucaucacagauguaauucguuaagauguggucauacuggauuaaggugggcguuuaauccaauaugccugguguccuuguuaagaagaggagggacacgugagaacucagccaagugaggauggaggcagaagugggcguuacacggccgcaagccaaggaguguccagcagcccguagggcucccuggagcuggaagaggcaaggaggaagucucccccagaggguuuggagggagcauggcccuguaggcaccuuaauuucugacaucuggccucugaaacugugagaaaauaaauaucuguuauuagaagccaccaagcuuugguacuuuguguggcagccccgggauacugacacagucguagaaaugcaguugagacacaggggaaaaaguauuucuguuagugggcaauugagaaggagagacuuguaggcuuuuagugcucacuucagaccauuggcgcccugcaucuugucuuaucuccagucauugaggaaauaaggcucagaacaauugugcuccgguguauuuugcgucgucuuuuuagaagaaaacugccuagagagugcgguggugacuaccacgccaggugugugaccaugauagcagauuuccgucucugaucugcuuuuucuuucaguuuggauuugaugugaauguuguugaccagaacuggaggugagcaggagagaauuaacugccuuccguccagagggacuaggcauugaaaugugcauuccagauuccccuggagcagugaacuuuggaguuagaggccgagcugaugaucucuuccuuucuuuccaaagaggauguccgugaguuacugucucauucuuuuuuuuuugagacagggucucacucugucgcucaggcuggagugcaguggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngauccuaauuuuuucuuuuuguuuuugagacggagucucgcucuguugcccaggcuggagugcaguggugcgaucacggcucauugcaaccucugccuccuggguucaagcgauucucuugccucagccucccgaguagcugggauuacaggugcgcaccaccacgcccggcuauuuuucuuguaauuuuaguagagacgggguuuugccuugauagcuaggcuggucucgaacuccuggccucaagugaucugccugccucagccucccaaaaguaauccccccaaaguguugagauuacaggcaugagcugccacacccggccaagaugcugaauuucaucacccucgcagugccccuguggccgugaaagcuuuuggagucgucuuuggagggcuguuacucuaucugcauccuuccgcuccucucuccuacucccuugucaaauacccuugcaaggcuggcuuuuaauuugucuucauauaugggauuauuuaaucauuaguccuaaaaugaacaaagggcuaggggcugggcaucugggguugugaucuugacuggguugcaugauuuggggccaugugcauaaccccugaggcucuuuuuuuucuuaccuacaaaaucauggguugucuggcucauuucacaguuaaaugugaaguuuccauauccauguaugagauuucaaucacugcuuuccacugucugcuuuagggauuggggaguaggguauuuagaggugaaacaggaagaaaggaauuauguguaugugcuuuacaaauucacaugugcuugaauguauuuacccuugaugugcucauuuuauuucauuucuaugauuuuugacguguuuauuuuucccacgucuagaacagaauaggugugcuggcagggaugcuguuaggaacugugauagauguauuuaugguuccugaagguuuacgaauacggucaugcugagcuggggaaguccagccucugcccugggcuuccuucaccugaugcaguuauuucuuguuaaagauucacuguaaaaugccaaauaaacuuaauaacuaacuaauaaccaucuuugucaguugaggacacuuacauuuuaugaauuuuggggaaaauauaggaagauaccugaggaaauagaauuuucaauaucauaggucuagcuuuugauauuacagaauuuuugugcacauguggcaaugugcuugcuuuggcuuucuaaaaagaauucagguagcgguagacaucuugauagcaguaaaaaaaauacaaccaaaaggaaggccuucaccguuaccugaguguucaccauggaccccauugugccagauccaacaggggcaucauuuucucuaagacacaaaacacacacgcaauucuacgaggucaguauccgguccuuauuuuggccauugaaaaccugaagauagagcagaucguuugccagagggcaggcacccaggggcucggggaggggugcugcccuacccacuuuagcugucuguagagaccaugaacgugaacaccaggaggcugcgugcgccugaaauucuggacuuuacagccugaggugcagcucaggcagcucagguuuauggaggccauuccuuguacggcuaagcaccuuccuguccuuggaggugugggcaggaaauguugaaagguggguggcucugcccucugguggcuuuucuuuaguuggggaugucuuaacacacacaucugaaauaagacuggcucaugcagaacaagagaugggaagcuuugcguggugccagggcuguuuggaggagcggaguuaaaagaucaaacacagacuugggucuggcuuucgugaugaggugcacccagugggaaggcccagcuggcgagggagaaguugguacccaaagaugugggcuggacuggcuucuuuccuucaguagaagcaagggcccagggaagggaguguguggugggaagguacgguggcccgugcuugccagaggaguuugcacaugacaugguuuaauuuuagagaauuuuagaggugugccacaaugcaggugccuuuugugcauagccucgccuggcugggcugugcaggauggauggaugagagcuuugauccgcgauuuugaagaugaguuuuauauugaaugcuauauccuauuagguagaggcuguuggguaggaggaacauuaauauauauuuuuuuaaauugagagugggcuaguugaauacuuuuugggccuuaaacacuuuguagcauccuuuuuacaccugugacugcugccuuuauuccauaaugcaugagcaaaagugugguuggaauuuaauggugugacuuuuuaggggcuuauguaggagcacuaugauccuuuugcaaaauaggagcagcuuuaugucaggauaaacaugggauuucagacauuucuugcuuaucauugucaguuuuaaggauuucuucuaacacaggacauauuuuugucuacugugauuguaaaaucuauuggcuuaauaucaacauugcuauaugauaauuuuuuuauuaauuugguuuccaaagaauauucacuccaugugcaauugauucauaggcagauaaaaaucuauuaguggaaauaaaagauaguauugaagugucaaucaaaauacuguuaacaaugucuucuuaugucacuuauggucaucuggugucauggguaguuaugaauuucuccuccuuaaacuauugacccuuuauauuugucugaaagaaaaggucacuucuguggguaucagagaggaugaugcaggcagcgacugaauguauuucaauauuaaaaacaacaacauuaaaacaagccaacacgacucagcauggucacuucuaucuuuacuauuacuaauauauuuccccuuuuuucaucacagcuuuuuauaacuaugaugccagaggagcggaugaacuuucuuuacagaucggagacacugugcacaucuuagaaacauaugaaggugcguaugcaucuugguaucuuuucucuuacauuuugggcagauggcacaccuucucagugccugcugggcaaagcauuccucuguuacagacacauaagacagucaugcuuccuucucaggcucccuuuucuugcagauggauacuguuucagguaaggguaguagugaggcuguuguuuaauacuuucugaaggugaacuuaaaacugaaauucccauuuuuaaacuccuuggcuccuuauuuucaagcauguguaaaucuuuuuuuuuuuuuuccuuuugagacagagucuugcucugucgcacaggcuggagugaggugguguaaucucagcucacugcaaccucugccucccagguacaagugacucucaugcuuuagccucccgaguagcugggauuacaggugcccgccaccaugccuggcaaauuuuuuuguauuuuuaguagagacugcauuucacccuguuggucaggcuggucucgaacuccugaccucaaaugaucugcccaccucagccucccaaaguacugggauuacaggugugguccacucugccuggccaaguguguauaaaucuugauuguuaacaguugaccacuugauaaaaaauagguuuaagauaguuuacuucguuguuuugagacagggucuugcuccaucgugcagguuggagugcaguggcacaaucagagcucaccgcaggcagccuccccaucuugggcucaagcagucuugccaccucaggcucccaaguagcugggacuacaggugcaugcugccacacucagcuaauuauuuauauuuuuuguagagacaggauuucaccauguugcccaggcugguccugaacuccugagcucaagugauuugccugccucagccucucagaaugcuggaauuacaggcgugagccacugugccuagccugcuucauuguuuugauguguuugaugugaacuaagauuucuucuuuuaauguccucacuuagauuuguuagcaguauaugucucagaggaaccccaauuuucauccuuuccuuuuuuuuuaaaccuguaauccccauuuucuugggaugaacagagauuuaucauaguuauaugggaugccguccaaugaagcaauauuuuuuuuuguuuuuuuugagacggaguuuugcucuuguugcccaggcuggagugcaauggcgcgauuuuggcccaccacagccucugccucccagguucaagcgauucuccugccucagccuccugaguagcugggauuacaggcaugugucacuguacccaccuaauuuuguauuuuuaguagugacgggguuucuccuuguuggucaggcuggucuugaacucccaaccucaggugauuugcccgccucggccucccaaagugcuaggauuacaggcaugagccaccgugcccguccugaagcaauuguuauaauuauccaauaaauaaacuauuggugacagugguuuuccaauguccuuggcuuuucagacaauuuguuuuuauauuuuguguuugcaaauaauuugagcaugccauauuucauuuuaugcugugguuauuguugcacagaagggaagaaaugaugggcuugauuuuuuaaagacuguucagaucuggagguuuuggugagauuguguuuucuuauuguugucggcuuaauuuccugcuugaaagggugguucccauauagcauaugaauaaaaaggauaauuucaguagaaaaacugcuuuuucacagagguuuuuuagcaaaacccuuccacaugggagguugggggugagaggggaaauugaagacaucccguaguaaucagcaaauugaacuuccaacuugaaauccacuuuacaaggaaugaaguaugcccagcuuccugcucgaggcaaacugugaccagcuccugguagacuccucugagaaacacagaccuacuaacagauccauguucauggcccuuauuuccccaucugaugcaugcuguaccuucccuaaaaaaguccugucugaaaaaaaaaaucgacuuuaguggccucugcguggaagccagugcagcucugcaaaaaccagccccaguccuuaagcggaugaguaguugugauggggucuucugcuuguuuuccguguuuacagcugacagcuguguucccuuaucuccucucaguauauacugcaugugucugagaggagacagagagaaauuaaguagagguuaaggaucaaaccgcucaucucagacacuuuucugauuugaagggaaaugcucuuguaucuuguuuuacuuuugcugccggucaguugaaguugaaauccugguuaauaaacacugggcaaugaugucauuccugaauaguuaaugauuuccuguggccccugggccuguggagacugcauuuuuguucuuugcuucauaagaggaaugcgugugugguggugguuuuuuuuuuuuugagauggaggcucgcucugucgcccgggcuggaguaugguggugcaauuucagcucacugcaaccucugccuccuggguucaagggauucuccugccucagcauccugaguaccugggauugcaggugcccaccaccaugcccagcugaggaauguguuuuuuaaacaguggacuccucgggcaugucagugguccuuguaauacguguaacuucaaaaauaucugauugcaggcauuugacuuuuuggcugacaucaugauaagagaucuacagugaacauuaauuuucugggcuagucauucuuucuagauucugaugaaaauauuucagucuuuguaaagacucuuuagcauaaaaugaauuuccguuccuugacaacuaacuuuuugguuuuaaucugaaucuaaucagagaaaugcauuuggagaaguauuaauaguuuugacuuuggggaguguggugacuuuuugucauuaaauaaaaagagaauaauguacuuccauuuguuuuccaauaucuuccucuuguuuuaucuaaauuucauggcuuguauuagagucuggcauuuucuuuuucuuuccuuggcucuccuuuuccucuaagaugacuuuuugguuuagcaaguuugauuuucuuuuuuucuaugauccuuuccaggauauuacagagcuugcuccagaggcuauaauuucuagaugauaaaucuuuauuuuaggguucaaagacuaaauuuaccuucaaguugugguuaauuucucuuucuugagcucacgaaggcuuacagcauagaacaaagaaaaugagcuuucuagcucaugguggaaguggaaagagcuuugagagcucauucgugcagaccccugccuuuaaacaauguccuaccuccagauaggagaggugaggccaggccccaguguugauugagugacucuugucuggucaagggcgugccaauccugcugucgacucguuuccauaggguccccagggcuuccauagcguccccagggugagaugcugcaccagaggcaagcugcaggcauugcccaaaguugaggaaauuguccuuuugauucagccacauucaaacuuaauuuauucaacucuuuaaaagggauagugaugcauuuucuucuaaaaugacuagaccgccauuuuccugugcuggacuguguccuccccgaguuugggaccugugucuugccuguauuugccuguucccuggguggaugucucuuuuuuuggagcagguugguugacuacguggaggccacuugcaagccgugccagggagaaguuaauucuguaacagcugugaaucuuucuccuuccagccucauccccucuuugcugugccccagagcagccagguaaucguuccguucuguucucuuacucuccggugcaaaaccucugccgggacauccucucuccuucaugccgaacucugucaugcagcaggguuuguggugugaccccuacuugucuuagggcacuuccaguuucugagcucauggaggacagagauugggucuaaucucuuucuguauuuguggcacccaguguggucucugguacauggugugcgggcucacuuuguugaagaaauagugcaugccaaaaaucguggggaggaaaaccaugguuuucauuuugcuuaggaaggccauuagaagaggaaucgacugccuaugaacauuaaauaaagacacaaaacuccuugccuuucaugccuacugcuuggcccuuccuccuccugccucccauagaaaaccuuucuacugugugugaaguggccucucguuugccuguguucucgugcuguuuggugugcaucuguuuuuaacagauguaagugugucauuauagucuuguucuguuuuuuauuuucccucgugcuccauuuaaaaugcacuguguucucugugucccuuuaguccauggcucuaacugcaucgugugcacauuucauguuuuacuaacugccugccuccccggguaugagcacuuagguuguccccgcuucccaccacccaagaucaagcugcccugagcaucccauguccaucucacucugcagggcacacagaugucuuugggcugcguucccaggaggggguugcugggucuuggguguggagauguagacuuuggauaagcagggccugcuucucccaggcugguugccgcaguggacacugccacccacggugaccaggggcuuccugcauccugcaguguucugccuucuaccacucuuaacuguguacuuuucauuucucugacuauuauuaaacugaagcaucucuucauacauguugaggucuuauggguuucuucuauacauaguuuauaaacuuugcucauuuucuuucuuuucuuuuuuuuuuuuuugagauggagucuugcucuauugcccaggcuggagugcaguggcaugaucucagcucacugcaaccucugccucccugguucaggugauucucagcuucccgaguaccugguauuacaggugcacgccaccacgcccagccaauuuuuuuuuuuuuaguagagacgggguuuugccauguuggccaggcuagucuuggaacuccagaccucaaguuaucugcccucuucggcugcccaaaauaccaggaugacaggaguaagccaccacucuuggccucauuuucuuacuauacuuaguugcugucuuuuugugucucuguauuauuuccuuauguauucuaagacguuaaucuuugucaguuucagaaaagaaaggacauauuaauguugaaaaugcaggaagacuauaauaggauaaaggacaguuguugaaacugaguacacagcuuugcauaacucauucaacugaccuuucuuuuuccuuuuugauauaugagcacugugucauagaugggcuuugauauaugagcacugugucauagaugggcgcugauacugggccagcuuaucaaaaccacugaacuugacaauauggcuaucaggagauaauccuucaaauguguggcugaagucuaggcauuuuguaucugagguucccccaaucagucuguugagucuccagucaagagagugaaaugaguucaguucaucauaacugggucuuagcaaaaccuuugccagaguccuggcaguuucuguccucuuuucuggauaugcagaaaacagcugguuagucaucccuuggggauucugcucaucuuaacaccaucacuuucugguucacaaucauccuuuucaucccugguugugaaaauuuucaccuuuugagagagguggaggccaguugcugugacaauggcccguuuucacaucugucugaucuuugguucugagguuugccuuuuuaauaguguaaagaaacccaguauuugguuauucucugggaauuuacccagcucacguuuuccaagugcccucugucacucucugacaggguccuuuguuccuauggggcagaguugggauuugucuuuaagcuuuuuuuuuuugagauagagucuugcucucucauccaggcuggagugcaguggcaugaucuuagcucacugcaaccucugccucucggguuuaagcaauucuccugccucagccuccugaguagcugugaucauaggggcuuaccaccaugcuuggcuaauuuuuguauuuuuuauuagagaugggcuuucaccauguuggccaggcuggucuugaacuccugaccucaagugauccaccugccuuggccucccaaaaugccaggauuauaggcgugagccacugugccuggccucuuugagcuuuugauuagcuuuccagaaacuagauggccuggagugacuucagaauguuugggaguaaaaaaucauccaucugaacucacaaaugguggggugcuuggaggcuggauacugacgguagaccccuaggccuuugcaggggcaguuccuguccucagccugagaggggugccagggguguggcugggucuggucccuuguugaagggacucuucuguguggcauccauggcaugcggaugguucgagugugucuuucuuucugcucucacuauuuucuuucucucgccacuuggaaggagcgagaaguggagccugggccaaacccaaagggcagguguguccugugcuuggcccuggagcuuccuguggguugagggcuguauuguugcuacagaaguacuuugugaggucguggcugcuccaggaaaaagugcccugucuugaagugggaggaaguucucucucaauggguuuucuguuuuggggcagcgagaugcugacaugugcccuuggagagaucuuggucuaaaucaggcagagggagagugaagaaaaugcauacacaaggagccuacucagggccagugguugaaaggacaaguccugcucuuggaacugugcaucugaacuucaaacugcugcuuccgaaccacaugagaugacggaggugaagguauggaggcccaugugugaagguugccagcugggcuccgggugcgcuguugaaaugcucucugggaaaccacguaguauaucuccaaagccuuagguucacugaaaaaugcuggugacaaacugaccucacugguucugccaaacagugaguucuacacaucaugaauguauugugaggacccuaacaugucucuuuguacuaacuguuucaacuuuguguuuguuuagggugguaccgagguuacacguuacgaaaaaagucuaagaagguaaguccuucuucuuaaacacagugcaugucucuucauaaaucacaccuugagaggaaaucaauuccaucucauuugugucugaggguuuuacuucuauaucucuuucucugaauuuaaaaaaauauauggguaggaaugugaacgagcuuggauuguuuucuucugaacaauauguguacauagaaauuguagcuucaucuccgugagugaauugcuaguuugugauauaguguuggccuguugucuucuguucaugaauuuuguguccuuuuuaggucugugugugucagagaaugauccgaguaaagcgacuucaggaaaaaaauuauuucucacaguugucaaucuuauguuguccuuaauaauagauuagcaaauuugcaagcucaugcaugcuguuucccucuugcauauaacuguuuuuacucugccuaagucaagcugugaaaaaaggaguucugcucuccuagagcaguuugcaugagugguuguuugaauuucugaaacuaagacauguaauuacaccucggaucauuguggugggcacucccauacacaauucuguuguggcuuuaacauucuuagcuucauggaaccuaauuauggcucuucuguuucauucuacgauguuaagauuuugaaguaaccucuauucuaagcugugguugggcuguccacguuacccaauauguuuuaauaucuaauuauguuugacccgauguguuuuaauaucuaauuauguuugacggaugguucauuuuacuuuuguguccuaaauuuaccucucauuaucuccuuauugggcuggacucuggauugugguccugagccuguaauaaguccuccaaagucuaguggcccaagugccaggguccuuccacucugccuuccccagagccccuaacccaggcuuugcugagcaggucagaaugggucauccucucgcaacaccagcacuugggaaggauccaggguggucccuauggcagccauccucuggcacagucaugucuaaugugagagacaguguuaggaaaucagugagccagaucugcaaauugggaccaggaccucuuaccuccaccuugccaaccucagacugggcuacaggucucuacacaucagugaccuauagccuugaaguuugcacaagaucgauuucaauccaguggaugguggaauagauuucuccaaggaaaguucuauuuucacauugguuuucccuuccccaaucaagagugaauuccagccaggcccaaagauaugcaccuguaggcccagcuacuugagagacugaagugggaggauugcuugagcucaggagauugagaccagccucugcuggucauaaugagugagaucuaucccuaaaaaaauaguguguaucugcagaugaagcucugaauuuaggaaagcugcaguugaaaccuuuaguaauaagagauuaagaucauggacuaauaugccccucccccaucacauuccuacauaggacacaacugccacauccugggcuggaugugccccaggcaagcuguuccuuuuucuuugaaucuuacuugguauuuguuaucaccuuccccaauuugagaucucuuccauucccacaaugccuccugaaaccacaguauuucugcacuacaccugggcaccuagacaucauaacucauucauaacucaucaacacaguagcgcuggguagggcauagcuauuuuuccaucuaagaucuccacugguagaugaauaaauccaagcuuuacagagauuauaaauuuguaaggggccuccuaggcaguagcagaaaagggaugugggcccuaggaauccuggcaccacgugucuguaaacaacuuuccuguaguuauaagugugcaguugauugggguggugcugagcaggcccagcggaaguugcgcauuucaaaccugcagguguguccagccucacucagucauuauccuuccuguggcuucaugauucuccaguggguuugcugagauugaggguugucuccaccuguggacauggacaagacugggacugguuuuuuguuuuucucccccaucuggguggacaccuauugcuaucauggaaagaaacccaggaggguguaccugggauuuggaggugucccggauaaccaggaccugaacacagcaacccagcguugggucccuucagacuucuguuuuuuuuaaguuaauguuuuauuuuuuuggagacagggucucacuuuguggcucagacugagugcgguggcacgaucauagaucacugccaccgcgacuuccugggcucaagguauucuccucccucagccucccaaguagcugggacuacaggugcacaccaccaugccuaacuaauuuguaaaaaaaauuucggcagugaaagggucucaccaucuugcccuggcuguuggugagcuccuaggcuccuaggcugaagugauccucucaccuuggcuucccgaagugccgguugcaggugugcaccucugagccuggcccagccuuguuuguugcucagccucugacucucugccugacgccuucccucucugugauaauucuucuuuauauggaauuuggccacuuuccuuguuggcagaagcaacaugaaucauuggugccugcuagaccaguucagcccccugccugcccccugcccacccccugcccuucccaaacuugauuaguagcuuguuuucugcaucauucagggcugaaugccggggaaacccaugcagaagcuuccauucccacaacaggugccuugaagccacaggggugccacuuuaucaauuucugcugcaugcacuaaaucucaugcaggaagcgguagcugggcugcguugcacugcccaagaccccaaccccguugccucuuuucuuaccuuugcuuuauuccaguaagggaguuauuuugcuugcucagaaagcaggacccuacguuuuuuuuuuuuuuuuuccugaggcggagucucgcucugucgcccaggcuggagcgcaguggcgggaucucugcucacugcaaccuccacuucccggguucaagcgauucuccugccucagccuccugaguagcugggacuacaggugcccgccaccacacccggcuaauuuuuguauuuuuaguagagaugggguuucaccauguuggccaggcuggucuugaacuccugaccucaggugauccacacaccugagccucccaaagugcugggauuacaucgugccuggccucggacccaaacucuugauaaagcucuuucuggcacuucacagaaugugccugaggcugaauguccuguugagaaacucuccccaggcuucauucucuugggcucacaugugcauugcacuugagggaggccgaccagcuuaucagcggaagcuaggguguacccccagguguugugcagauugggcgaaauucggccugucuuucuguauuuuaccagagggccccccuguuggggaagucucugagaaagucucugugggucuggguacguggucagugcacaagggacaauuggugguguaaaccaacuuucaucauuuugaaagaggagaccaucaucaaaaauugcuuuugagacaucaguuggccuuuguucugccugcauugaggccaaaaaggugugaucuauggagcagccugcaaauugccuguaucuuuguggacuuuuuccuuugcaaguguguugccuguuugcuucuaagacaucggcagacugcaauacaagccaaaugaguugccgucuuuucuacuucuuuguguuuucuuugauauguuaagacuuaaaaaauuaagagcgaucuagccaccccucaccccaccuuuuugggaacuauuguuugauuuacauucagcaauccuauugauaauaaaagcuacuguuuuuuuuuuccucccaaaggguauauuuccugcuucauauauucaucuuaaagaagcgauaguugaaggaaaagggugagucuggucuugauguuuaaaugaagaauugcaaguacuauauuuggccuugcugcucuuuuguacgauggcguaauaugagagggucaagacaaugggugugauugacuccugggggacaggaguuuuggggagagaaaggggacuugugauucagaguuguguuuaacauggcuuuuauccuuuauggagucugaagucagcaccauacuuggcaguuacuguccuugaaccuggggucacuauuggaaagcauucgcccuggugcucugugcuuccucugugagcuacugacuucauuuggcagagacuccaaagccccccagcucugaguccccuuuuuuuugggaagacauugcaggcugugauauaaauggaguuuagggugaagcaacaguuguuaaauugggacaugcaggaguuuacauuuugucuaauugugauguauguuuccuagaggucauaaaacugauguauaagaucauuaaaaggacauuucuagaacaggaacccauuaggcaggaauggcagaugaauaaccaggugugaacuuggaagaaggaacauuaaaauguuuucuuuuuuugucucugcuacaucuucacacucaguuaaauauguaaauuauaaaauuacuaaucauaugauuacugcauaaugacaucucuuuggcugauuacaaaauugccuuuccaagcacuguacuuuuaacauaugaaaagaaccguucggguuccauaguuccaugaugcauacuuaaaaugaagaaaauaauuuagaggcaugaaugaugaugaccugcaauaugguacuuuuuagacagauaaaguguuuuguaugcaaaguuuuaaagggaagaaaaagaaaguugagacuuuuacucuguggaaguaacuggaucaagugugcauuuaguguacuuuauaucugcauuagaauccuuauacagggcagacuguguaugauuauuuaaaaagcacuuugauguauacaaaagaauauauguaaaauguaauuaugaagcaugauaauaaagugaacaacagguuauucugagucucaauaaguagagucacaccuaaccagacaggcagacagagacacauuugguuccuguuccugggccuucugguccaaggugccccacugugggcaaaugcauagagcuauggugaaaugaacaguuuagaaacaauuucccugccuuugcuuuggguucccugugauuguucuccacacuguuuuccuggcucuaucugucucccuugccacggccacucaagccuagcugcccaacagcuccuucccugaagaaccccggccuucaggcuugacaggugaucucaucccucuucuuuuccuccagguuguuguagacuuccaccuucccuucuucuccugguccuuuccccuuucuagugccaaugugggccacgcuuucaucccaccucugccugccuucuugcucuccaaguuuauuguccugucucucuugcagagucugucucuuucaggaucugucucuugcuggucucuugcaugaucguucucauauggccucugucuugcaggcugccuuguaagccucucuuucuugcaugagcucucucuugcaugaucugucucuugcaggcucugucuuucucuugcaggcucugucuuucuuuuacaggcucugucuuucucuugcaaggcucucucucaugugaucucucucacaguaucuugcuugcauugacucucgugaaggaucucuuuugcuuugucucucuucucucuggacgcugacuucauucauucucagacaucccaaaugauuacucuaugccuguuaccacugauucuguaccuauucccccauaaccaaagcaauucccauuuuguccuccaugcuuuucccaguacugacaugguuagcaaugccuccuuaugucuggaccucacagugucuucucauccucugccucuggagcuccacugcagccuuggacacguugguccuugcuucacugaaagccccucuuaacgccgaugcucuuauccucuucuuauuaugcugaccuacugcucaggcaugucaccgucuccucuguccuguguccgcuacucugagggugcuguccuagccuucuccuauuucuuuguugccccucccugauugacauggccucuguugcguuucccucuucagcugaucugucucugugggugaugcucacaucgggaccaccagcccugauuugucucuugaccccucauucaguuaggcagccaaguaacuaaugagaaucauccccacuguugggugagcaucugcuaugucccauucauucucuuuucaaaaaaaauuauuauuauuuuuauuuuguauuguguauuuuuauuuuaugagauggagucuugcucugucacccagguugaagugcaguggcgagaucuuggcucacugcaaccucugccuccagguucaagugauucuccugccuuagccuccccaguggcugggacuacaggcauucaccaccaugcccagcuaauuuuuguguguguguguguguguuuuuuuuuuuucaguagagaugggguuucaccaugguggccaggcuggucuugaacuucugaccuuaagugaucugccugccuuggccucccaaagugcugggauuacagaugugagccaccgcacccggccaaaaaauuauuuuuagauuugacaaauaaaaauuguauguauuuauggugugcaacaugauguuuugaaguauguauacauugugggauggcuaaaucaaacuaugugugcauuaccuuacauacuuaucauuuguuuguagugagaacacuuaaaaucuacucucagcaauuucgaguauacaauacauagcuauuguagucaccuugguguaggauaggaggccuguugaacuuauuccuucugucuaacagaaacucggugucccuuugacccaucaucuccccacuccccuaugucccauucuuuuuuuuuuuuuuuuuuuuuuuugagacgaagucuugcucugucgcccaggcuggagugcaguagcaugaucuccgcucacugcaaccucugccuccugcguucaagcgauucuccugucucagccucccaaguagcugggauuacaggcgcacgccaccaugccuggcuaauuuuuguauuuuuaguagagacaggguuucaccacguuggccaagcuggcuuugaaccccugaccucacgugcucuacccgcuuuagccucccgaaguguugugauuacaggcgugagccaccgcguggagccccauucauucuuaaagaugcucugccuugaugcacuuucccucagucuuaccagcagcccuaugaggcaggcauuauugggguuacauauucuugaacacuggcagguaacaaggugguaacaaagguaagacaauaaagccagaucaaauguguuaaugccagcuggcacauuaaucccagggauccacugggccuaccagaagggaggaaccuaagguggaaccagaaccaacagcaggacauggugcaugcacugaggcccuauucacaugguggaagggaggucguugagcuccaggcuucucauagccagugugaggagcaccagugcacucaacccaggauccguaagaugaaaacagcccagucguuguugcagauccucauacugugaguggaaggaaauuucucccugcagacuuuauagggaugacaccguagcauguaaugaaccgcauuuccaucagcauccuuacugggaaacuuggggacauccuuggcagggcuguuuuaauagucauguucuucaguagacacugaugguggcccaugaaagggucauuuuguuguuguuguuuuugagauggugucucgcuuuguugcccaggcuggagugcaaugguacaaucuuggcucacugcaacuuccgucucccggguucaagugauucuccugcuucagccuccugaguagcugggauuacaggcccgcaccaccaugcccggcugauuuuuuguauuuauuuauuuuuaguagagacgggguuucaccauguuggccaggcuggucucgaacuccugauccacccaccucggccucccaaagugcugagauuacaggcgugagccaccacacccagcccaaagggucauucuucauagcaguuuucuaggggaugguuuugccugcacccuucccucugaugucugguucuggaacuauccaugagaccaccguucuuccaggguccccguugucuguugcuuugggauccuccccuccacugucaauaagucaucacaggccugaucuccaaucgugagccagucaggguuccuuccacaggucugggcucugugcacaucaaggguuguaggugggaacuauuguagcaucccucggcaucccaugcuggccacauucuugccuguucaggacacacagacaaccuguggggccagcuagccuaacuacaccagccacaaauucacucucucccccuaacccucaguagucugagucuuacuuagcauagugccugacccagagcacaugcccaggaagcagugguugauuugaugaaaacgagcgcauaaauagguaaugaguuaagaauaagucaaggggcugggcgcgguggcucaugccuguaaucccagcacuuugggaggcugaggugggaguaucaccugaagucaggcguucaagaccagccuggccaauauggugaaaccucaucucuacuaaaaauacaaaaauuagccgggcaugguggugggcaccuguagucccagcugcuugggaggcugaagcaggagaaucgcuugaaccugggaggcagagauugcagugagccgagauugcaccacugcacuccagccugugugacagagcgagacaccguuucaaaaaagaagaguaagucaaagguuaaacuuuuggggcggaggaaaaaggauaagaaagaggauacagaguuuaaucagaguuggcaucagauagaguaaccauggacauuuggaagcuguaaccucucucauauuucgccaaggauaacugcuuccuguauuaucauguaaugaguuuuaugcgugauggaaaauguaaaaguaaucuuaacccaaaccugcauuuuaaugccacauggaccggcuguaauuuauggcaucuuuaagauagauggguacacauauuaugaauauacuuuccuuuugccagaccuugacauucuguagacuuuuaauggaauauuauuugccucuuucaucuuacuuugacguaugagguggauggcuuacgugcaggguaauguaugaaccuucccaagcucuguacaaauauaacuugucauucguagagacguauguauuuauaugugugcaugcagucuuauuuguagauuuucuucccauuugcuuaauacugaacgcuauggccuagaugugaaauuuaccagguacuacucauagcaggcagugaaaccguggacucagcugcucuuuccuucuuuccucccaggcaacaugaaacagucaucccgggugaccucccccucauccaggaagucaccacgacacuccgagagugguccaccaucuggaggcagcucuacguggugagaaaaugagauauucauucaaagcuuagaaauagagagugggcuuuuuugacccugauaugccaaugggauguuuuuuuuucucagcgaaacuuaaaagcagagcuuccgagacagaguuuuacucggaauuggcaaaggaagcgacauggcugagaguuuagccccugcugggggcugugugcccuucgaccugccauguauuuggguguauuacagugagcuguagcagaagggacuguaggaugugucuuuccuugcauuggaaggagaaaugugguuguuucaggccccuggaaugcaggaucgggcaguggguguugaugucaccuuuuaaacaguaauaggugcuuauuuaaggauccgguagagggcaauuacuauuuuuuuuuuuuuuuuugccguugucugacaguagguaauaccucuuaucauuuaagaaaaacaacagucuucuagauuuaccuguguuugugacaggaauagggaaauauuuuacauucuagcuucgugugcaauuguccaguucuccugaucacagaagaagucuuauuaaugcagagagguugaagcucugacaucuuccauuucguauucccucggggcauuucuuugcacauaaauucauauuugcaguagauuaccuuuuguuaagcuuguauuucuauucagaguguugauuucucauaugcuaauguuauuaccaccaagccagggcucuggaaggaagucgguacguucauuucuugagaacauagaaaacuuccuaaaguccugcagcugcuuguugggcaggcuuguuguuuuugauuauacagugguuuccuauaaaugcacaguaauaagcaguugcaguaauugucaucaaacguacugaaaaaccuaaaagcguaaaguuagccaugaauguuuuguguaaaucugagcaauucuguagucaggguuucaucuucaacuuagcaauuuuuaaacaaaaauauggcaacaaaacaaacaggaguugaugcucauagucaguggaccuacuuaagucuguaacccuagaguagguauucuuaaugagcaccuugguuuccuuuuacaaaacuuaaauuugccucugauagacuuacaugguuggauuugugcaaagaaagcuaacccccaaaauggcuauaauauuuuuauaugggcugggcgcaguggcuuaugccuguaaucccagcacuuagggaggccgaggcggauggaucacuugaggugaggaguuugagaccagcccggccaacauggugaaaccccgucccuacuaaaaauacaaaaauuagcugagcaugguggagcaugccuguagucccagcuacuugggaagcuuaggcaggagaauugcuugauccuggaaggcggagguugcaaugagccaagauugcgccacugcacuccagccugaguaacagagcgagaccccuucucaaaaaaaaaaaaaaaaugcauuuuuuugcugcacauuguagauauuagcaaaauaguaaggauuuuagauaguugauacagccuuagagcaguggacaagagaaggcagcguggauauuagaaacuccuagaaagaagguuaaauaccagagugagcucaguacgugguuuagauauguagagggggaguuuuuuaaaaaaguggcagugaacaaauuuaauguuuuaaagggaccaugacauuuagauaccuuuuuauuuauuuauuuuuugagauagggucuugcucuguugcccaggcuagauugcaguggcaugaucacagcucccugcagucuuaaccucccaggcucaagcaaugcucccaccucagccuccugaguagcugggacuacaccugugagccaccaugcucagcuaauuuuuuuaauuuuugaagagaugaggucuccuuauguugcccaggcugaucuccaacuccuggacucaagcaauccucccgccucugcuucccaaagugcuaggauuauaggccggagcuaccaaggccagcaugcuuagaguuuuaucacauuagguuccaccuaaauuucuuuucauggaaagaaccacugaguuauuuuccuucagauaaucccuaaucuccuugauuauuguacgcuuguaauugcaagcugcaaacuguugcuuuucuuugaaccgucaaucccaucaaaauucuuagaaagugguaagaagugugaguuuugcaucuuauuugcauuuuccucuugucacaaagcaccaagagcuuguagauugagauuuggccucuugcagaagugucucuuguggguuguacacaccacagugugcagcagcccgcccaggguggaaugcuucuucuucccuauagcugagcugagagcgaggccgaggaguucagguucucagugugcugagaaggguccagggugcaggguguucugaagaccguauguagguuguaggauucagaucuuuaggcucagacuaauuccggaggagcuuuagacuugcccaucucugauccagaugcaggaagcucacgagcagguguugacgcucaaggucuagccccuguugggaucaccuuuuugcuucagugggacacaggauguuggaugaagucuuggggauuaugcauuacuuuuuguuccuuuaaucuuuuaaugucgcauggaaaccaaauuccguauaauauguuuuaguuuaugcugaaagcaccuuuuaauucaacauuaacuaaaucucaugaucuagugcuuauaccucaugcguauuugaagagauagccauucucuaccaucuccacaaugcuguuuuauaacaaaaucuuucugauuggguuuuuccccguauagcaagauaacagggagauguuucgaagugugcggcacaugaucuaugaccuuauugaauggcgaucacaaauucuuucuggaacucugccucaggaugaacucaaagaacugaagaagaaggucacagccaaaauugauuauggaaacagguuuguuuauuugaaagaugauuuuacgcuuaaauuauccaauguaauaacaucacuauaagucuucaggagaccaagaucauauuuuaucauaaaacaaaauuucuaccaucaaaguaauggcauguuuuucauuuugaaaaggaugagguauuuuccacuggauucugaacuggggaauuuugugagccauucuugaaaccuugucauucuucaagggauagagucaagaagccagggagccugucauuuucaccguucuggagggaaccccaucauuacuccccuagcaaggaacuuuuacuuucugaccauaguuuuugacuuugaguccagaucuggggggccuugcauagugacaagcaacagguuucuuucuguggaaucccagguucugagcauuggaguggacauuagaucacuggaaaguuugucaccuguguaggcuugccaguuuucacaaacagaaauacagcccaguuaaauuucacugcagauaaacaacaaauaguugcuuugugcaguuaugucucuugccagagcaagaguucuucccauccauagcaggcauccccccagcucugcaugagugccuuuagugcucaccccugccuacagcuguaccuucuauguuagcacguguuuuuugaugcugaaagcaaacaagcugcucugauccuaauucugcuggguccuguaacuagaaugaggccaugcccuuuuccaccugguaauauuuaguuuucauagaauagcagagcugcaagaagccuuaaaaaguaucuggucacaugguucccaaaugcucuucuauuucagaaucacugggauagcuguugaauuauagaaucccaagaccuaccccuuaaggcucugauuugugauaucugggaugcuggcuggaaaucuccaguguuuuuuuuuuguuuguuuguuuuuuuuugagauggaguuucggccuuguugcccagacuguagugcaauggcaugaucuuggcccauugcaauccccgucuccuggguucaagugauucuccugcuucagccucccgaauagcugggauuauaggcaugcaccaccaugccuggcuaauuuuguauuuuuaguagagaugggguuuuuccauguuggucaggcugaucucaaacucccuaccucaggugauccacccgccuuggcaucacaaagugccaggauuacaugcgagagccacugcucccagccggaaaucucaaguuuuaaaaauagaguuggguugugcuggacagcagauuuggaaaacuucugguuuaauucaacccccucauuuuacacauuggaauguggaagucagaaaagggaagggguuugcuuccagccauucagcagaaaggaguccggguaaaucaaggaaccuuucuguaaaaucagaauuaucacauaauuuucugguaauuuauauuuugaagugugaaaaacuucuuaaagcaacguuaugagcaagauguaggguuuggauuagaaaugcuguaggagagauuuuuauuuuuuuuuccagaaagccugagauauuagcuauuguugcagcaaaacccauuucaagaccaccugcuuaaaaaagcagacuuuuggagcuuugauuugauuuucuauuggaguaucauaauuuaaacuuauguucagagaccaccugcuuaauuuggcugcaggaagcuagcaaaguacauuguaucauggaaaaaucuaguuaaggaaggaaguguuuccaaauacaguuuacuacuuugauaggaaauacaguccuuaauaagacagguuuuuugcccaaggaucuccaggcucuuccauaauuucuccaaagcccagcgcucugcauauaucuuccuaguucuuccuucagaaaaccuaaaugaugcaaaaugauaccacaguguugaauguuugauuuuaagguggguggauuuaauaaggaaaagauguuuugcgucuuuuucauugaucgcuuaggcauucuugcuuuuuugauugauuuuuaaccuggguggagggguuugaggagcuguuugagaaugugaugaaggucuuggaccauaucucuagaaaaauguacauacacaauacacaaacacaggcacacagacccccccaacacagacacacacacacacacacacacacacagacagacacagacacacacacacagacacacacacacacacaguucuacacaugauuucagguggggaggucucccacccuguccucauagaugcauugggcuuccauggacuucaucucuccauugccuugcugugauaaguugcaccuucauaauggaaacucacucugauucagaaccagcugaacacugguugcugagaacaaugcguagaaggguugacugcacaggccacuucguuugaugguuugcauguggcauucuggaaggagcauggcucugccauuggagaguucugauacagaacccaggaucugguuuuggaauaaauaacuucuccaagcuuagguuuccuccuuugugcaaugggucugacggucugcccuggcaggugugaggugaugauguggcaggacgugcacagcaggcuggcacagggccguccucucguguguucccugagggaacccaauucugcguggccuguaggaccuacuggcugggccuccuaagcugguucuuuguagcugcccuggcaccagcacugacgugcccauaccagaacugaucaugccuacacuagaagugaccaugcccuacccacaguaguacugacucuauccacgcauuacugaccccugcccauaccaguauugaccccacccacaccagcacaaaccaugcccacaccgucacugacccugccuguaccagcacguuccuaggggccgguucagggauaggauaaggaguaguauuugggagggaggagcuugcuuuguuagugagacauauuacaaaaauaacuaaugagaccuuaaaaugcuuuuuacauuuucuccagaugucuuucuguuggucuugaggcacccugcuuacauugcagccacugcggcuguuuucaugcagugcaaaaagccucuauuuguuuaaagucuguuuacccugaugcuguugacaggcccaguugguccuccugcuucacugucaguggaauuugcucaauagauauuaaaaggaaaaaaucaguuuucuguauuugucuucccagugguacagugcuugagcaaaacuccaaagacuaaauauguuugagaugcuggcagacucguaucuggcuuuaaggugugugaccucaagacucgaagucucaggguaguuuuuuagauggaacauuuauuggcaauucaacuuuccucuuuaauuuguaacuauaaagauguucucuaauugaaauuuaucauucuuucaaaugacucuguuuccuuuuucauauuguuaaaaaagccuguuuccaucggcuuguuaauuacaggaauauaauccuaacggguaagaggcaccuaugguuaauuuucugcccuuagaccugcguguuuuguuaacaagaaagccagaaccuacugccagaucacaacucuugaucucuuuuguuacacaguugucuguguucuuuaaauaaaaacugugguaaaaaucaucuuacaauuuuguuggauuugaggaaucagagagaauauuccccaaaauauguacuguuuauuuauuuauuuauuuauuuauuuuuaguauuuauugaucauucuuggguguuucuccgagagggggauuuggcagggucauaggacaauaguggagggaaggucagcagauaaacaugugaacaaaggucucugguuuuccuaggcagaggacccugcggccuuccgcaguguuugugucccuggguacuugagauuagggagugguggugacucuuaaggagcaugcugccuucaagcaucuguuuaacaaagcacaucuugcaccgcccuuaauccguuuaacccugaguggacacagcacauguuucagagagcacgggguuggggguaacgucauagauuaacagcaucccaaggcagaagaauuuuucuuaauacagaacaaaauggagucucccaugucuacuucuuucuacacagacacaguaacaaucugaucucucuuucuuuuccccacauuucccccuuuucuauucgacaaaaccgccaucgucaucauggcccguucucaaugagcuguugcguacaccucccagacgggguggccaccaggcagaggggcuccucacuucccagacggggcggccgggcagaggcgccccccaccucccgaacgggguggcugccggguggaggggcuccucacuucucagauggggcggcccgucagagacgcuccucaccucccagacgggguggcggcggggcagagacacuccucaguucccagacggggucguggcugggcagaggcgcucuucacaucucagacggggcggcagggcagaggcgcuccccagaucccagacgaugggcggccgggcagagacgcuccucacuucuagacgggaugacggccgggaagaggcgcuccucacuucccagacuggguggccgggcagacacgcuccucacuucccagacgggguggcggccgggcagaggcugcaaucucggcacuuugggaggccaaggcagguggcugggagguggagguuguagcgagccgagaucaugccacugcacuccagccugggcaacacugagcacugggugagcaagacucugucugcaaucccagcaccucgggaggcugaggcuggcagaucacucacggucaggagcuggagaccagccgggccaacccggugaaaccccgucuccaucaaaaaauacgaaaaccagucagguguggcggcgcgcgccugcaaucccaggcacuccgcaggcugaggcaggagaaucaggcagggaggcugcagugagccgagauggcggcaguacaguccagccuuggcucggcaucagaggcagaccguggagagagagggagagggagaccguggagagggagagggagaccguggagagggagagggagagggagaauguacuguuauagacuggacagauuuauuagccagauguugcuuguguuuuuaguuggugacuacauuuagccaucuggccaggaaguugcuuaaccuuauuguagauaacguccauauguuugguguucacauacaauagaacaucuguauugaaaaucuuccuguggccucauguaaggacucgaaguagaaggggagacaugcagggaucccuauuggggucaguggggaguaaaaaggugguggauagaucucuccuccaaguuuucuucccucucuccuuccucaacucucugaugaugucacaacugccagcuauguguuuggguugauggauguauaugugauugcauauauaugugaauguguguguguguguacauauguaguaugccuuagguggggugcaguggcucacgccuguaaucccagcacuuugggaggcugaggugggcagaucaccugaggucaggaguugagaccagccuggcuaacauggcaaaaccucaucucuacuaaaaauacaaaaauuagccgggugugguggcacacaccuguaaccccagcuacucgggaggcugaggcaggagaauugcuugaacccgggagauggagguugcagugagccgagaucgcaccacugcacuccaguaugggcaacaagaacgagacugucucaaaaaaaaaaaaaaaaaaaaaaaaaguaugccuuaaaacuuuucauauuuuacauaauaauuaguaauacauacuucacuugggccuuguagaucuguaaaacuucuccuugcaagacaaagccacuguugauugcaauggaaauaaaaauugaggauuuuuuuuuuuuuuuuuuuuuuuacuucucccaagaugacacauuuuaagcuaaagaaagcagccuccaagaauuuuauauuccuaauauuuugggcaagcccgaguuucuagguuguuuuuaccugcccaguugcugugguggaaguugugcuagaaaauucagccuccuuggucuaugucugugaacuuacuaaauucuuguuguucuagaauucuagauuuggaccuggugguuagagaugaagaugggaauauuuuggauccagaauuaacuagcacgauuagucucuucagagcucaugaaauagcuucuaaacaaguggaggaaagguuacaagaggaaaaaguaaguuugacucugucauaugccauucacguuuucucaguaauaaguuuucaacauuaguaaaguaucagucaagcccaaaauugucacuaagaaagaaccugaaaaggaguagcugcagaguuuguguccuacagucaugaguggaauggagccugguggcacaggaugucacccaugacaugaaagggggucggacagcauuguguuucaucguaggagacaggauccuaaugauguugauuuuguguucucaucugucaaaugagacacaagacuugauucugcauuuccucucggauaaugguaggcaggucauguauuccaagcucauugagggcagagaguacaugucuuauugucuuuucgucuucuaugaucuuuaaugguaucauguaugcauuagccuguucucgccuuacuauaaagaagugccugagacuggguaauuuauaaagaaaagagguuuaauugguucaugguucugcagacuguauaggaaggauaguggcuucugcuucuggggaggccucaggaaucuuauaauuaugguggaaggcgaagugggagccaacacuucacauggcuagagcaggaggaagagagagggugugcgggggggugcuacacgcuacacuuuuaaacgacgagaucuugugagagcucaccaucaugaggacagcacugagaggauggugcuaaaccauucaugaaaaauccaccccaugauccagucaccucccaccaguauauauauauacacacacacacaguagauacucagaaauugacuaauugaaucaucuguuaauucaacaaguacuuacugagcaucuacuguguaccaaauguugaagacauaaugauacaugagacagauguccuuggaggguuuagucuaaugagggaacaaaaaauuaaauaacuacacauauauaaucauuauuuugauuuauuggauggacaccugaaaguuuuguaucucugaaaauacucagcacagcaguugcacaggauacaauuuuuugucuguugugugaaugcaugauuuaagaaugugcaggggagauaagaaagugacugcaccaaggccuuugcuggguuaugccaaugaguuauuacaauuuucuauucuguagggaauaaagaaagcaagugucagugaugaguguugcugggguugacuuucuguuuccuuccauacacagucucaaaagcagaacauagauauuaacagacaagccaaguuugcugcaaccccuucucuggccuuguuugugaaccucaaaaaugugguuuguaaaauaggagaagaugcugaaguccucaugucucuauaugacccuguggaguccaaauucaucaggugggugacauuucuuggcugccgucuuuccucuuugguuaguguuaggaacuugggaucagaaccacugaagcgucccauucaugcugagaggccuuggaugaauggcugcuggacacgagcaagcagccgagucaagagcugucuuagacagugugauggcagccagguugggcucugggucagggugaaccuucuugcguguagauugcuauuugcucguagaguuauagcaguugcagguacacucuggccguaucuuaagaguguagcugaagauugaaguaauacuuuguuuccuaaguugucuucguaagauuuuauauauccuggucccucaaauaucacuauuuccauuuuucaaaauuugguuucuaugaaugccauuucugugaguuuugucuuguuuuuucugcaagaugauuggcuggaauacaucauuuagaauggugccugccacauacagacugucaguuaauauuuguuaaaugaaaacacuguaagucuauuuuuuccugcuuagccuucaguauaacuuucucuuugcccagauggaaacaaugugguucaacuauguaugaauuaugugugugucuguguauauguuaaaacucuaguaucuucacuuguauuauucaaaauuugaaaacuuaguguaugaaugauacagaaaaauacgaguggauuuuauucucacuucugauaaagacuuuguuuccucuugacauaggaugcaguuuuuauuuuacaauguauuugguuugucauagguuuugaaauaaacaugcauugugcugaauuuuauaguauugucauucuaaaugaacaaauaggcucuuaaaaaaaaaaccaacuuagaaauaccauuugcaaguaguucuauuacagugacaacccaagacauugcacauuaaaacuuggcaagguuuuugugcuguggauguuaauugaugaguagcuguaugugauacuuuugauauuuauaaacucaauaguugucuguauagugcacguacaugguauuaauuaugaagcaauguggauguacauuugguacccuguuauuuggaaaauuaacuugcuuuuauuucuccauuuuucaagugagaacuaccugguucgcugguccaguucaggauuaccuaaagacauagacagauuacauaauuugcgagccguguuuacuguaagugcacccaaagaugcuuaguugaauuggcuaccauucuaaggacuacuuuuagccauuucugucugccuuccugcgacacuagaacaugggucccugggaugccuguauacagguuaauuuaguauuacuaaguagagcgcauuuccagaaaucaucugagucucuagccacccuuagaaucaccgugacaaagauuuaccccauuaacauggaaugugccucuuaaauguguaucguuuuuauuuuuuuccuugagacggagucuugcucugucacccaggcuggaaugcaauggcgugaucucggcucacugcaaccuacgccuccuggguucaagcaguucuccugccucagcucccgaguagcugggauuacaggcaugcaccaccacaccuugcuaauuuuuuguauuuuuaguagagaugggguuuccccauguuggccaggcugcucucaaacuccugaccucgugauccacccuccucggccuuccaaagugcugggauuacaggugugaggcacugccccuagcccuuaaauguguaucuuaagcucacuuaacaguaauugacuauuguuauuaaauuccuuuuugucauaugaauaacugauuaaaaugauaaaaacuggucugagaagagucucaauccauuuuuuuacuguccuuuucauuggagcuugcauugaauaaugggucuccaaaauaauuuauggaaacuaauauuucuaggaccucggaagcaaagaccugaaaagggagaaaaucaguuuugucugucagauuguucgcgugggucgcauggagcugagggacaacaacaccaggaaacugaccucgggguugcggcgaccuuuuggaguggcugguaaucuauuucucuguguuuccuugagaguuucagaucuucacagucacuuucaaaagaaucacuguugaauguugauuggacaaugcacagcugugauuuauaagcuuuucugcuggagagaaaaaauauauuuauuaguuauuuucauuguggcuucaaguugaccugcuaggcucaggaugcucuaguccucaaguuucagauauaaaucauauauuugguuuuaaaguggaucccaucuuucccugggagugauccugacccauauucucagucuguagggaagccagucaguggagguuuucaggucuuggugauggacauaagaauggauaugugcaggacggucaaagcaacgaagaagaggaagaaaggcaaacugugaagagaacgcgguuagcuucauguuggugcucuucauccgccauguuggugcuguuucuccgccauguugguguucuuccuccgccauguugguguucuuccuccgccauguuggugcuuuuccucugccauguuggugcucuuucuccgccauguuggugcucuuccuccgccauguuggugcucuuuaucugccauguuggugcucuuccuccaccgugcuggugcucuuccuccacccugcuguugcucuguuauuuuuggugacagcacgaggaaugugaaagaccaauuaucucuguugaggaaagauaaaggcauacccaggaaguucugauuauuugcccuaguucacugugacucucauuuuucauaguuuugggaagugguuuucucucuuuuaugguugcaguacaauuucauuaccuagcacugugauauuuauuuuaauuuuugugauuuuugggauucauauggauauuuaugagggaaaaguuccugauucuugacacauagcuggauuuuuuuguaugaacagcuauggaagacauucuuucccuuggcuaccaggaaacucugaacuuaguccauccccccugccuuuuaaauaaacauuauuuuuagaagaguuuuagguucaagcaaaauugaacagaaaauacagacaguuccuauauauuucuccuuccuucccccugccuccccauuaucaguauccaccauagauugguacauugauuacaguuggugaaccgcauugacacaucgucgcccugugaagucuguaguuuacauuagcguucauucuugauguugugccuucuguggguuucgacaaaugaauaauaccguauauucaccauuguagucucucacuggguagcuucaccauccuaaaaguccucugugcuccgccuggaauuuuuggaaaaauauuucaaaucauuuaaauaaaugacuuacuacaucauaaggaguaagcaauagcagcgauauagacauuaugagagcagcauauuaauucaauuuacuugaauucaauuuacccauagagcuaacuaacggaguguuccaaugauuuuaccauuugugagugaaaauggugagggugagguguucuuucugaaguccccacagccuugggcuggggaaauccuuuugcauuuucaucuuucugucuuuuuguuuuuaugagacagagucuaacucugucacccaggcugugugaugacagcucacugcugccccgaccuccugggcucaagugauccuccugccucagccuccugaguaacugggaccacaggcacaugccgugcuaacauuuucaugucaugacuugaauacauacuugaaaauugccccucuauuugucagagccuguagcaucuuuuacauguaaucuaguguuauauuuaaaaugccuuucauuuuccaggauuguuuuuuuucuuuuccaccuugaugguaguuuuaagaaaauauuuaauuuuugucucaggcauaauuggcuucauuugagcaaucagagacaucuuugacaacacacggaagucgcuccucuuuucaacagcagagcuacacauucucugguuauuagauuacaagauggauugugucauaaguuccuacgaaugcguaguuauauuucuuaaagaugaaauguagaccacaggcugacaguuuuuaccuucuuuugauuaaaauuuuuggaauuuaaaaauuuggaauauuuuucaguuuucauuggguugauauuccaggaaagucuagguacuaauggauggagagggugaugggcaugggcucagcugacaccacuguggccuuccacuguuucuuacaugcucacuuaugcuugcuugguggggucuagaguuagguugggccccccagcuccuggaguucuccaugaauuacagaagccuggguuauucacuggggcagggcgggcagccuggacauaguuccuuguuucuggagccccuaccuguguaguguuggcugagacacuacaucuggucccuggaguuuggaugccuggcuguguggccuccagggacuucuguccccugauaucugcugaucacauggacacccccuuuggucccugguuccuccugucuggacuggucucugguuccuucccuuccugucuugugucucugguacccacugauaucggggcuucugaaaacccaccuggggccaaguucuagccuugucgucuugcucgugaauuuuccagaguguggcuucuccucacugcucugcucugacuggcacaugggguguccccccucacuuagggguugcaaagaaccugugugaaccugcaugaaccugugugaaccucuauaaaccugugugaaccugcgugaaccuuuaugaaccugugugaaccugugugaacccacgugaaccuuuaugaaccucugaaccugcaugaaccugugugaaacugcgugaaccugugugaaccucuaagaacaugugugaaccugcaugaaccugcgugaaccugugugaaccuuuaugaaccugugugaacccacgugaaccuuuuugaaccuguaugaaccugcgugaaccugugugaaccugcgugaaccuguguaaccuuuaugaaccugugugaaccugugugaaccugcaugaaccugcgugaaccugugugaaccugugugaagugcuucagagauacccauaggcauuuguuuuccucugugggaagauuucaggccugcagcuguuaauguuggguugccggguccuuugaguucucugucccuucuggugucacaguugccuagcaguugcugguuugccuggcuccacuacaugcccuggguggggauguccuguucaucccuuggugccaagcacugagcacugagccuuuguggccucugugcucacuccagaggggccagccuuccuagcccugcucagcuggugugugucuguacauuauaaguaagaaacuggcugggcgcugccuguaaucccagcacugugggaaguugaggugggcagaucacaugaguuuggguguucgagaccagccuggccaacaugguaaaaccuccuaucuacgaaaaauaaaaaaauuagccaggcaugguggugcaugccuguagucccagcuauuuaggaggcugagggagaagaguugcuugaaccugggaggcggagguugcagugagcuaagauugugucacugcgcuccagcuuggggaacagggagagacucugucuccccucccccccaaaaaaaaggccagguacaguggcucacaccucuaaucccagaacuuuaggaggccgaggcaggcagauaaugaggucaggaguucgagaccagcguggccaguguggugaaacccugucucuacuaaagauacaaaaaauuaguugggcguggugcugugugccuguaaucccagcuacucaggagucugaggcaggagaauugcuugaacuggggagguggagguugcagugagccaagaucacgccagagugauggggcgagacuccaucucaaaaaaaaaaagaaaagaaaacaaaacaaaacaaaacaaaaguaaggaccugaucguucugcuuguggaguuuccaguuuccuacuagaaacucuucucugagacauuucauuaugugaucuggcuauguaaauuuuuggcacaaaaaguaaauaucuuaaugcagugguucucaauccuaacugaauaugagaaaaaucuugcgagcuaucaauaaaaauucuuggucaggugcugugguucaugccuguaauccuagcacuuugggaggcugaggaaggcagaucgcuugagcccaggcauucaagaccagccugacaacauggcaaaaccucgucucuacuaaaaaauacaaaaguuagcugggcgcuugguggcuugcaccuguggucccagcuacucaagaggcugagguggggggaucaccugagccuagggagguugagacugcaaaugagccaugaucgugccauuguacuccagccugggcuacagagucauccugucccccccaacggcccccugccccgccacccccccgccccaaaaaaaagaaaaaagucuugcacaagccccacuccuguccagguaaaccagaaucucuacuuuaaccaaaaucgcuuguuugucacuaugggccacucagugacuggcaguuugcugccaccagacuaccuugcccucccugcucugccccgcuuaucacaugguggcauucagcacaucuggggaauuuuuuuuaauaggacuugcuucuaacuuauucaguguguuguccaaccagauguucucuuuguuacuaagaaaggauacuuggucgggugcaguggcucacaccuguaaucccagcacuuugggaggccaaaguggguggauugcuugaguccagcaguucgagaccagccugggcaauauggugaaaccccaucccuacccaaaaaaacuaaaaaacaaaaauuagccggucgugguggcgcaugcuugggguggccaaggcaggagggauugccugagcuugggagguugagguugcugugaaccgugauuguaccacugcacuucagccuaggcaacagagugagacacucaaaaagaaaaaaaaaagggauagaagggaugcuucccacaucugagaagguugaucaacauuuugguaaucguauucuaucuguucauaggcuacuucaauuuccacaugcaaauuuaauuuugaggcuuucuuuagaaugacuucugcgugucuguguuaacagaguucaguuccuuaaaaugagaaaguguccauggaccuuuaagucuacaguucuuagucuucgguugaaaagaaugugucacauuucugucuuuuaaccuuuuuauaauguaaccuuuucuaucuuuuucuaaaagauagaaaauuguaaaaauaauggaaauuuuauggaaaaguguaguuaaauaaauuauccauaguuuuacauagccaggguaguaccucauguuuauucugauauguuuguuuccaaauuauuuuuucuguguguggcauaugauuuuuaaauacaauaucccguccuaccauguauuuguuuauuuaacugauugauuuuuuaaugucuuuuuagucccuuuuuugccaucuuaaccauuuuuaggcgugcaguucaguaguaaguauguuugcauugcacauacuuuuaucuuucuaacaaaccuagcauuaucuuaugaacauguccuuuuauuaagcauuauucaaaaauucggcuucucaauggcugcagccuguaguccugugauuccagcaguccuuugcuuugggcucugagguuaucucagccuugcgguguaguagcuacgcagugagcauccuggggcuugaagcaucccaccugugccuguuugcaggccagccccugcagcggaguugcugacucgcaggguguggggguccaucugccgugagcaagucauccugaugcagccccaccagugggacugagccaucagccccucucccugcgagacguuucucaccuccugccuucugcucuccugccugugcuggcccugggccucugucacucuugucccaacgccacugccuccuuccuucuccugcccucugucuuccagcaucacgcggugccgucugucuacccggccucucccucacacagcuguacugacuucagcuggacucugucuuuucaccauccucuucccugaauguagagacccugggcuggcuggcugggggaauuuuucccccaaguccuuuauuuccuccuuuggugucagggacaucuuguccaaacugcagggagcacucccucugcguggggcugugugcggaagagcagucaggggagucccugggaagcgcgaugagcggugaugacuggugacgucaaggccuucuccucgaggcucaggaugggugcgggacucgggguguuuuccaccugugggugcucaggcucugauugcguuucccgcuuguuugcugccuuccugcacaugguccuguguuccagggcugggcacuggggauguggcaagggagucccauggucagcuggugagaugagucccauggcagagcagagcucugcaggcacccagcaaggccacccaggaccagcuggcaugugagggugggccugcucgggucagacucccuugguucuggcucaucgugggcugcugccuaaaugaguuuauugaaggaugcugaacugguggucucgggcaucuuggaaaaagguaaaaaggugggugcugcagucagucgcgugugggucagucacccccaagagugcuggaagcugggaaacgcuucccccaggccaggugagggcccguguccagaccaugcauccucugagcagcugucauuugauguugcaaguuauuugggauucuuugaccuguaucugcaaacacagccgugggcuccuggcucuuugaggccccuugguugaguggagugagugugggugucgucucuuacgacacugcugaggccccuggggccccaccagaccaaacaggggaugaggaugcugcuuuuuugguucuauguaucccuccuccuuuuuggaggguggugauggugaugguagaaaggaaaauuuucaauauaugauuacuuacauguuggacaaaauauauuuagacugauccucuuaccugaacgcagagcugggcuacagagagacccuucuggggaaaggucuugugcgaagaaaauaaacaaggcaucuuccucucaaguccaguguggcgguggagcaguagcagacacagggaaagugacccgggccaucugggguuauucuuggacuuucuuguucugucaugaccaagggcaaaaggaauuguuugaaagguagacagugugucuggguuuaccccugaaugucaucagggaaugucuuuuaacacaagaagauggcaaaggauauuagccuuucuugugauguuagcaagccuggaucucccgggggguguguuugugaaggcaguuuaauaggauugaaagagcuugggucuuggagacuuucucgcuguagacuuugagcaugcuuguucaugccugucuuugagccucaguuucuugucaguaugguagguuacugaggauuugccuugaaguguccucuugaaagagcguccacagauaccagcauguggugggugcuugguaaaugguagcuacuuguuggcuuaauuguuugcgggaaagcaaaagugugaggcuucagaacagugcuggccagcgugguaaccacuugucacaugugacuaguuaaauuuaaauuaaaugaaugaaauaaaaguaaauuuucaguuccuccaucacgcuuucuacauuuucuuuuuuucuuuuguuuuguggcagggucucacucugucacucaggcuggagggcaguggugugaauucuguucacugcaaccuccaccuccugggcccaagcaagucucccaucucagcuuccugaguagcugggacuacaggugcacaccaccacgccuggauaauuuuuguauuucuuguagagaugggguuuugucauguuacccaggcuagucucgaacuccugggcucaagcacugugccugccuuggucucccaaagugcugggauuacaggugugagccacugcgccuggccuaugcuuucacauuuucguugcuuguuguuaauggaacauuuuccaucauuacagaaaguucuauuggacagggcagcucuagggugacaguuggguaauaggcaaaggaaauuauuaaauggaacucugccauuugagccccaauuccauuugggccagcauuuucugauaacuuaauuugucuuucaagcauggaaauaauuuagacuugacuaugagaaaacagcuuuugcuguuguuugccagaagauauucugauguuccuuuguuuguuuguguucugugauuauagcauuuaagccaaaacaaucucuguucucuuuuugucuccagugauggauguaacagauauaauaaauggaaaaguagaugaugaagauaagcagcauuucauucccuuucagccguaaguauggagcaauucaaguacuuagccagauauaauguggaaaacauaggcuuguaauaauuaucuuuauaauuaaauggauaaacauaacuaaggauugauuauuuuguaauuaugaaaaaccucuuuagucacugcuguaguacauggaauuuuuuguagccauaagaauccugggucaaaguuuguuuaugguccuggaaguaggagauuuuacuuguaaucacugaauugccuuauauagaaggcacagaguuacagcucugcucugagccugaauguuucuuuacauaauugauuuauucuaguagcuauuuguauuuucaaagcacaauacuuccaaauucaucauaggagguugcuguuuuuaaaauaaaaaaacaaacaauuaugaugaauuauuuuaaagcgagaaauaaugcuuuaaagcauauaaucacacugcugauuuuugugucucgguuuuugcuuagaguggagccuaucuguguucguuuuuaggcuuucucuaguucugaccugaagucuuuaaagaggcacggaagcugagaaaaagcucuuggaggagauucauuaaauugauuaucugauuuguggguagaacccagggaacuggugggaagaacuggcguuuauuucccucguguggaagcaagaguguacccagaugauggucguuggccacuuaagcacuccuacuccucacagaggaggagagaaaaaggaauccagaugguugagguuaauuguaagagacagcuuccuccugggcgugggguuggguggcgauguuaggggagaaggcaugguaagggcaguggaagccaccugccauagugcucugcaguuucacuuuucccucauuuuuauucuuaaucgacuucagacuugaaacacauuucagauuuuagaaauuuuacgguuuucagcuguuggcugaaggguuuaggaggcggguaguaauuggguggcugaaggagcccuguccuugggggcccggagaugugagguugacuucccucugccccacgcauccuuggugauggaccaccgcgcucaaccccacccgacuccucugggucuugagugccacuggcuaagacaggaagaguauggcuuucuuugcaggcgggcgauguggucacauagcacccuaaagcuuuuuguacagcucaguaggagauuuugcuaucuucuugacguaagaauaacagcaaacccugcguuauugagcugggagucaggguuaaguuauauguaucucagcaugcacaacuagaggcaaaggucucuuuguggcuuaaaugcuuuagguuuacucuccuguccaauaugguaaccauuagcuccauguggcuauuuaaaauacuuaaaaugagcugggcgcaguggcucaugccuguaaucccagcacuuugggaggccgaggcaggaggaucaccugaggucaggaguucgagaccagccuggccaacauggugaaaccccauaacuacuaaaaauacaaaaauuagccggguguggcggcaggugccuguaaucccagcuacuugggaggcugaggcaggagaaucgcuugaacccgggaggcagagguugcaaugagccaagaucacgccacugcacuccagccugggcgacagagggagauucugucucaaugauaauaguaauuagaaugaaguagcauuaaacauuuaguucuucagucacauugguccuguuucaaguguucagcagcaggggaggucaguggccccguccugggcagcacauacauagcacaucuccagcacugcagaaagcucugcuggauuauguuguuuuguagucccauccagugaggagaguuuauaaagggaacacagugcugcagaaucuggaaguuuccuuagcaaacaaggggaacaguaucauggaacaugggcagauauugaggucauaaauaaaauacaccuuuguaaaauuauaauauuaaauugccucauucucucaugagaaauaaugcagcccccugcuguuuugaaugcuguauuauauauuagaccucagagguucuugaugcccagauguaacacuaaguugaaauuaccuguugccugcuaguguccucugugaaaagucaaaaacaaaaacaaaaacaaaaacaaacccaaccugagggauuguuugaaagguuagggagguuauuaguuuuagauucacugauuuucacagaacauguuaugaguuguuugagauugccugugcuuugacgccaucuuuuucuaucuuguaguggaauguccacuugaaaaauauguuauuccauguguaacucuuauguaauuugugacuccaugcuccauuaaaggaagacuaauagacagaugaauauuugaaguguuggaaacaaaagaacagcaugauuuuuaauagcaaaauaagcagugaaaccaguucuuugggaaaugucgugcuaaugaaaccauuuuuugcuccauuaaaacugauuuauuaucucacaggguugguuuuagagaaggaagcacauugcacaucucccucccucccugucuuuuuuaacuuggugacguaaaugacaacagucuucaguucccucgagucauguggcucaagugauggauagcacuguccuuguucccaggauugauuuuaaacauuauggccaugcugucuauuuucuugcucauuucauagugcacuucgcugugcuacaugguauuucuauuugggcauaugccccccguuuguagccagucucucguacagcgcagcaucugucacaggcuccugguucaugggcccugaaaacguggguggucuguguucauaacagcgccacacgugggacuaggcagugguguucuccacacacgguaccauucuucucacauguagucacuugagggacuauuguguacguaguccaggaggguagaguagaaagccuuugcaagcaguuagguuccagggauuuuuuuuuuuuuaaaucuugauuuugcuuuucccuuuagaucaaccugccccuugaccuaugcuauguucagaauuaauugaaauuggaggaauggccauaaacauucuuugggauuaaaugccuuucaaccauguggcuuucagacaagcuccuuuuuuuaaacacaagagucugauggagaugcaguggaggccuggugcacguuuauuccuggggagaggguugcccucauuugcucuguucccucucgugguucagcauuuuccugaucaaugcuuuucccuguuucucuugucaccucucccauccuuugucgugcguugacucaugaugccucccucucgcacucggugacgaugaucucuuauguucccuuguuaccguggcccaugggucucugugccccuuugucuccuguggucuuggucgucccgugcccuccaggcucgcguuggacgacgccauucgacacaagccgcugaacaugucaucccguuuuucacccaggguggcaggggagaaugacuuccuucagacuguuauaaacaaagucaucgcugccaaagaagucaaccacaaggggcaggguacguauuuuccuauuuuguuucuaucagcguguauuugcaugcguuggggcagugcugucuggguugguuuuaguuugauguugaucaugaugguggugauaaugauggggaugacagugaucgugguggagaaugugugugacaguugccccuguguacagugcaugaugguuuucuugcccgucaccuuugugaacauugcugagagcccacuccuggauggagaguggggucagauuagaaguuuagaggaacaugcaggcgguaggcguaacucccucugcccguguugugugcuaaucuuugccuguucugggucuucccugcuggucucccuaagaaggugauuucauuugugcagacuugcuccccugaguucugucauuuaagugauuucuccgccccuacacuccgccucacacucacuguuuuuaauccugcacugacacguuucugagcagcugaccugcugcuggcagaaggaaugaaucagucaccucgggcuggugacaguuggcacuuggcuggccaggagggcugccaggaaacaacugugacugaggccccgccuccagcccaaggggaagucaccuucagaacuugaccgucucacucccugauccaugcagacugcccguaaacgcgguagagcuuaggugaacagaccugcuucaucguccagcuaccuuaugucacuagacuuuuaaaaaacaauuaucuugauucauuuccacuguucuaaaggagaaugugaauugagccugaagaauguuuuagagaaugagccuuccuagggaucugcagggaccuccagcuuucuucuggugugaacuaccccccuuucuggcaaacaguagcaggacaaaaaccccaacccagaacguuaaugagauguggccucugcagacagagcgauuuucagcugacccaggacccaucuucuccuaaauuaacagcccucccaauuuacacuuuaauugaaaaccacggggagguccaauuagggcuguuuagauuggagucacucucaggcugggagugccagugcaaagguugccagccgauccuucagugcuucgagcugggacugcccucggaucuccaguuucuuuugcagucaucggaguuuugauaaacuuuuauuagagucauucagggaaaguggaguuuggugucaggccagcaggaaaucacugggaaagaggaccagaagccugccucugccaggcucacugguguguggccaggaucuuugaagccggcgaaccuugggcucauguccggggguccaguuccuugaacuucugggaggagugggcauuuucaagucacagugaaaacugagggagaagaacagugauaguuuugucaaggggaucacaggugacuuccugaaucagaauggccuuaggcaacaugacuagugcuuguuuuccuugaaccugaauuuucuccagggcacaaugguggguggaauucaggucagaggugagugauguggccagugagggcagccacacagaucggccgccgggacugcagggcgcugcccaccggcgcucauuuuaucaccagcagcccaggcuuaaccugauccuugcuugucugucaagugacuguuagcggccccaggaguggaagggacauggaggagauacucaucuucagagagaaccacuggguuuuuucacaccucuguccacaugcgccuccugucucuugagcucaccacuuggccuuggccaguuuuugguuuaugccaacauguuuccucuucacaagagacaaaaauccugaauauuuaauccaaauuauucugaucccugaacccagaggugugggacauuuuauguggacagugaauucaugaagacuccagacaucugguucuguuguuugagauagaauguaugcuaauccucuuuguuuuuaguuauucugcuuaagcaaaugucaaccccaaaugcacuuuuuucuccugugagaaaagcauuuaaaacacagcauaaucaggaacauuuaauuuccauuuuuaaagcgugugguaauaaauuuaaugugucacuagugcauuaguuuauguauuaagauauuugcgcaggccggcguuucugagaaagguguuugaaacacaggauuucuaauauuaaguguuaaguguuccauccucaugucucaaccuuugaccucuguagauaaugaccucaccacauccugcaauccuucaaagagcaucuuucuguaagauauauuuuguggacauucauucuccagggaggcuuuuggacucaaacuccugagauuugagaaacucuuagcugcauccuggugucccagggaagaccagcucccugugagccacggugccaguuccucaggcucuucugucagggucugggcuuugguuugcucucccggaggccagggcuggggguuagggugaggaagugccuggcccuuugcccaucugucugcuuaccuauucugcaggucuggagcugcuguuagcucagggugcuuuugugugaauuagaaaaaggggccucaucaaccaggugaguagggagaugcagccagcgccaggaccuguggcucugugagcgaguagaggcaggguuuagcucccacuugccuuuuguggucacuugucuagugaaaugcacauucugggcagugguacaugugcuccugucugggugccauccccgauaccucuuuggggaccgcuuucuauuggugguucuuccuucuucaaacucucccucccaugaucuggaauuucauaucuuaaaaagaaaggaaaaagaaaaaaaauauuuaaaaaaaaaaaggaaagaaaagaaacaccaagaagcaguccuacccugaguaauacaucugucucugucuauguggccucucccucuggucuucgucucccauucaucuucacccuucugccucccagcaucggcccucucccugagcgcccccgcccccucugcccccgucucccaccaggagcccuguggcugcaugggcaccaucugucccaguuuuccauuuccccuguuaucucugaggucucuguccccuugugagcucucaaagugggccuuucuccugccucuucggggcucuucuuuccuuccccacucugggugcuugcccuucaggcagcucugccuggagcgagcgggucuuccuauuucaaggaacggugcccccgggacuugcuagugguugugccugcaaggggcaccgucucuguaagcugcgccuccuccuaccccaacuccccgugguucugcugacuugaccuucacgcuggucccucucccacccuccauaguggcauucacguccugccagccagcuaggaucaugcgguggccucccugcugcgauuccauccccacugugcucuguucuccugccuacccauucccuguagccacagggugucaggucagagccugacucuuguuccugagccccacucugggugccccccauccuucagauagaccacagucccugccaccccagccuccgcacugucuuaccacagcgucugggggcuccaccuccccugggugaggacaggccugcaguucccucacuuccugcaggucucagccccgaagucccuuccucugugacccuugagacuguggucccaggaugccuugcagugugcucaggacuucucccgugagaacuucgcaguugcauauuucucuaagagaccauggaguuaguguuugaccguuggcaauggaagcuaaacaccugucaggggaggucgugagggucugcccuaugucuccaguaggugcagugcccaguauuugccuggcacauaguaggugcucaguagcuacuuuugaauaaauuagagggacucacuagauagcaagaggaaaggggguuucaccagcuggcaaagaacaaaacaucaucagugacuuuugacuucucagcuccagcuaauggaaaucugagcaaaggagaaugccauuuccaggauagcggauauaggaaugggcagccagaggacagggcgugaggugcgggauugaaucaagcagggcugcucccgucagggacagccggaggugccggcaccgcugucgguuaccucccagugcugcucagaaggcaggcugcuggagaacaggccugugacugucucaguuccuuccacgcagggcagggcgcugagcugagggugauggagggcagguucugcucuggaggcaucugaagaggggacagcugcacacacacacacauacacacacacacaugcacacauacacacacacagauacaaauaccacaaacacagacauacgcacauacacacacacacaccacacacacacacacuaacacagauauaaacaccacaaacacagacacacgcgcacacacacagauacagacaccacaaacacacacacagauacacuacacauacacacacacagauaccauaaacacacacacagauacaccacaaacacacagaugcagacaccacaaacacagauacaccacacaccacacacacacacacaccacagacacacagagauauaccacaaauacauacacacgcacacacacacagauacagacaccacaaauaaacacagauaugcagauacagauaccacacacacacacacacacacacagaugcagacaccauaaacacagauacaccacaaacacauacacaccaacacaugauacaccauaaaaacagacauacacacacagauacagacaccacaaacacacacacacacacagauacaccacacauacacacgcacacacagaugcagacaccauuaaacacagacacacacagauacagacagccccuuccacucagauauacauauagacacacacagacacacacauggguauagacacagacacgcacacagacauauauauauacacucacacagauacagauauacacauaagcacagauacagacacagacauacauacagauacagacacagacauacauacagauacagaaagacacagauacagaaacacagacagacacagauuuagccacacgcauacagauacacagacacagauacacagagacacacacagacacacacguguacagacacacauggacacacagacacacacacacacaugcacagauacagauacacagacacacagugacucacacagacauacgcacagccacaggcaugcgcgcauacccaugcuaguagcagaaaugaggacagaggcuuugauguucugaggggcagaugaggcccuaccaagcugaguggggggaagcaagcaggcagcccccccugaggccucagggacagagcacccccaugugcuggcuuauagugccagccccuucccauggggggaaaagaugccgucgucguagaagacagcucaggccgagccccugccugccccgccuuugacuuguuggaauguguggcuuguuuccuuguacugucaccuccuauuugguugcuacucaguauuuauacaaaccacaguucuuugucagccuugcagggaggaagaucccgcgcacaucccgcacacacgcccuuacacauagaccccaccggguuuacugcccucuccccaggauaccccuggcaucuagguuuagaggcuuugaaagucuucauuucucucuuggagaaaagagccgagagcggcuggggcuuuguuuucuuuugcgguggcacugugguacagagggccugggcuccacaggcugcaccuguccuggcugcggagggcuguccugcugguggcccugcagacuggugcuccacugcucgcccagguugugugaugcugcuuagcuacuugaaacuuugauggguucucgaagcuacgaauucaccuccagaauccuccccugccuuugucuuuccugggagacuagaaaaugacagacuucucagccaccuccuagaaaaagguggccugcugauuuaucuuaaaugucuacccacucaaaagagacauugguccuuggcauuccucagcagcacagugggugcacagcagcugcugaugugcguucagcugucugugagucacccuagggcagggcuggcaucccagcucguuggaugcauggaguccccacgacaggcaccuuuugccuugccccucucuuucucauauacccaccuuuucucucaagauguugaauugugaauuaaaagucucucauucauugaaauugguuucgugaaaacuucuaaaaaugcauaggauaaaaugcgacuuaagagcauccauuguuuuuccagguuuguggguaacauugaaauuacuuccuggagauauccaucagauccgaaaagaguuuccgcauuuaguggacaggaccacagcuguggcucgaaaaacaggguuuccggagauaaucaugccugguaagaacuggcuuguucagggcuucucagcauggcauggggguagccggccacggaggaugacgugugggcagcaucauguaugagcucuggcaaggaaagggcucagcuccugguaggugacccuguaagccccagcaugguuauggaucauggggcugugaccggagugguagaauaugcucccuggcccccuguaccccuggauggaucagcucuccccagcugcaaggauugugugaggggggcgugggcacccagcaaaugucuggguagacaucaggucaaaagaagaaagaggucagaaagggagcugcccauugugaagcccacuuagggcaaauggcaggguuggauggucgcugaauggaaaugccugugccugcgcccgcucagcuaguguacguuauacuggcauuccuccaugaauucuaagucaugaauucuaaacugaccgauaacaggauuugcguguuaacauuaaucucauauuuacauaauacuuuucauuuuccaaauaacguuccuaauaaucugauuugaucaucaagagaucuuuggaagcauguuaauuuguauccuuuauauccgugugauacuuuuugguuugcaaguaaugcuuacguggcuuggcagggcguaguggcucaugccuguaauccuagcacuuugggaguucgaggcggggggaucacuugaacucggguucgagaccacccuggggaacauggcgaaaccccgucuugacaaaaaaauaaaaaaacuagcugggcgugguggcauaugccugucauucuaguuacuuuggggggcugagguggaggaaucacuugaaccugggaggcagagguugcugugagcacagaucacgccacugcacucuagccugggcgacagauugagacccugucucaaaacaaaacuaacuugaaccacgugaggcucuuggaagcccacaaauugguguugagugaauuccuauccagauuaaacuguagccuaaagucgcucagcuaaugagccguggaaacggggacaaacucccccauauucaacgcggccuccuuuuauaggccugugcuguauagccaggagagugguggcuauucagggugcaugcuguaggaguuacugcuuugcuuacuuuagugcaacuucaagacacauucuuucuacuccuuuugucuuucagggcuguugugggucauugaauagucggucugguaaauccauaugaaagacaucuaaauugguuaggcuaaauaauagcuaggcuuaccuguacagaaagaaaagcaugacguuuagucaauucugaagcuauugcuuguguguguccagucuauaugcaggaaauuaauuuagguuuauuaaugggaguggacuaauuuguauacuuauuauuuguauuugcauuugagauacagauuuauaaauuaggaugaagcaauuggcaauaugcauuuaucuuggcauccuuaggauguccucauguucaaagggaaacucagaagcuuccaguucaugccaauaguguuucccuuaugauggauagacuuaaaaacuaagucuaggcccggcgugguggugagugccagguaguagcugcuaguagcagguacuagggaggcugaggugggaggaucccuggagcacaggaggucaaagccguagugagccaugaucacaaccacugcacuccagcuugagugacagagagagaaccugucucaaaaaaaaaaaaaacuaagucuaaacuuguagaucaucucaugauagauucauagggaaaugauacaguugaccauuguucuggcagguuccaugugcugaguccucggguauauaucucacaggaagugauucuagcuugggugggucaucugcguucucuguuggccgaguaaucacuggccgcgcugugggcaccagagagagagagaguaugggcgguuaucagucugucucgcugucuuuagccugcagaaccuguguaucacccgguuuugucacugucugcagggaugcgcgucuucuuuggacagcgcagagccugucccaucacccagcggccugcucugcuacuuucucauagcucguuggacuccuggaauccuuaugaaggauccaggcaggcgaugccaaguuuuccuuugagcugggaagguagcaggaguccacuaugucugcuucuaguuccuucuuccccagaauguucuguaaccuggggaggcauuugaugagggucuauggugaaugcccauuugugggguuugcuuacuguaaaugaggucuuacuucugugcuggcccuggaguaacgcacuugagguguacuugggagugaggcugugggaguuucgcccugucacccgggcuggagugcaguagcacgaucucagcucaccgcaacgucugccucccaguuucaagcaguucuccugccugagccuccggaguagcugagauuacaggcacgcacuaccaugccuggcuaaucuuuuuauuuuaauagagacggggguucacuguguugcccaggcuggucucaaacucccgagcucaggcaauucacccaccugagccucgcaaagcgcugggauuacaggcgugagccacugcacccggccuugaaguucuuuuuugaugaugguguuugugccuugauagaauuuuuaggcugagagaucauggaguuuaugccuuccuuaucagugaggcuguuuaguggugcuggccuuggaggcuaagugacuuguccaaggucacacagcaaaugagcaacaagucuugguuggguggccuugcaccugccccucguccugugcuccacgguucuucucguggucaguaucagugggcggcagccgcgccuccuuccacacagcuacuguggcugugguggcaacccacugggauuaugaugauaaugacuuuuaaaugaaagcuuaauuuaauaguuggauacauuaaaagccaaaauagagcaguuuaaaagaaaaaaaaaagccaaaacaagaaagcaaggagcaaagagaguuauuuuccuuaagggauccuuggucuucagccagaaugggcauuugcugcucuugacggaaccgcucuuuggcuccuugggagagcggguggucagggcgugggagguggccaggcaggcagcagaggagcaguggcugggaacgaggcuuccucuaaaucauguuacuaaugaagcuugugaaguucucccaguugggccauuaccaggggcuuccuauguucucaguaggaagaagagucuugagcucauuucuugcguuuuuuuuacccccuacaauuaaaagcccaucucacuuuaaaacagacaggucuguuuuguucuucucucugugguccccauucgggauccugauagcugccugccagaagggaagagccaugcagaaaguuucucccuagacccguuuuuccucccugauucuaggcuggugauccucauucuuuuuuucuuuauuuuuauuuuauuuuauuauuuuaaguuuuaggguacaugugcacaacgugcagguuuguuacauauguaugcaugugccauguuggcgugcugcacccauuagcucgcuuuugagacggaguuuugcucuguugcugaggcuggagugcaguggcaggaucucgguuugcggcaacuucugccucccgaguagcugggauuacaggccugcaccaccacgcccaguagcuaauuuuuguauuuuuaguagagaugaggguucaccauguuggccaggcuggucuugaacuccugaccucaagugaucuacccaccucggcaucccaaagugaugggaucacaggggugagccaccucgccuggccgguccucauucuuaaucaacuuuuaguucaacucuuggagucaugcuuuuaagaagaaugcauaggaggcaaccuugccaguuaccugggagugccaguggauacugcgauaguccuuggcuacugaggacucagacagccguagccagccgucuaacaagggacaauggugugggcugccaugggucauggaugccaucaauaguauuggagccccucugguugucggcuacccugagagggguagaguguccucugcccagaugauaaccaagcagaucauuggaaacuuugagauuuuuccucuuucuagaaaacuuuaucaugaugaaaauugcucuugucauguauuuaaauggugagacuguuuuguagaaaauauuucauaaucaucuaauauguauuuguaauaaucuaugaggauagguagacagucuugcaaaauucacaauuacgcuauuaauaauggauuguuuuuuaaauguaugauuucuccccccucaggugauguucgaaaugauaucuauguaacauuaguucaaggagauuuugauaaaggaagcaaaacaacagcgaagaacguggaggucacggugucuguguacgaugaggaugggaaacgauuagagguauuuauuguggcgagggcucaucuguaguguuucaguuuuacuugccaagugcucaccuuggcucugcuacagcauagaugucgucaggguggggcuuuggagucccguuucuugggauuggcguugguucuuguuuccuuuucuccagcuugccaugcagggccugggguccucugguccuggcagcuggccuaucucaggaggucccuguggucuuuuuuuuuuuuuuuuuugagauggagucuagcucuguugcccaggcuggagugcugcaggugugugccaccgugccuggcuaauuuuuauauuuuuuaguagagaugggguuucaccauguugaccucaaauaauccgcccgccuuggccuaccaaggugcugggauuacaggcgugagccacagugcccgagcaggucccuguggucuugaccaccuuugcccaaccuuaucguggagucucauuugcugucacaagcccaaggccuaaaggucuagcagucacacuagaaguacagauaccauuguuacgauuugagagaugaagaaaaaugaaggcccuaagaaaucaauuaaauugcucagcguuagagagcucuagggguggaacugagcaccugcucaugacagccagagcucugaccucgugcucuaccuaccggcgaucaugaagaucugcuuccguggccacagcagccugcaggguccaccugggagguacuuagaagcuauugccuccucugaugaccagaggucaaaucagagcugcugucccugugaggugccucuuugcaccagugcuggaggacugggcuuuucugggcccaugggguugugccuaaggcucagugucgccaagagaagcauuaugucuuucucucugggugaacucuguccagcaucacugccugccucgucucccuggaaacauaggugcugcccuugccacuggucuuucugguuggagugaagcaaacaguguucauggcuggaggaaggggaggggaggguucccacuuuuuagucuacagucccucacccuagaccuaugggacggaucaggcaacuuccugcagauccuaauguuaaaguuauuaggguugagggucuggggaacuggaggucagugucauccccaugugucauaaccaucaagaucuucaaugugugagaacagggguuggagcuggccgcuggcuucagguggaucugugcuucccuugcugggaacguguucauuugugguggggguguguugguguucuuggagcguaccuguccccccacauauauagugggagauguauauggugucaagcucuaugaggucuuacgugagcucuuuaugucuucuuuuaaagcaugugauuuucccgggugcuggugaugaagcgauuucagaguacaaaucugugauuuacuaccaaguaaagcagccacgcugguuugagacuguuaagguauuauuuacauggucauuuuaucacauggcgcugauuaugaaaugcucauuuguaacccaaggaaacauccuaacauccuccucagcccgggagcugcuccaggcaggcagagugucucccaacaaagucauucaagguugcuaaggaaccacacugguguuucuuagaauacauuuacucucaucuccuuuuggacguaaaaauaggacguucauggagacaaaugacagagucuuuuuaagauagcuauugucuuucucuucccaguacuguuuuauguguggcaugcugucuuuacaccaaacaaaaaaaccgagcugccagccuguggaggucauugcuggggagugggauccuguucuguagcucugauauggugccuuuucauaaugcagcgugcucacaucuccacgauggaguaaacaccgucucaccgccaagagcuugaauauuugaaaaccaggccagggguuggcucuggaauacagauguuugaugugagaauuagggacaauuuuugcuuagaggcagcauguauuaggucuuuuuucuuugaguguaaugugacaacaggaaagcuuuuuuggcgcagcugugggcaggucaccacagcuguggaaggaauauagacccuuccagguuggggcuaagaagaaaaacggcaacuuuucuuuuuuugagacggagucucauucugucacccagacuggagugcaguggugcaaucucggcucacugcaaccuccacuuccuggguucaagcgauucucuugccucagcuuccugaguagcugggauuacaggcauguaccaugaugccuggcuaauguuuuugguauuuuuaguagaguugggguuuuaucauguuggccaggcuggucucgaacuccugaccucaagugauccacccuccucggccucccagacugcugggauuacaggcaugagccaccaugcccggcccaaaaacagcaacguuuaaaaguagaaucuuggccggaugugguggcucacacuuguaaucccagcacuuugggaggcugaggugggcagaucaucugaggucaggaguuugaggccagccuaacauggaaaaaccuucucuacuaaauacacaaaauuagcugggugugguggcgcaugccuguaaucccagcuacucgagaggcugaggcaggagaaucgcuugaacgcaggaggcggagguuguggugagccaagaucgagccauugcaccacucuagccugggcaacaagagcgaaacucuguaucaaaaaaaaaaaaagaaagaaaaaagaaucuuaacaguaauggucagagcauucagaaaaaaaaauucagcugugucacggagucaguuggcuuggcagcuguuacaauaugauacaaaauuuugcagaggcauuuugucuuuggaaaaaucauauaggggacuagguguacaguauuuucaccacugcaguuagaaauguuuacaguuguaccugauagcuccaguugaauaaagcuguuacgcuggaugauauugauaacagugcuuaaacuucuuuuucaauucuugaagguggccauucccaucgaggacguuaaccgcagucaccuucgguuuaccuuccgccacaggucaucacaggacugugaguagucaagcacuuucuucccccaaguauuuuuaagggagaacugggggaaagcgcgagaggccacucucaguuguucuggaacucgcuaucauaacacaauaaggcucauuucccaccggaaccuauuccuuggaaacauucuucucucuuuuccuugagcagaucucaggaggagaucuuaauuuccuucuccaguuccuccuacccaguguugcugguccccuucuuucuuuugcuuuccagucuuccguguugacuugccauccauccaugccauccaucagaaaaguuacugagcuguaacaaauaccucucaaacaugggcucuuaaggugccugucuuagaauuggaaaucuugaacccuuuuugucuuccuugguggcccuugcugucuggagcucagggauggcuuuucucauagacauuuuugugaauacugaccauggugccaagacuuuaggaggaaagaacugcuauuugaaucacucuccuucaaaaagaauuuauuauugaugacugaaauuuguuccaucacauuuuguuaaauuaauugucaacuaaagcuguagcccugugcuagacaguaagauaucacagaaggaaaacaugauucccgucuuucagggugugugucucuuuggcauugggaacugagacauauucauauuugggacaauaaaugacaaagagaguuggcuacaggcuugugugccgcaggcaguuaaaggaaaagagugguguggagggcagaccgcccuuugucacugaugaccccgugggggucacaccgugcagugggcaguuucagguucugugugcucuggauggagcuuaagcaugagccucuucuguaucuucauuugaggauaagaauaccuuucuggcuggugccguggcucacaccuguaaucccagaacuuugggaagccaagguggaagauugcuugagccccggaguuugagaccagcuugggcaacacagugagacccgaucuuuacuaaaacaguuauccuggugugaugguauaccuguagucucagcugcucaggaggcugaggcaggaggauugcuugaacccgggaggcagagguugcagugagcugugauugcaccacugcacuucagccuggggaacagagugagacccugucucaaaaacaaaaagcaaaacaaaaaaaacauuaaaccuuccuccuaggguauucuugaaggucaggcaagguggaggcuggccaccuucuggcacgcugccugguauggauaggggcuccauuguaguugcugcugcuggaauaauguguucauucaccugacuauuucuggggccuggccugcccugggcccuccauguggggugggugugccuggacaggggggcugcaggagagcagccuggagagcaaaugcacgagcacggucaugauguuauggugugcagaucaucgagaagcuugggccugcuguuguucaggggaguuggagaggccugguguguggucugcagagcuggggugccggcccaugacugucaauggcagaugugugugugguggggcccggccugggauguggcugacuggagggguuucaagcagcauggagugccuggugguggguggugcauggcgggggagugcggggggugggugguggcuggcagcugccgaaagcaucauugcauuccuguccugucccaacagugcaugcaggccagggguucaguuacaagggcaucagguuuaugucuaacgggagaagcaggggcaggaaggccgccagcuuggaaggcaguucccugccaucucauccuugccccaggaucagauccaggcuaccagaccccagaccaagucggaucugcuaauggugcacaacauccuugguggccgaagcuguaggauaauaacaacuaucagcagauguuggccaucguucacuaugcucuuaucaugugcccgacacaagaaguuuauuguguuauuuggauucguccucgcaagauucccaugugguaucaguauuauuacuucccacauuacagaugaggaaacuggggcuuggaaaccccaggucaggggcugaaaggcacccagguagucaguggaagagcuuugguucuaagccagguccuugugcccgagccuuaugcuccaaugccuugggggaguggcgaggccacuucuuuccuuuggcuuuuauugaguuccugcuguauacacaacaagcugcugggguuucuccucuugcagagcuuagguuugaguugagguuugagauuaguuugcaagaaccagcuagggcguggcagccugugaguaucacaugaauuaggcagagguaugaugugagcggagggugcugguggaauggggguggcugugggcacagguguguccucgaccaaggcauggagggcauggugggggccagccuagugggcugcagugugccccagacccucuagggcuccacgcauauaucaccuugaggcccacggaggaagcagguuaagaacgggguucuggaauccacagaggacucgucucaaaauuacgcucccgucuuuuaacaagcucauucucucuaauuaauaaauuacacuagggcagagcgauagcuccuguagcauuuuaauuuucaaaauccuuguuuuucuugucaguuuuaaguacucauuauagacaagaugcuaucacccaacauaccaggacacaucugcauaauaaaugaagucuccguggccacagcuugugggauuuuggaaacauguugagcaucgcaggugcgaugccgaugaaagccuggaugucggccgcugaccauggccuucggggccuccccagccagcccugcaugcagauaccuggggcagaaacagguagaaagagcugaggccacauugguccccacuugcuacccugaagaggaggcuagcaaagggaacaagugaugggauuucucaccugggaucugaccuugggauuggaaaguuuggugucgauggguuaacauaauaccuuuccagcaaccugucggcaacuccagcugcaccagaccgugugguccacggagccaggcagacuugcagcucucaggcccagcuggccaggagcugaguuuuccuugauuguagugggcuuguuggguagggcggccuagagaaugggcagcucuacccacacuccagaacacacaaccccuacugcuguuccuaagguucuguaaacuugucauauaaaccauccaucucaugauggcugcuagugagcaugcaguaaaaagcgguccauuccucggaugugaagaugcagaauguuaauaaaaggugcacuuacuguacuacuuacugguagggucaguagaagccuucugcugaccauuauugucacacauccuucugaacccuggcuguuuuccuggaggcaugucuuuuuuguugccguuguuuccaaguccacccaaacuuaggaggaacuguucuguucuuugccauuugaacauugaaauauuucaugugcucuggugcccuuuuacagaguuauuuuuuuagaauccuaggguacauauauuuuacuucuguuucuuccuguguuuuuuggcugguugauuauucauggaaccauuuaauuugccaggauguauugagcacaaccaggaaggcaaaggugauaagccauguugucuuggguagugggauccgacgguaaauauuuugagccguggacucaaggcggguggaugugucauucucccucucugaucucuguccuuucaucuauaaagagaaagcucggaaucuguaauuguagagauaguuuccagcucugguccucuguuucugugcucugcugggauugcaacuugaggaauuucuggcagauccauuucuucaguccauguuccucaucuguccuggcuuaucaguccuuccccgccuuuggcccucgcugucugucaccagccacacuggacuucuguccccagaugugccacacugguccucgugagggccucugcgcuaggucccccucuuccugcagcauugacaucuuggcuuaugugcuguccagcuucucagagagaugucuucugacuaauaaauuggauuguccccguugucacugugaccccuuaagaaaccacaauguuuuguuuucuauaucaucugaaagcucauuuguuuguugacugucucccaaaguggcacaaauauggauugaguaccuguugggcaccaggcucuauuucauguacuaggaaauggcaguaaaacaaaaggucacuuacauuccagggucuaguggaugaaaccaacaauaaauagcaacaagaucaacaagauucucuaucaaucuaucucuaucucugucucugucucugucucugucucuaucucuaucucugucucucugucacacacacacauaaacacaacaucugguagugauaagaauuaucacgaaaauaaaucaggugagaggaaagagggugauugggugacuaaugggcuauuuuagacaagauauggucacuuuggaggaggugacauuuuggcagaaacuugaaugaagcgagugagccccacaugcagauaccugggggaugaacuuucucgccaaaggcagcacaauuucacauuggggucguuaguccauugguaauucacaugauggauauugcaaggcaggaauugauuuuaguuuucuguauugacccgcaguuuccuugguggaauggucugccccuucccagccucugucguuuacuguggccucuuguuuccaggcccuguugauuuccgcuggucugggcgucuuagguugaaagcacacagucuuucucauugucauuuuacaguuacucucgcuuucuaguguugcgggcuuuccucugccuucuucaagaccaugcugcucuucuuggcccuuuauccuggaauccguuuucacguuccaggaaaaaucucuucuaugagauuuugauuagaauggcuuugaauuuauagauuaauuugagaacaacugaucccuuuaugcuaggagucuucuuacuuguaaacgugguccauuuuuccauauauuuauuagauuagcuuuaauaccuguuuguauaauuuuguaauuguuuucauaaagguagccuuuguagcuucuuauaauguuauuuugucaugauaauugaaagcaaucaucaauuuuuuuguuuuuuguuuuacagcuaaggauaaaucugagaaaauauuugcacuagcauuugucaagcugaugagauacgaugguaccacccugcgagacggagagcacgaucuuaucgucuauaagguaucugguugcauuggugcaauauugcugcuauagacaguuucagucuuuucugggcucccugaccuggaccaaccuuucccaucauugugaggaagcugcuaucuagcuacauuuaauuaugcaaaugaacauuuccaaugaccagcccuuuuguuguuccuaacgggaaaagaugauauacaauauaacaauaggugccaucuaaaaaugccgugaacaugaauuaugcugcaguaauaagggaaauuauuaaaauguguauuuaauaugauacaaagcaauuacgaugguuacaaggauuagggauaacaaaggguggcaaaaaugguguguugcuguuugugaauugccuuugacauacggcaugacuaaauccacaggccgaagcaaagaagcuggaagaugcugccacguacuugagucugcccuccacgaaggcagaguuggaagaaaagggccacucggccaccggcaagagcaugcagagccuugggagcugcaccauuagcaaggacuccuuccagaucuccacgcucgugugcuccaccaaacugacucagaacggugcguucgagaggagaaacacacucaccccaggagcucugccccaguccugucuuuuccaugcuccuuccuauguggaggugugcuccguaggugcaugaacgucacccauaaggcauucauugcaucgggcugugaugauuuaucaaugcauagaagguggcauuuguucauuuguuguaauuuaaaauucacacuucuacucuggucuaaggguuauucuuuuauuuuuauuuuuauuuuuuaagacaaggucucagucucgcucuguugcccaggcuggagugcaguggugugaucucaacucacuccagccuuguccuccuaggcucaggcgauccucccaccucagcuucccauguagcugggaccacaggugugcagcaucacgcuuggcuaauuuuauuuuuauuuuuuauagagaugaggucucacuuuauugcccaggcuauucccaaacuccuggguucaggcaaaccucccgccucggucucccagagugcugggauuacaggcacgagccacugugcccagcuguauuacucuuaaagggagauaaagcaauggauuuacuucuuaaaaugauuuuuggccaaaggaagguagcgugacauaaaggaaagugcacaagauuuggagucagacuaaaaaccuggaaucggaccauagcccuguguuaacccuggggaugcccuucaacaagucuucugcacauuucugggucuuaucuuccuugucugucgauacgggaauagugccugccucaaagggcuuagugaggguuacaugaacagugggcugggagcucaccucccucuuuaugucuuccccauucucagcuacucucugagauaauuacuaguuaucuuuauuuuuaaaagcugguuuggauguuacuuucuagcccuacucgugcugugggauaaggcacccccugcugacucccacaccccaaagcucagcccuaauguggcagaucacucauccaucagcuggugccgugcccuugugugggguuuggccgaugcuuugagugccugcaccaccacugcuugcagccucuccagugacauugcuguccagccagggguacuucuuauucagagcacacugauguuguugcugucacuccgucuggaagaggcagaaauccuacauuuaaaaauugaaucuuccaaaugcagccguaucacagcugugcagagugacuuuaugcucucuugaagcagagcuugaaaauccaauuuuuuccucuuaacugcccgauacagauuuugauuauuacugucuguugcuaucaugaguugugucucugggggauuguccguaaaucauggcaguaguuuuggauuugcccaagggacagucaucguuuggacuuuaauaggauaaacacaggacaaaaguaaagccauugucuggaagucaggacauuguaguggagcgugcacugagugugcugcauguuugggcaugcgagcccugggucaaaugcuuuuggaucuuuccguuucugcacuuugcacucuguuguucugggcuacacuuucccacugcuggucugcugaguaaacugcuuggugugggagcaguaagucucuuaagugccuuaagccuacuggggcacuuuuauauuccauuugcaugcauuucucgaaccauuuaugaaggguccuagcuugugguuguguaguggucuccaugagcauaugaaaagccuuaccugggugugggaucuaugcagccgugcaguggggaagggagagaaugcacagggagccugcuaguggcaugcccgaggcaugugcaguguauuugucccuguucaugcugcugauaaagacauaccugagacugggcaauuuacaaaagagagagguuuaauguacaguucugugugacuggggaugccucacaauugugguggaaggcaaggaggagcaagucacaucuuacguggauggccgcaggcagagagagagagaaagagagagagagagcuugugcaggggaacuucucuuuuuaaaaccaucagaucucaugagucuuaucacucucaugagaacagcacaggaaagaccugcccccaugauucaauuaccucccaccaggucccucccacaacacgugggaauucaagauaagaucuggguguggacauagccaaaccauaucauguggucagcagugcggggcucaacuugggacuugguuauggaaaggaugcuccccugugacauguuagucucuggauguggccuugauagcuccacucgccugacagaugacagcauccagagccuaauuuaacccaaaggugacaucuccaggugggccacacuuuagcauuucaguaggugccauguguugcagugcucauggugcaggaagccaucaucucauaauugggucauguuccgaaagcaugcucggaagucauuacuuaacuugcucaucuuuccccauucaaagcaaugcucugagcugcgguuaggugaugaggcccauccacagaauccuucuuaacccuuaugacccuggagaaaggggacuguggaccaggacauccccccgggggguggggucaguggcaaucccuccuuucacccucaagcuccuuaagucucaccagcugcagaguaauccccuccccagacugagggagagggcacccugcucucagcagcagcuguugccaggcaacaaggaaauuccgaugugaugccacucaccaggacugaugggaagucugccuuucauuucucaccagccacgguuccccuucuugggauuguggcaugucagguguguacaagauggagcugccccaaauggcgucuaagcaucaacucccacauucucauuugagggaaucauuuuucugaaaccaugauuuguuccugcgaaguuccauuacuuagggaaacgcaguggcugaauuauucauugagguugguauuaaacuucucuguccucagcauuaugcuagaugcugugggggauaugaaagaaguacaagaugugauuccucuucucaauuaacugacuauauaauuagaaaggagucaugaauaugggcugugagucccgguaauaagggccuggggugggacucaucugccuugggcagccucaugggggcuggacaagcccuguuuucuuccagcacucccuuugcuccaagguguuuuacuacucauuagcccaauuggacuuugucucaaacuuacaauacagcgugccaccaacuuugaaugaaggggauccagauuauuacugucuauuaaggaaauacugguaauucuugugagauggaaaucucccuuaacccuaggaccaagagugugucugggcaggauggagccuuuuccauuacuucacuuucacuuagaaaugaagacauguugcccaggugcaguggcucacaucuguaaucccagcacuuugggaggcugaggcgugagguucacaugagcccaggagguuaagaccagccugggcaacauggcgagucccugucucuacuaaaaauuagcugugcaugguggcgugcaccuguagccccagcaacuugggaggcuguggugggaggauugcuugagccugggaguuagaggcugcauugagcugugguugugcuccugcaccccagccuguaugacagagugagacccugucucaaaaauaaauaaauaaauaaauaaauaaauaaauaaauaaauaaaaaagaguagagugcucaauucgucauccucuccugggaugacugcugccauuugugcuuuggacuaggcauucugcuaagugcuuucuacacgucaugucaguuaauucuuacaaccaccuugugaaucaggcaacacuguacccaugguucagaugagaacacugaggugaaguuaccuccccaggccaagugguugcugcaugcuggugguuaggcccacacuugggcgucuuccacgggaucuuugggugcuccuuuuuugucucccuauuuuuaacucuucccuuugucagcuguacuuguuuuggagcuuauugccugcaugccuuuuguacaauuugaugcugaaguuauaauggaugucuguauuuccugauuuucuaccuauagucacaauuagaguuuguuuuuuuuuucuucuucaguauuaacuagaguuuuguuuuuugauucuuucuuuuauggagacaguuucuguagcugaaguugguucaugagcauaacgguaaauuagauguacuuuguuaaugguauuuuuucgaguaaugggauguuaauauaacuucaggugaaacuuggguaggcauauguacuuuccuagagagcuuuuggauccugacuucuuaccuuaaagaauaucuugggccaggcaugguggcucacacuuguaaucccagcacuuugggaggcugaggcagguggaucaccugcgaucaggaguucgagaucagccuggccaacauggugaaauccugucuccacuaaaacuacaaaaaaaauuagcugggugugguggcgggcgccuguaaucuuagcuacuucggaggcugaggcaggaaaaucucuugaacccaggaggcggagguugcagugagcugagauugcgccauugcacuccagccugggcagcaagagcgaaacgccaucucaaggaaaaaaaaaaaaaaaagaaaaagaauaucuugaugccuuaaacaaaaacauuucuggacacugucuucuuccacauugacucuuuaaaaaccaguauauucauuccuugcuuuuucuauauaaaaugcaacaaacaaaaacacaaccauaacaaccacaaacuucuguggaagcccagacauggugagggccggaagcucacucagugcaggcgugaaccucagugcaggcguggucucaguuguccagagcuacuguagcuguggggacucuuaaccuugcagucucaguacuuuaauuuguguuaguuauuuuauuuauauuaucuauaaaaaaauagcagcuuguucuugagcaggagaaacaaaccauuugguauccagugccugggcagcgcuuucugggugagcaggccucuucaggccuuguggugcucugaaacugccuuccuguagaauggaaagacaaguucuuuuuuaguuucccaaaugcacuuuuaaagcuucuacauggaaaucauuucaugguaaaugucguugggaauaaugaauucaaguguacuagguguuaaguauguugcuacaaaggaauggaauauuuagcaggugaaucuuuuaaaauaggguugauuucucuguucacaaaauuuuauagagaaccucacauaaugcaugauuaacagagacagaacagaguuucuugcuugugaagaucugauugucauuuucuguuuccaguggaccuucuggggcucuugaaauggcgcuccaacaccagccugcugcagcagaacuugaggcagcugaugaaagucgaugguggugaaguagugaagguaacauggagcccaaagggacuuuuugggucuuuuuuuuuuuuuuuuuuuaauguauguuaacagaaguaggcagugacuucaaagguaguauaggauugugguuauacucccuuuaaaaaauagugacauagggauugggugcgguggcuuacgccuguaaucucagcacuuugggaggccgagguggguggaucaccugaggucaggaguucaagaccacccugaccaacauggagaaaccccgucucuacuaaaaauacaaaauuagccgggugugguggcgcaugccuguaaucccagcuacucgggaggcugaggcaggagaauugcuugaacccaggaggcggagguugcagugaguugagaucgcaccauugcacuccagccugggcaacaagagcaaaacuccgucucaaaaaaacaaaacaaaaaaauagugacauacaccucuaggugcacagagugcuucuuggcuucugguuuggggggacucucuggguuagccgugaaggggacuggcuuugcaaucaaccucaucguggguucugcguccucuucccauagguccucacuacaggacucacaacaguucagugaccucuuuaagccucucuuuccccugccaugagaagugggguaacaguagugccuucugcagggucguuguggagccucaggucuuuuuacuguugucaugauccuuguuacugccaucagcauucguacuagacucccugagauccccuuuaagugaccaggagaggucuguggugugguagaaagaucacgacacugagaggcuugccugggccgucuucuucccacgggacgcucugcagcagugucggguauaauuauucauucagacccuuguggccucagcaucuuuaucugugagagagggcagucagauuacauggccggagguccugggagcacucagcuucuggaauucuuuacucuguaauuguuugugguucugauguuuucugcaguauuaggcucuucucugcucucagauaccccacaauuugcuggggcaacuuuuccuuguacgugaggaagcgaauuuccauuuuuagucgauucuguuuuuggcuaugggacgauaagggggucacuggcauguggcguucuauaagcauagacucuccagcaaggucuguguguugccgccucaguuccucacucucuaggagaggugauugcagaaagagacgaccuuaucucuguaaaaacuaauuacuuaaaauggccuuaauuaaccagcagugugcuucacuucaguaucaauuaauuuggucgcaccaguuuccugaaucguauaacucuucagacauauacucacuaaucuuaaaauuuuaaucaucuucucaguccugguguucucccaauggcuuggacaauguuaauugcauuuuaaacuucccuguguucuguaaauucccuaauucagguggaaacuaggugaaauacaugaacguaguugagaagaauccaguuaaugaaauuuuguccucuuucauuuugaagucccuguaucauauuaggaaugaguuguauuucuggcgaccaguuaccacaguuaccuggaagaauguagaaugaucuugucccgucauucucccccauuccccucaucucauagauucucacauuugauuauucaucccuagacauggccuuuacaccuuuccuuucuuccugugcgugcugguaccacgcaagccugggugaccuguccagcccuuaccuaccuugccuaacuuugugcuuuuucucugcuggcgugucugacaugcgccgugagccuagagaguggaacugacuugaggccacggggcuguuaauggccagccaggacuugaggaauuccugccugcacggggcuccuuuugcugauagggaugcugauagauuguggguuugguuccauuuauucaggaccucccuucugaguauugaugacugauagcagagagauggcauugcuugguagauugaggaagguauuuguguauuuagcaaaagauacgcugucccauuagauggaaaauggaaauggugacuuuggugcccuugaacauggucuuagagagaggguggggugccagaugaagcccuuucauggcuccgugugaaggcccuccuucaggugcucgccccugccccacugcagcuccgcagcccaauacgugcagcuccaucucccugugguucuguuucugugccacugaccaugucaugugucugggugggaccagguggucuacuucagggacuuugcaugaaccgugacaggccagguccugccaccugggagccuguuggcagggaaauauucggcuguuagcagauggcaucaaguuuugaccuucgcaaagaaucuacauucugaaaaugaugggaaauggugcaaaaguaacaaagugguacagauccacauaguuaggaguugauuaaucccuugacauccagaccagcaugccuuuuggucagguugguuuuguuucccacuguuugcaugugacauuuucugguauaaaguaagugguggcuggcacagccaagcauggagaggauuuuacuccuuaaagggucucugaucucaugcugggcaugcugggcguccucucucccaaaggaaacggaugaggcucaugcugggcaugcuggacauccucucucccgaaggaggcgggcgaggcuguugcugcugcugugguuccacagcacuccuuugcgagcaggaguuugugguuugcuucuuuaaucuuggggcuauagcaguuugagaucuuccaugccaucccaaaagcccccuggguguugggaagaggcugcacaguccaggaggaaucugaaccaaacaccugacccagccuuuccucugauguccuugcugugugaucaccucacccauuuauuuuuauuuuucuuuaaauuacaguuucauugagauauaauucacauaccaaaaaauucauccuuuuacucugaaguuuuuagugucuucauggaguuguacaacuauuaccacugucuaauuucagaacacuuucaucaucccaaaagaaaccacauagcuauuaguagucacuuucuccucuuccuguaaccacuaaucugcuuccugucucgauggauuuaccuguucuggauauuuuauguaaauugaaucauacgcccuguggccuuuugugucuggcuucucucacuuagccuugugucuucaagguuuauucaugccguagugacuaucagugcuucacaccuuuuuuuguuuugagaugaaguugugcucuuguuggccaggcuggagugcaaaggcgcaaucucaggaucuuggcucaccacaaccuccaccucccagguucaacugauucuccugccucagccucccaaguagcugggauuacaagcgugugccaccaugcccggcuaguuuuguauuuuuaguagagauggggguuucuccauguuggucaggcuggucucgaacucccgaccucaggugauccggccuccucagccucccaaagugcugagauuacagaugugagccacugcaccuggccugcuuuuaugccuuuuuauggccgauaacauuccaucacauggauagaccgcagauugucuuuccauucauuaguugacacacauuuguauugauucugcuuuuuuggagaugaugaauaauauuuguguacaaguuauuuugugaacauauguuuccuuucuuuuggagagauggccaggaaugaaacuguugacucauaugguaaaucuguguuuaaguuuuugaggaauugucaaacaguuuuucauagcaauugcacaauuguacauuucuaccagcagugugcaaggucuccaauuucucugcguucuugcccacuucuuauuagucaucuuaaauuguagcccagauagugggugugaagugauagcucaugaugguuucccuuuguaugucccuaaugaguaaucaugauagaucaguacuucaucauguuuauggccaguauuucguuguguggcguucugccucuucuugaccuucucuucuaauacgaaucaucacuuccaacaccgugaucuucaguccgucuuacauuuccugcaggggaggauggggugggacuugaagcugacuuguagugugacaugccuuugaagucucuuccuaauuacauguaugaugcuuuguccuucuuugcaguaguauuuauuugguaaauuuuagucaacuguaacuguaauuucgacauuguuguugaauaaaguaagcaccuucuggucucaaaacugggauacugcuguguauuccaguuucagaaucacgauccucuuccaugccugggcacccugguugguagaagguccuuccuuccacucagcuggguccugucccuguguggcuucugcccauucacuagcugaaguccuguacccaguguguagaaugagugagaugcaucuucccagaguugccauucagcgcuuugucaccagccuuaugaaaaccggaaagaggguuggaaaggcccccugggggaagcaguaggcccucuccuugcuuugacccucuccauuuaacacugguggcauuucuuuguucugaauucgcucauccaaaauuuuugucuuguguaucuaguggcugaaaaggaucccgaauggcuuuauagguagugcugggggcaaaguggguauuuggaguacugcagagaugauaguuauuccagugugugggggaaguccgguggguucacauugucacccgaccuucugugucuaugcaguuucuucaggacacguuggaugcccucuucaacaucaugauggagaacucagagagugagacuuuugacacguuagucuuugaugcucugguaagagagcuuuccuucucauaugcuuggauaacacagcguucuuccaugcugcagcgucugaggcuggagucgggggcuucgucacagugaccuugaacgcauuuucaguuguaaauccaaucagagaugaauugggguggcagauuuuuuuucucuuuuuuuuaaauguaaaacuguaguuaggcaaaugucauuucuaggguaagaaaagguaaacuagccaccaacuucuaucugaaaauguuaugguucauauccuaacacaggggugcagaugguucugaugaagauuauaaaauggcuuacauuauguugcuaaugaaaauauuauugauuaauuugacagguauuuaucauuggacugauugcugauagaaaauuucagcauuuuaauccuguuuuggaaacuuacauuaagaaacacuuuagugcaacguuagccuacacguaaguuccuacuuuguuuuaaaaccaauacuucuuuuuuugguauuuguguuauuuagagucuuuuucauguacuuuugucuaugacuguguauuuacuccugcucaaaacucugaguuuacuggaauaauuuuuaguauuguuucccucuuaacauaccuaaaaaccuuguugaaagagauaugugauaaaucaucguaauauucuggaauaaauucuuguucucccucacaccuuccauuuaucuuugaaaucuucacuuuauguucgaugaaacugagcuuuggaugcggagugucugacaccgcggcuuccucgcgagccuuugaugaauggauaaaugcauguguucccguguuaaggagauugguuguuuagugugaauuagaugcaguuuuguacuuugcaauguaucuccuugcucuuuaaagagcaccuucccuuuucuuugacaagcuucagcugucacugucuuggauuccuucuauccaccccucugcccgucugugccccagaggucuaggaagacaccagaggcuaugcauggugccugggccagcuuagcagugugccugguauugaagagcagagcccuggagucuggagucaggcugccugggcuugaugugcagcucugucccucacaagcucugugaucuugggcaaguugcuuaaccucucuguaccucagccuucuugucuguaaucagagcaugauuguaggcuuguguggaaauuuuaauaaguuauuacguguagagugcuuggacuaaucccuggcacuuagaaagcacuaagcaauuauuggguuucauuaucauuagauuuauuaugaugacuuaccggcucuuucuugguggaauuuauuggcauuuauucagacuuuuuauugugugaguuacagcaaaacauaaagauuuacauaauuucuuuaagaacaucccgcuuagaaucaguagaaaggauucuuuuuagugugaguaaauuuaguuaaaacucccuucugugucuucaacauacuuugcaaaauaccuguuuuuccucccugugugcagucaugaacucaggucagaggacucuggccuccugaagccagcuguuaauauacccugguccugcaccuggauucuuucauaucugccucgugugcguguuuacuguaaggugguggguggagcuccaggaaggcuaagagcugugagguccucaagccugcggaacaagcugugacuaguucuuugcacuugcuugcuaauaaacguuuguuuaaaacauuuuguucgcugaguggagaugcccagugugugggcaugucgaguaguuccuuacagaccguggggagggugcauugcagggcacuuuuccuggcucuugugaccaaaacaggagcuugugggguuugcggaaguggccuguggacugcagcaaacguagcacggccuccacgugugcucauuuucaaaauucugccuuuugauugaaauguggccaaagaacucuucucagauuaggcuccgugcuugaauuucagaagaugagaggcaugaaucagcuuaccacacugcagccacaucucuucauuggcgccagccuuuccaugcugugcuguuggggaaggagugaugcagccauucucauagguggagaaagaaaaaugggagauuuugaugaguuuccuaaugagacaaacaaaaaguaccauuuuuucuuuaugcugugaugggacugagauaagaauaguauccucauggccggguggaguggcucacaccuguaaucccagcacuuuggaaggccgagguggguggaucccaugaggccaggaguuggagaccagucuggccaacauggagaaacccccaucucuacuaaaaaugcaaaaauuagcugcgcgugguggcacgugccuguagucccagcuacuugggaggcugaggcaggagaaucacuugaacccgggaggcggagguugcagugagccgagaucgugccauugcacuccagccugggcuacagaucaagacucugucucaauaaaaaaaaaaaaaaaaaaaaaaaaaggauccugucauucaaucuauggaaucugcugaaaaagaaauuuuuauuguggaaaauaaguauuguuagcauguuuugguaaacuggcaaccucacgugguuccucagcagccugaauuugcaugucugcaccuugaaauuccaaaggagucaguggcgacugagauagcucugaccacaucauggaaggucgccuccgcauuggugauaugcuuacaguauucucugggccaggcgaaauuccaguaauauuaucccagaguguccuuguccucuucuccucuagaaggcuuugguagguacaggcuuacuuuagacucuuguccauguagccucucuccuuugguaaauguugagaucuuuagcccuucuucccaacaacaccaagagaaggaaugaaagauuuuggcaaugggcaguccucuuccgcaccucgagcugugucugcggcuccccugcguggguaguucauggaugcuggagccccacuggacugaccagcacugguacaagugagaaugaagggaggcaucggcuuugggggcugcucuuccauaaaaccagcaugacugggcuccuuuuuguccacccuauggagcugcugcaggcuccucacuggcaacugaugcuccaucugcuccgcccccucuagccagugccaagggguugcuuuuugugcagguauaagauggccuggcagauuuauuuuuauuuauuuucuuuuugcugucuaauuccagguuaagauucauuugcugguucuagguccuucuuuuauuuauuuucuuucuuuuugcugucuaauuccagguuaagauacauuuguugguucuaaguccuucucuuugcaaaucauuauuauuuuucuuuuuuuaauugguuugaagaauucccaaaauguguucuauggaauguuuauucccugggauauuaauauauguaauaagaggugcgugguccaguaaguuugggaaaauaaguaaaacugagugaagcaggcuucaugccaggguguugcaugcucucuugugcagugagcaccacccgcagaggccuauauggcaagguguguuuuccagccaauggagauggacaccguagcaggaggaucugcagacuucgccucuucagaacagcgagcaggagugugacucugagagcaucagggcucccuacuagagcucuggugccugaucgguguuagaaauggcuucacauccacucagucucccaaaaagcuuuucaggccaugcaugguggcucacaccuguaauccuugcacuuugggaggcugaggugggcggaucauuugaggucaggaguucaauaccagccuggccaacauggugaaaccccaucccuacuaaaaaauaaaacccaaaaaguuagccuugugugguggcaggugccuguaaucccagcuaaucagaaggcugagguaggagaaucgcuugaaccugggaggcagagguugcagugagcagagaucacagcacugcacuccagccugggcagagcgacacuacgucucaaaaaaaaaaaaaaaaaaaaaaagauuuucauugugauguauugguaaaauagguacucuuagcucauccauaauugcagugaagguugcucuucugagugucuuauuccauaaccugagugagcagucuggccuuuacuggcucacaacugaaccagacaugcugucaguaccccagcagauugcuuuuaugaacauaaaaaucuuucauguggcuuuuaaaaagccucagugaauuuuguuggaugcguaagauguuggugacuggagaaguuuggguggcggauauucuuccuggugucuuacuggcugcacgcauggugcuaguuuuuggagaguugcagugcagcucaguacauuaaaaaaugaccguguguuguuguuaauucaguuguucuuuuauuauguguaagcuauugcuugagggucauccuuaugaacaagauuauuauuugaugagucaguaaugguugaaaguguagaaguguggauagaauuaaaaauggcagauccucacuacugccucuaucauuuaaaaauaacacaugcucaacggauaaaaaauaguaaagaaaucucacauuacucaaauguuauagugcagacgauaaaaguucccuuguauauaaugcuacauauuggagauaucuacugugccagcauuuauuuucuauguuuauauuaacauuguuauuaagauuaugacuaauaugucugcauauuuuacaaaacagcauuguuauuuuugcuugcuuaaaauuuaaaaacuuaaaaauuguuauaauuugcauacaacaaaaugcucauuuuaauuuuguuuggacgguuuuuguauacccuuggaacuacugcccaaaacaagacauaagacauugccauuccccacaaacaucccucuuggccuaucugagcccaucccacucccagacaagcagccacucugugguuucuguuaggaauguguuuugccuguucuuaaacuuuacaccaguggggucaugcacucuuuuuguaucuggcuucuucccuuccacauaauucucuugagauucaugcauguugcuuugugcaucauuaaauauuugauuuugcuccucucuauuucugagcaguauuuuauuguaugaauauuucaugauuuguuuagccauuuucuuguugauggauacaugaaguguuucuaguuuuuggcuauuccgaauaaggcugcgaugaauauucuuguccaagucuuuggugaaguuuguuuuuguuucccuuggauaagcaccuagcgguagaauugccgggcuaaaggauacguguauaguuuucuuuguaagauauugcgagacaguucuccaaaaggguuguaccauauugcauucccaccagcaaucugugaauguucuuuugcucuguauccucaucaacauuuaguagugucugacuuuguagcuauuguacugggggcaaaauuauaucucuuggugauuuuaauuugcaguuacuggauaacugaugauacugaguaccuguuuauuuuauuuugauuugccauuugugaaaugucuguucaaaucucuuuuucauuuuauauuuuguugucuguuucuuauugauguuuaugguauguguguguauguguuuguguguuuauacacauaaauauauguauuuuuuuuugucagacaugauuuuugaacauuuucuuccugccucuguuuaucccuuuucuuaauggugucuuucgaugagcagaaaucuuuuauuuuguugaagccuaaaucaucauuuaaaaaaacagauagggauuuucauuuuguggcuaaacaaucuuugccuagccaaaggucuuaacaaugccugcacugucuaaugucacagcacuagccucguguggcuauuuaaauaaaauuaaacuaaacaauuacuuccgcaguugugccagguguguuucaagugcugagccagguuggacagcucagaaacagguuuccaucacuguagaaaguucuguugggcaucacuguuucagaagcuuuaugcuuuaugcuuuugacagaauucagcaucuguuuaugauaaaaccucuuggcaaacuaggaauagaugggaaguuccuugaucugauaaagcucaucuacgaaaagucauagcuaaccuuauacauaaugcuggaacauggaaagcuuuuccuguaaguucaggaacaaacguggcugucucuucuuacuauaucuguuuauuauugcgcuggaaguaguaaagcaagaagaaauaaaugcggguauaacaauuggaaagaaaaacuguauuuucacguugauuuuguauauaaaaagcccuccugaaucuauuuuauaauuuauuuuaaaacaaacauaaaaggaaacuucaauuguauauauacacauaauugagagggaauuaaaaguacaguagaauuacaguaugguacaguacaguacacuuuagggucuuaucaaaaagucauaggccgggcaugguggcucaugccuauaaucccaacacuuugggagggaggccuagguggguggaucaguugaguucaggaguuugagaccagccugaccaacauggugaaaccccaucucuacugaaaauacaaaaauucgccaagugugguggugggcaccuguaaucccagcuacuugggaggcugaggcaguagaaucucgugaacuugggagggagagguugcagugagccacgaucacgcuacugcacgccagccugagugacagagugagacucugucucaaaaauaaauaaauaaaauaaugagggauaaauuuacugguagaugacugaaaauugcaaaauuugcuaagagaaauauaaaaaguaaauaauuugauaauauauaccauguucauguauugaaaaauaaaauauugcuugaauguuuauuucaaauuauaguuugaacacagucucaaugaaaauucuguaugcuuuugugaaaaaaaaauggacuaauuugaauauuuauacuuucaaaaagucuaaaauaccgaaauaauauuuuagaagaucaaaauuucaagauuuauuauuaaacaucaguaaccaagauagcaugguauuggcauaaggacagacaaaaaguucagaaggagagaauauaaaauacagaacagauucacaauagaccuucgauuuuguaacugcuguuuucuuuuaacagcauaaugacaaaacuggccucuuuuuuuuuuuuuuuuuuuuuuuacuauagugaugagggagugcccaccuaguguauugaacugcugugcaguauuucauuguagggauguauuaccauuuauugaaccggcucucagagguugggcauuugcauuguuuauguauuuuuacuagucagaucaugcggcaguaaacaucauuugauucauuuguaauuguuucuguaggacaguuacuagaguuggaauuccuggugucaaaggauuugaauauccuuaauuauaauagauauuuccaauauaauagauauuuccaauauccuuaauuauaauagauauuuccaaauauaacagauauuuccuuaauuauaauagauauuucuuaauuauaauagauuuuccaacuauuauauauaauagauauuuccaauagauauuauaauacauauugccacuuuacccucuaaaaaauuuuuaugcccugcugggugcaguggcucacaccgguaaucccagcacuuggggaggcugagguggguggaucacgaggucaggaguucgagaccagccuggccaauauggugaaacccugucucuacuaaaaauacaaaacuuagcugggcgugguggugugcaucuguagcugugugggaggcugaggcaggagaaucgcuggaaccugggagguggagguuucagugagcugagaucgugccacugcacucccgccugggcaacagagcaagacucugucugaaaaaaaaaaaaaaaaguuuuaugcccauuuauccaacagcaguguuaugauaccccaaaguuugucuguacuaggcagaaauuuuauuuaauuuucauguguuuauuaaugaaguugauuaauauauuucuagauuuuaaaaaauuaagcuucucacauucccuaaaacuuugaguagaucuauuaucauuugaacuuucuuguuauuugaauuacaguaaaguaaaaauaauuuaauacauuucccuucaucuuuagcaaggaauuaaaaaaaccuaucuaugaauuaaacacugaaaauauuuaugaagccaugaauuaauauuaagcuccuaauauauaguuuauuuauaccaacugucuauaauuacuucuguaguaggaugaaaaauuuacaaauaauuuuacucaauuuuuguguauuccaaaguguguaaacuuuuuuaucauggaaaagauuuuaaauguuuucauauuaggauguuacuugauuuuagaucccaauuuauaaauaaacagacuaagaguauaguagucauuguguuuuuaaaacuaaauguuuuuggggaaucuuauuaggaaaugucaauauuuuaaaaucuucauguguccacugauaguauucuuacuauucuuauauauuguuuauagucuucucuauaaggauuuuuacaauauuauuaaaaauuuaagacugcuuccuauuugaaagaccauuuguaaauuuuaauuuucgguguaagaacucuaguuuuagaaaaucaacuaaaaugaauaaaagugucugagaugcuuuccaauaacaaauacuguuucaugccuuuaaaaaaauuguuguaaaauacacauaacauaaaauucaccgaaucauuuuauuuuauuuuaugauuuuuugagacaagguuucacucuugucguccaugcuggagugcaguagcgcgaucuuggcucacugcaaccucugcuuccuggacucaagugauucucuugccucagccucuugaguagcuaggacuacagccauaugccauccuacccggcuaauuuuuguauuuuuucuggaggcaggguuucauuuuguuguccaggcuggucucaaacuccugaguugaagugauucaccugccuuggccucccaaagugcugggauuccaggugugagcaagagcaccuggccccuaccuaauaguuuuaaagugcaauguugagaaaaucgucaccacuauccaucagagaguauuuuuggugucaugccuuuaugaaaaaaauuuuugugucucuguuuggcuguaaugaaaaucucuucgauuuuauuguuuaaccuuggggaagcuaguguuuuaccuguggaaguccugguuuccucauccauuaaauaggauaauacugccucauaguguugcugugaaggcuaaguuagauaaugcauuucaccugcuuagaacaacgucuacacuuagaaagggcuuauuaaaugcucagccuuugcucucagagguauuuuaucaggcacauuuacugauuagaaaacguuuuacaggccgugcaguggcuuacgccuaugauccuaacacuuugggaggccaagggggguggauugccugagcucaggaguuugagaccagcccgggcaaauggugagcuccugucucuacuaaaauacaaaaaauuagcugggcgaggcggcgugugccuauaauuccaacuacuugggaggcggaggcaggagaaucacuugagcccggaaggcagagguugcagugagccgagauugcaccauugcacuccauccugggugacagggugaaacugucucaaacaaaaaaaaaaaaaaagagaaaacguuuuacagauauucauauacugauagauggaaaccaaauaaaaguaaccuacuuguauauuuccuuagcaguuaagauuugagauauuuuccuuuccugagcuuauuugugcguguuugcauugugaauaggaaguugacaaaaguguugaagaacuacguggacggugcugagaagccgggaguaaaugagcagcuguacaaagccaugaaagcgcuagaauccaucuucaaguucaucgugcgcuccaggauccuguucaaucagugcguaccuauccccuccaugcccgggcucucagaggacuggcaggagauccuucacuucuuuccuuccccuucucucguccccuuauucuuuccuuucuucuucccccuuuuucccccuugcuuucuaggcugagagagcacuguugauccuggggugagcugcccacucuuuccuuacccgccugggucccugccggugcugaggcgggagcccuguuccuggucugagaugugugccugugagucgagccuuggcuccugaaagcauuggcgaugacgcaggugcaauccugggcgucuacugagggcucagaagcccuuuucaggauaucuuuauauggcaaaaagucccaaaagaaaaacaacaacaaaaauaggccgggcgcaguggcucacgccuguaaucccagcuacuugggaggcugaggcaggagaagggcgugaacccgggaggcggagcuugcagcgagcggagaucgcgccacugcacuccagccugggcgacagagcgagacuccaucucaaaaacaaaauaaauaaauaaaacaacaaugaaaaggcaaaaccaagugaaauugccucacuugggcagacucugggauuuccuccuccucuuuuccucaguagagugauguuucauuucgggagaacucuuccuacauaggguauuuccgugaggaaggauacucaggugcuuuagccuagugacaguuuucacacgcuguguggaugaacuuaugaaugauuuuugagcuuuaaaguaaaucgaaggguuaaaggggaacaaaaaauguauuuauuaccauugaacuguauacuuaaaaugguaaagauggugaauuauauauauguauauuuugccucaauaaaauacauaaauugggauauuuauggcuuauuuuauagagagccuuaauauuguauagauacagaugcagguuaagagcugcgcuaaaaugaggacuuucuaaguuggcccacgccucuucacuguaugauucaaaagaugugaaaaguaaguguguugagggugggguguggaauuucacucccucugcuuguuuuuuugggggauggcuauuuugugggugaccugccaugagugaugucaauggauguuggugguucuacguuguuauuguucuuguugugaguuccacacacagaugggauucaugaaccugugucccucugaauuagcgaauacauuugccuuugaaaagcauggugcccuuguaaccuauuaacgagaauaaggaauugaaagugugggcccacaucagugccuucccguuuccuccucacuguguuuucguuugucugaagcagucguguccagaagaaggacucaggagaagggggaagaauucaaaaucuaaccaugugucuaccaugauaguaauaaggacaaagcaacaaguuauugacuguguguugaccuaucagagucauaaacagggugguaaccacuagugauguguuacuggucagggacuggagugugcuucuguucacucuggcguguccauggucaaaaccacaguccucgugcugccauuuuugcauacaaauauggcauguuugagggcaucaugguuuuguccuugacuuagauauuacacucuuuuauuuugcuuauuauggauaugcaugaccuuugguguggauugaagcuuucccucaaggaucuaaguugugauuuauuuucucuuuguuagggugaaacacagcaugguaagcuagguuauguuuucuuguauuuuaauucuauuucaguaaaguuaauucuaugaaaaugaacuuccuggcccccccugccuugcuguuauauuuuccucacugauuuuaaaucucugauuaugcuaaacccaagucaguacuagggugggaggaugaacuugaaagauguuacagauuuuugucauguuuuauuugaaaaauguuaauuuugugcaguuugugaucaauaugacauugacucaggcauuugaugaucugcauauucucacccgauaacacuggacuuucccuuucauucagagguuuguacuuaaaacgaucgugcauugauaaugguguuucugcuauaguaguaaaugcuauagucuuuuauacaauaaugcugcuuuagaaaagauugaguuacccagguugaccaguagcaaauuauuucucugccucguucuuuaaucucuuucaauuucaaaauacaaauggcacaaaaucuuagauucaugguccauaauuuuuuuuuucguuugaucagucuaauagugcuuaggaauaugauuggcugcauguaauagaaaaacaccauuuaugugacuuaaccauaugggguucacuuuuuuuuuuuagucacauaaugugcagcccggaggaagaguuccgaguucaugcaccugcgugaggacucagcguccugauguccuuggcuccuuugaucucucugccccaccauccuuaguggggucucuuuaucuccuaauccuaagauggcuucugccccucccagcaucagcucugcauuccagguggaggagaggggaaggcaaaggagaaacagcugugccagcuauucuucuuugaaagagcuuuccucaucccuagaaagugucaugugcuuucaucuuauuggccagaaccaugucacaugaccacccuaccugcaaggaagcuggaaaggauuuuuagaugggcugguugaugcuuucuacaauaccagagugauuuuaguaaaggaguuagggagaaauagauaauggaugggcaguuaacauucucuuccucauaccuucaacccagauggucuguucccugagagcuucccuaacucauucuggguuacuaaauccuacuuaacuagguuuugcagagccuuucuucuccauuaguuugggagucaaucucugagacuucugucaccaguaucucuuuggcuuuaaguaucucuuuaggcccuaagugauccacuggcaugguuuaguccuaccagguuacauagaaauggacugaaguacucagcugcuccucguguuugggacaggaaguguuuagugcuaaaguccucugaaugccugcauucuggugcucaacagcauggcacagaacaugaucgcucuaccugccuuuguccugguauggacccagcaggagccaggcaugguccacaaacugaguuucuuugcugguauaacuuguuuguuagaagaguugagacuguugaggacacaaaguggucacaagacaaguuguagcaauuguuacaacuuagugaggcucccuaagccucugaggccauugucugggcauuccugacuuuagcuaaccgaguacugcagugauucuggagauccugaugcugcugcugcugcuccugaucaugaugaugaugaugaugauuugagacaggaccucccucugucacucaggauggaguacugugaugcagucauaggucacugcagccucaaaccccugggcucaagccauccuccugccuuagucucccaaguaacuaggacuacaggcaggugccagcaugccuggcuaauuuuuuguaggacauggucucgcuauguugcccaggcuggucucaaacuccuggccugaagccauccuccugcuguggccucccaaagugccaggauuccaggcaugagccccuguaccccacugauucuggggauguugauacucauguuccuucucucccucccucuuuuccucccuucuucccuagcuucuuccuucucuccucgcuucguucuuuccucucuccuucccuccuuuuuucucucuuuugucccuuccuuccuuccuuccaugaauacuuaaugaguguaugagccccaaguguaucccagacuuucacaguuugacuuuauuauuuuuucucugaacguuuccugaauguggauccuggcugccuacccucauuccugaggggagagaaggacauaacguucuuugagauguggagcaccuagccgcauugugcagagacaacaaauacuucaauuuaaaucuguguucuaaaauggcugagaagauauuucauagauuuuaugagaggaaaaaacccaugcccuuagaauauuggacgguagggcagaagucuucuaguaaucccuccccuucuguccuccccaucccaccccugcuccccaucaucccaccacagcaugucaguuguuacuucaucugugcuaucacaggucugaaauguagcugaaaucguuuuccuagcuuguauaggcuacuuaaaggaaaaagagccccacgucccacacagauaucuaggauguuugauccgugacaagcuccaaaugagucuccuguguggugcugucagagguggggaagaaaacaaacuaggacucucaucuucuuaccugcagcauguuuauuaccuugagagaaaaacaauugugcucacagcuggaauucaugaguguguuuuccuuuuugcagcugggauaaacuuuugagaucuuauuuuucuuuggcuuucaaaauggucuauuguguuuuccuauagugcaauagcuuuguuaaauuccaguauaauugacaguaauuauucuuccaaagaacaaagaggugaaacuuugaagaugaagauauugaagcuuauguuguuaacuuacuaucuuucuugcuaugcagucucauauuuuuuguuuuguuuagaaagcucauuuuguuuugaaaugagaacaacaguuuaaaagcuauggcccaaagacauuugguuccuggggaacccacugaaagauuccugacagccgggggcacuucucuacugguuuuuguuugucuguguuuucuguguggguggaucacauuaacuagaaagccagaaaacagauauucugcaucagaaucaaauuacuaaaucuaguuauugccugccuucucuucuggguuucuugugcuuuguagaguuuuugccugucaucugguguuagcuuuguaaauaauuaguuauugaucaugaauaaguuguacagaccuuuuugcuaucauucccugggucacaaaauagaauguaguuaauagacaaagauccugucauuccuuguuaaugaacacuuauuuaaguagagcaaggaaugagcaggucuuauucaucuguuuauuuaucgauaaguuucugaguuguuuuuucucaguuuuuuauccacuucaggguggaucaaaaaagugguucucccugguuuaucugggaaaaugaaaagggaagauucuagagacuuuaacagugaucuuuuguuacagaaagaugcuucaaaaggaucacggcaaaaugcuauguucuaaacauguugguuggcacaagagaaacuguuuuacauuuuuacucaugagagguucugguagaauuuaaaaaauauuaaagauucauuaaucaugccuuauagauuuugaagcuguguuauugggggcauacagauuuauaaucaugauaucuuuccuguuggucuauuccuuaaucaauaugaaaaguuucucuuaaucuuuuggcuaguauuugcauggaauaccuauuuccauccuuuuauuuucaugcuuucugugucuuuauacuuaaggugugccucuuauaauacaacauauaguuguauuuuucuuucauccagucugacaagcuucuuaauugagcauuucauccauuuauauauaguguaauuaaguaauguuagauuuauauauuauuuuugcauuaauuuucccuuccccaucuguauuauuuuccccuuuuccuccuuuuuugccuucuuuuauaccaguuacacuuuuuuuaagcaucucauuuucugauuuuuaaacauauuauuugaauauucuuuuacuauuauuuuuaacaauuauucuagagaugguaacauccauguuggacuuauuuuagaguauuucaaaugauuacucuuaccaauccacugauaaugcuagauauggccagaaaaauagcacgcuggaauugccauuuucuucuccucuguuuuauauuauuauuguauuucaauucuauguuuuauauuccauaagacauuacuguuauuuuauacaguuaguauucauuugauguguuuuauguuuguaauuguuuuucauccuucaauuucacuuuuccuuugggaucauuuucuuucuguccaaagaacucacuuguauuauuucuuuuaguguuggccaguuaugggacucuguuuguaugaaaaugauuuauuucaucuuuguguuugaaagauauuuucacucacuauagcauucuagguuggaaguuauuuucuucuuccauguauucuauucuauuuugauuuccuucauuuauaguaagucauuagcuuucagacuuacuguuacaucuuugaauuuaaaugguauuauuuucuuucuugcugcuuuuaguuugucuccuuuucugugguuauugacaaucuuacuauggguugcauaggauuguuuuugcuuuuuauuuauccugcauugaauuucugaauuuuuugauugauaucuuugaucaguuuuggaagauuuguggccauugucuguucuaauguuacuuuugucucauuaucuuccuccuuuucuccuggcacuucaauuacauguauguuagaucuccucaauaugccugcacauuccuagcccucuucuguauucucuuccucaguacuucuguuuaguuauuuucuguggauugucuuccauuuuacuaauucugccucuugcugugucuacucucuauuuuguuaauccaucuaauaaauuuuuaauuuuagagaguauauuuuguaguuuuagaauuuccaguugauuuuuucauagauucauuucucuacugaaauuuuucucuuaccuucuauuugucauuuuuuuaucuuauuuucccuguucucaaauaugauuauaguuguuuugauguucuaggaaauuguaauaucuagauuaucuguggggcuguuucugcucucuuuuuccucuuucacuuggacuguggucugguuuucugcugaguuuaauaauuuuuguuugaagucaagacuguuuguauguaaaacuguagaagcuucagaugaugugaucuucuuccagagauaauucauccugccuucuucuagacaaaguggggcugaccaucuuauuuuaaucagagacugugcucaguuuugaggcuacacuggaccuuuaguaugccucagucuccauuuacugugccucuggcuuucuaggauuuucaucugagagucggcucuguuaccuggggacucucucccuggcguuuuccaaacucgagucauuuucucugaugauuggugcaaauuccacuuugcuuuauagagguuuucguuuugguuuuuagucuucuaucccauacaggucuaggaauuacagauguccugaggggaaaaaugauugcagcuugauggcucccgaaggguugcaccagucuaccagguguucuucaugccacuugcaagcagaaguucaugauuccaucauuuuaauuguuugguacaucauuuaagcaaaccccauuugaaaacccuuauuuacaaaacagauccacuagguugcaauuucccauuuuacacagaauuuguugcuuuacaguggaauucauuuaaauaucagacuaccucuaggguaauuaauuaucacuuaguuuacaaaauuuuccauuguacacaaguuuucagguaucguauauuuuuaauuaggcagcaaacuaguauuaguaaacacuguauuaauaaaacaucugagucacaauauuuuaaaaugcaaauguguugcuuuuuaguaacacagcaacuugaaguaacugcuaauaaauaauuuacaaacgagacuuauuuucaauuaguaacauauauuagcauacauguaaccaaugcacaacuuccuuauuaccuauuuauugaauaugucccaccucuugaauacuuuucaguuaccacugauguugaaaugaaugcguuuguaaagcaccauuacucuggaauaaaaaagcaacucuugugauaucauuuuaaaggauuagaagaucaugguaaauuuaggcaauggaguguguuguugauuuucaauuugugacauaauggguuuaaaaacauugguaguggccgccuggcggcucacgccuguaaucccagcacuuugggaggccgaggcaaguggaucaccuuaggucaggaguucaagaccagccuggccaacaugguguaacuucuucccuacuaaaauauaaaaauuagcugggcauggugguggccaccuguaaucccaccuacuugggagguugaggcaggauaauugcuugaacccaggaagcggugguugcagugagccgagaucaugccauugcacuccagccugggugacaagagcaagacuccauuacaaaaauaaauaaauaaaauaaaaauaaaaacacugguagaaaacacaacugcaucuuaauaguguaauuuuugugggguagaaauaaagcugaauuuccccauccucuuucccuccuucucuuccucggcccuuuccacccucccuuucuguauauuuucuguguuuuucagauuuauaagauguaguauguuacaaugaaaaaugcagugagugguagcauuaagggucagccucuguauguggaggcacgcugccuuggcugaguggucugcaugagucucacugccaaguuaccuuccuugcuucauagauguugaggauguggucucucauucuaacuugucacccaagugauucccuucauggcuauagacauggauucaaaaaauguugagguguuucugccaggcccccacaguuuguguguuucuuugcagacuguaugaaaacaagggagaggcugacuucguggaaucuuugcugcagcucuucagguccaucaaugacaugaugagcagcaugucagaccagaccguccgggugaaggugagugccggccacugccaaggcagacuucuccuucuuuuuuucuuucauuaucucuuuuggagguagguauuuugauuacaguuaauuaacuugccccaaauaccauaguuguuaaugucagagaucucaauuugauuucaagagcugugcuuuuuuuuuuuuuuuuuuuuuuuuugagacagaauccugcucuguugcccaugcuggagugcaguggugugaucucagcucacugcaaccucugccucccggcuugaagcaauucuccugucucagccucccgaauugcugggacuacaggcgcaugccaccaugccuggcaaauuuuuuuguauuuuuaguagagaugggguuucaccauauuggucaggcuggucuccaauuccugaccucaggugacccacccaccucagccucccaaagugcugggauuauaggcgugagccacugugcccggccuuuuuuuaauuuuaauuuuauuuuuagaugacacauaaaaacuguacauauuuaugggacauacgcugauauuucaguacagguauacgaugugaucaaaucaggguaauuagcauagcaucaccuugaacauuuuucauuucuuuuugcugugaacauucagaauccuuucuacuugcuuuuugaacauauacacuaaauuauuguugaccgucuucacucugcauugcuacagaacacuggacuuuauucuucuuaucuagcuguagcuuuguaucaaaguggacuuguagaugaagggcuuccuguggcugagcuaaggggcugugggcccugccaagccugaacucgagggaaaggccccggagccucuuuuguagugaacauaaucaugcuccauguguagugaaaucccuucuuccuccucccuaggugcucuuaaauauuuucauugcuucucucuuugcuguuuggcaagacagauucugaauucacuuuauuuaaauuugggggaauugaugagaaucauguuuuacaccuaauuucucaggguguccaugcccuggaaaggguggugaaccuucaugcuucaguggaucuuugccugugcagaagagcgagccuuccagugccccuguccuucuguccuucuucccucuuuugaugaccuggucucacccuguuguccuuuggaagaaagaucccuuccacucacaugaggccugaguguucuuuaggaugcucacugguguggaagugccugggaggcccauggagcagccgcaggacccccacaaucuugguuauccuaguuauggcgguuuucacugggcugacuuauugcagaaggagcuguacaacuugcaauuugcugccugcacuaauuccuucaaagaacaagaaucuuccaaaugauuagcuuacaucuuucacucgacugaucaugguagacgccucuguucuuccucuuuuaauguuuguuuaacguauaauuuuagaaggcauucuuauggcuagugucuuaaaaauauuuuggucaagucgcuucccagccuuaaagcuuugccauaugcccuggaacaaagauguaugugugcugagacguggcugaugguugcugugaccaaggaaaccagcauaaguagacaugaaucaagucggagccuaccuuucaucucagagguggugcagcuguuugguggagccauuuggacucuucacuacgauuucuugauuuuuuuuuuacaugauuuacuauaaaaauuggugauuuauacagaaagaaauguagguggugcauacauuaaaauuuuagguuauuugggcaacuugauauugcccaaagcugucuuauugucccaagguuaaaauuagcaauguguuugguacauuuacuacugaauucaguggcauuuuagaaaaacagacguguguaguguaagaauagauaaaaauuacaggaaguuuugagcccagcaguaauuuuagauugcuaaauauauccuuacauuauuaaauuugauugggcuugauuugugucugccucccucccuugaagucagauuacuuagugacuagggaccgggaagaccaugcuucaguggguguuuuauuauaagacacaagugaauugagugacgugugugcauugaugcaaaccuuacaucugcaagacagacgcacggcguuuuauuaggcaugucaccucccuucugguaauugguaucguauuauuucacaauaggugcuuucucgaugacguuggaaauuuaaagauucccaucgugggagccugacuuuuguguuguuuuaacucuuucaguuuugcugugucuaaauggaaggaaauaccuugugaaccaucuuccauagacaaaguauauuuucagacugugacauuuaaagguuaaacauuguuuccccaaguguggcccucguugguaccaaacgguugguaccuucccgguucaagugauucuccugccucauccucccaguaguugggauuacaggcacccgccagcaugccuggcuaauuuuuuugaauuuuuagcagagaaaggcuccauccccuucuugguaccaaaccugccacuggcaucaacuuugcggauuagagucagccacgggguuuuacgccucauugaagagggagggcaggaggaacuucagaaguaauuuauugcaggauaagcauggucuccagcuagaauuuucaacaggacuguuuucauugauuuagugacaaaauuuuuccaaggucauuuaagugagaaaacacaaauggaggacgcgugggccaguuuuuauguuaagucaaauguccaggaaacuccacugaguguguggaugcugccugccuucacuccccuucccagcggccgucucccgucacccccgcuccccaggcgcccgccgugcccagauguuucaguaccgccucaccgucccucagugaauggcccucagcccuggggcugcagccaaauacuuuuugaaaacauacugccguggccaaauaacaugaaauuccccauuucuaagugucccguucaguggcauuaaguacagucacacuguugugcaaccaucaucaccaucccucuuuagaacuuuuacgucuuuccaaacugaauggaacuccagccccaucaaacaccaacucccugcagccccuggcagccaccgguccacuuucugggucuaagaauuuaauggcucugggaaccucauggaaguggacucauaccacauuuguccuuuugugucuggcuuuuuuucuuuuuuuugagacggagacucgcucagucucccaugcuggagggcaguggcacagucucggcucacagcaaccucugccuucccgguucaagugauucuccugccucauccucccagcagcugggauuacaggcaccugccaccaugcccggcuaauuuuuuugaauuuuuaguagagacgggguuucaccauguuagccaggcuggucucgaacaccugaccucaaauaauucacccgccucggccucccaaagugcugggauuacaggcaugagccacugugcccggccguguuuggcuucuuuuauauggcauaaugucugcaagguucuaccaggugguggcaugugucagaaucuucuuccuuuuuaagguugucauguugcugugugucucgugcacauuuugccuccgcaccugucccuggauagaggcucggccuguucccaccucauggugguugugguucaugcugcugggaacugggguguacagaugccucuugaagacccugcugccagugcuccagaaguggaauugcuguuucucgugguaauuaugcuugaauuuuuugaagaaucauccuguuuuucccagcaccccaccaugcuaccgaaaccucacuugaaauuccauauugacuuucccucagcagcccuuuccgcagcuccuccagcuccaggcauauccucugccgcacaucaccuaccuugagugaaugaugcggcuccgacugcugcauugaaaaggccuggggucagaggcggagguugcagugagccgagaucgcgccauugcacuccagccugggcaacaagagcaaaacuccaucucgaaaaaaaaaugauaaaagaaaagaccuggggucucucgguaucaccucuuccugucuguuuuccucugaagaggagaagcccaccugcugugcagugcugaccgucccccucccugagacccgcuccaccccuagcuguuuccucaccaucucagaucuucugucuucaccuugagcugccccuucacccggcccagauguucuggaaauucaacccgugccuucuggauucuucuuugcccucggcguuucucucuccuaccugacaagaggguccuuggccccauugccucugcccucgagucguguucuguguucugccccaagagauuguggcugcuguuccucccaggugcccccgccgcccccagcugcggugucuccagucagccucggaauucccuucugcugucuucucuucucugugcuacugugacugugguuucaugaaccacugggcuugcuagguccccaguucuucgucuugaaauuagggcagaaaagucuuggaaccguuuccugcaugcugaugcuggaccugccccuuuuuuccuuggcaucucuuuugguguuuuccugaaacucccaucuggugaugacuugcuguuucucagaaaacugugcuguucuucagcugccaggagaaaugggucagauuccagugugugacauccagacagcuucauaggcagcccaccuggcucuccaagccuuuuucccucguggagacccaaguagaaccagugcguuccccaggaaacaccaaacaucugggugugaggagccuccugaggguuagcucccccaaucagugguugauagaaauagcaugagcgccuagugccagaguaacuggagcugauacuuauugaucgccugcuguucaacgugcuuuguauuucucaacugauuuagucuuuacaauagcccuauuaaguagauacuuugauugcuuucugaugaagacacugaggccuagagaccuuaauuaaccuacccaaggccacaagagcugggaugggguaacgcgcugguuuaaacccugguuggcuaguuccagaaccacucucuuucccauuuggcuccuagagacaguguugcuaaguccuggcuaucccgugguguuuggaaacagggcccaugccugccauccacaucaauggagaacaggcuggaugcuuugggcuggaaagaugccgacauuaucccugguggagcuuuccaucgaaguggacaugcauaaagcaacuuaaaaacucuggugaaaugccacaagaauugggugagugugaaggggagggaggagaguuagaaggggcuggucacgaaggcuugugggaggagaccuuggcgauggccccacuguguuggcagcagguggcuguaucuuggccacucguggauugcagugcuggauugaggcguuuggggcuuugcagucaguucuuacaggcauugacaucauuucaaguccacaaauauuacuaccuucccuuaggaugacccugggaaaagacuacugcaugcaggaccuuggcauagucuguuccaucuggggcugagaaugccagaauuuucuauagaaggaaacuuugaccaugauccacaguaggaaauugaugcuuacuugguauaugugugugagugugucugugugcauuguauguguguguguguaugugugcguguguguugugcauaugaagcuggaaaaugcucaugaagaaguucuacacugauucccugugaugcauucuggcauuuucuagucuagucuccuuuagucuauucuagacuaauguauuucaguuaaaaaaaaauugcugguugacaggcacuaaauuuauuucaugagcacuaauggaucucaaccugcacuggaaaaacacuccucuuuauucaucucaggacucugccccucugucuccugcuuaguuuauuaugaaaauauugucagcuuucugcauuucuuccauugucguguagagccccaggccccugacgcucaggcaacuuuccugaccagcaugcggauugaacuggggugaagauuaauugaauuugaggccccccaagcugagguuggcacacagaugcagaagguuugucuuccuucuggggcacuguccccagggagcaggcuuccccaucucuuuccauucuaaccaucacauggcgccauuuccaucuggcuuucuuagagaggagcuguguugaaauaagcuauucuguaaucucaguaaauacagcugaugggugaguucugcccuccaagaggcacauuuuuugauucccuuaaaaauaauuuccugauuugaaaugaacuguauuuucuugccuuaaaucuuacccagaauucuuccuuaugaggaguuuuugcugcuuuuuguguauuuauuuccgggcuagcaucugggauccacacggcuacucacagauuuguacacauagaacuuuacuguccucagaacaaaugaucugaauguguuagggaugaugauaauuuaagaucagauggaauaggauuugcuggcaggugaggaagucacguuucacugaguaacuuugggccugucuggcaccucuccuacagcagcuccugccuucgccccuucgucuuuauauguguuccagauuuucauaaagguaucaaguccugguuugcauuaaacaaagcagccauuuauuguguccuugcccucaguuuaaaaguaauaugugaucugguuagaaaaaugccaaaaaguuaauuaagaaaaauaagaaucauuuaucacccuaccuuccagagauuacacuguuagcauuuuuguuuuuacagugaugagcucuuuuugcuuauuuagcauuauccuauauauauacacacacauauguauacacccacaccuauauauacacacauauaaauguaacauauguauaguauaaauucucauguguauacacacacacacacacuuuuacaguguugcauuuuucuguauauaucuaccuguguccuucaguauuuuucaagcacacauuuugaaagguuacacauugccucauggcuguaugauaacuuacuuaaccaguuuuccauuugagggcacauagcugguuucuaguuuucaguuuucaugaacagugcuuggcugaccucucugucuauggcaaaggccuugcuccaucugguuugcucugaggcauccagauuuucaaaugcucuaaaguccgaugaaagucaugaucaaggcgauuagggcuugauuccugggugaugacucugugcuucuuucauuggcgccgugugucugcccugccuugguuuccacuagagcucccgucuguuucuuuuccacuuccuucuaugcuucuugucauugggcuaugcagcugccaugguggaugagucgggagccacuucccucucucagaagccaccugcuucugugaccuuuguguuucuugguacaggauuguuggccaaguuagguaaggagacgagaacuccggugcguuccacucccucugaccugacgaaucagggccuggagcaaaccaaccaaugagauguuggcaccgucauagaccagcaagcagcuuaaagaaauuugggaguauuuugagucagaaggguuucccaagagcaaguaauaaaauauuuucaccuucuugauuuugaguggaggagggggugcacugaugguguuaauugaucugaggaugucaugggcaugagucaggaaucuauuugagagucucucaucauucguggggacacagaugcggugguuugaaugaggaccgucuaggucacauugucuguauggagacagacuuguugaauuagaauauugggcagcugaggcuggcaacucaggugaagccaaccaugacaggaaggacuacacuuguugagaaucagcaacaggccaggccuucuggagaguucuccugcaacaaagagaagagagggaggucccagagucgaggaggugaguaggccaaguuuggaaguugcucuaacaaaauacuacaaacuugguagcuuaaaacagugguuuuuuucuucucucagagccuuggagauuagaaacuugaaaucaggguggcggcagggcagguuccuuuuggcugcuccaagagaugauguguucugugccuuucucuagguuucuggugauccuugguauuuccugacuugcagaugccuugcuccagucucugcccccgucuucacgcagcacucucccugugugucugucuuugugucucuucucuucuuaugagguuguuaaauucagggccaacucuacuguggcguggccucaggucaacuugauuauaucugaaaaaagacuguuuccaaaacauucacaggucccaaggguuggaacuugaauuuagcccuuuuuuuuuuuuuuuuuuuuugagauggagucucgcccugucacccaggcuggagagcaguggugugaucucggcucacugcaaccuccaccucccggguucaaacgauucuccugccucagccucccgaguagcugggauuauaggcacccacuaccacgccaagcuaauuuuuguauuuuuaguagagacaggguuucaccacauuugccaggccggucucgaacuccugaccuugugaucugcccgccucggccucccaaagugcugggauuauaggugugacccacugcaccuggccugaacguaaccuuuugaaggacacaguuucacccacgguagacgucaucguggacgucaguguagaguucacuggcaggucaguggugaacaaaggacuggagaggaaguggguccuuagccaggcacccacagucaguuugacaugggagcugcaggacuggaaacuucuuagaaucuagugugcacaugagucaccuggaggucuuguuaaaaugugauuccgacucuguagggagggggccucaagauguuucauuauaaucaacucccagcugaugcuaagguugugggucccuggccauauauugagucagaaguggccacgccucgccuugcacagacagcugcugugugagcaguaguguuuguggguagggcaccuggucucaguucuugcagccuucaaggcuggcuucauucaggcugccugcccucagcugucugacguucuggacuauuuugauuugauaaguuugcccuacacacagaugaugacacacuugcaagugugucauguuaagaaagacucagcagaagaaggaacgagggaagugaagaaaauauuuuauggcuugcucuuagaggaccuguggguccaaaugcuccccauuucacuauacugcuugcuggucuguggcccugcagaggguuggguagucuggcugagaucugaacucaccaggugcugcagcauuccagucuucuugguugcuuccuaggauucuuccugcccgcucuggagggaacaauaccacucacauaggcaagaauuaaucaggagaggucuggauaaauacacuuguuuccuugagcaccucuccacccacauuuauacugugcacaguacuuugcaacaguagcagaaaugcagcaguagcacuaccuugcagaaaugcaacaguagcugaaaugaaaaucaucucucuuccaccguuucuucagcaaaccaaguauuucuauugguuuucuuccaauucuagugcaugcccaucaaaauguuuaugcuugcaaccugcguaguuuuugguuuacugauuuuuuuaucauuuuaucacaacaccuuuccauuauuaauguguaguuguaauuguaauggcuguaugccaguucagaacaugugccugaauugaugugcaaucauuugcuuaaucaaaugauuuuuccucaaauuaauuuuucuauuguugaauacuaccguguugcuuuuagcauuuuaagccugcaacaaauuauuucauugauaaguaguguguguuuauguuuucuuuaauuuuaugauccauuuuuccauguugauuccuucacauugccacuuguuagaggacaaugcuuuaauuugagauugcagaauucuaggcacuugcuugccaucccuccugccuuguccccaguaaugaugcucacugguggaaaaucucuccuuuggccaugguggcuucagugcucaggaaccugaacuuauuuucuucucccaccccugaucuuguucagagaucucucuuguuaggugcuccucccacaucugugcccucggucuuggauucugccugcugccaacaugcaaggugccagugagccccuuucuccuuccuccaucauggucaggauuuauucagcauuucucugaaagugagcaggucucagaguuaugcuuaguaccucauuguugaguuauguauucaccuguuuaaaaaauuccuucaaucauauguucauucuccugugugccaggcacugugcuaggcacugaggaguuacagcaccaaucacacagauacgcucuguauucucauggugguuccauuggagugagcaaggcaggcgugaacucaguaaccauccccuauguguauaguugcauaguugcaauaugugauuuuaagcaaaucacagacauaaaauuaucauuguggauuguagucacucauuuuaagaaaaaguaaaggucagggugacaagguauaucggggcauuggaaguaguuuagggguucaaagaaggugcugauacaaagguagucaccaugaggugcuuggauauguaauacagcagaggaaaaugccaaacccagacucucguaugguuuggagagaacugugcugccacuuuuguccagagggguuguggagcaugaaguaauccuaaucccuucuguucgugcaguacucucaggcaccaaagacuuugaugcguguuaucucuuaggauccucccagcacugccauggugguuguuaaaaauaaugagaaagcuuucuaaagggacgggcagagaacaucaucaugcaaagucugugcgucuuaauagcugacucauugauggaaacauuuauaucccacauccacuggcucuugucuggcuucuucaaaugcaccugucccuaggaccccuuccuagagauaccagcauuuagaacagaccagucuaaacaaggucuucucaagugaacugaagauacuaggccugcaaacgcucaucugcacuucacuuacgauguggcauuuauaaaugcauucaccguagguguuuguagauucuuuuuauguuuuaaguuuuaaguuugcagcauugaggccuauuuugauugcaaauugcauaaaccucaaauaagaucuaaaucaaaggaaagguauugcaugcuuauaggugacucaacauuaagaauucaguucuucccaacuugaucuacagauucacugcagucccaaucaaaaucccagcaaguuuuuuuguggcuauugaccaacugauuccgaaguucauguggaaaggcaaaagacccagaauaaucaacacaauauuuauggagaacaaagucagaggacuggcacuacucgacuucaagucugcuggaaagcuccaguagucuaauuacagaaacccaacuccaauucacauuagaaagaaggaaauuaauugauucauguaguuugggaguccaaguguuaagcaugagugaguuuaggauuuagaagguauccuccucuuggcuuaguauuuauuucucuccauuugagggaaaaguggcugccaguagccagaggcuugcaauuuucuuuuuugucuaauagucuucgaggacacagagugaccgucucccucuuuaaggcaauguuaaucuucagacagaaccaucguuaaccuucuuuuaagcaggaggcuaucccugaaaggaaaagacugugaaguugaaacagaaguagagcuucauaaugcagaaaauggagaaagagggaugagaggacucacaggaaggcugaagggacauuuguaaaugcagcugaagccagugcaaauuggcgacuuugugaaauggguuuugcagcuauucuuuggagcugucugcugaggugauggaaaggguaguuaaaagcuucauuuaggauugguguucugccagcaugccaaguagcccaaaccaaggccugggaggagagcagacuuuaaauaugucccaggaaacguuuuauugagaaacaugucaacuaccacuauagcauuaucaagagggaaaaaggaauauuucauaugugagcuuaaaaaaucauuagcucuguuauauugaauacuugcaaaauuucauuaaaauuguuuuugcagaauuuuaugauagaauaaauuacuuuuguguauguauugaugaaaucauggaguuauaugaguuuggauuucucaagcacccaaauagucaacaucaagaaucagggaauuaggagguuagaaagucacaucuuuaguuuuuuucaggaacuugcccaggaacagagggguccuaggugggaugaccagaccccaguucucuguucuucagcccagugcuuuuuucaugacaucacucaagucagauuuuaaauuugugcauuacacuggcuuuauuuagaauccugugccaggcaauauaguuuugauuagaagcugaacaguauuauucuccaugaacugugaaugugacacuuuuauaauucaaguagaauuauuuuucccuugggaaauccuauacauucaauaugguacauugaauuagcaaagagguagaagaaaaaaggggcuauaaaaaguguaucuuauuaaaacaaaguagguuuucuucuugccugugucaccuuuagauaguaauucuuagcaucacuauuuuuuaaaucacaaauugucuucuaucuagugaaaugauuaagaaagaacaguaguccucauuugauuaggugaaacgugacacaagucucguugauuuuugaaaaggacauuuucauauaauuccaagaaauacacauucugacauuaaacauuuuauaugaucccuauugaagauuaaaaggagagguguuuggccgggugcgguggcucacaccuguagucccagcacucugggaugcugaggcagguggaucaccugagguugggaguucgagacuagccugaccaacugaccaacaugaagaaauccugucucuacuaaaaauacggaauuagcugggcuugguggugcaugccuguagucccagcuacuugggaggcugaggcaggagaaucgccugaacacaggagguggagguuguggugagcugagauugcaccauugcacuccagccugggcaacaagagcgaaacucugucucaaaaaaaaaaaaaaaaaaaaaaaaaaaaaaggagaguuguuaugucugggaaauuagguggccaucaaguuuuuucaugguuuuucuuucauugauugauugauugauuugauugacguacugagaccgagucucacugucacuuaggcuguagugcaguggugcaaucuuggcucacuguagccuugaccuccugggcucaagugacccuuccgccucagcuuccaaaguagcugggacuauaggccagcaccaccacagauggcuaauuuuuguaauuuuuguagagauaugguuucgucauauauuagucuauuuucacacugcuauaaagaacuaccugagacuggguaauuuauaaagaaaagagguuuacuugacucacaguuccacagguuuaacggaagcaugauuaggagaccucaggaaacuuacagucauggaggaagacgaaggggaagcaaggaccuucuucacauggcggcaggagagagagcggagggggaagugacacacacuuuaaaccaucagaucucaugagaacucacugucaugagaacggcaagggggaggucugcccccgugauuuagucacuucccaccaugccgcucacccgacacguggggauuacaauuugagaugagauuuggguggggacacagaaccaaaccauaucacuccauguugcccaggcugagugcuagauuccuguguguuauuuuagggcacuuuauacuuuuauuauuuaccaguguuugagaaguuuaugaugguucacaaaacuuucucuuccuacgugggucuuauguguguuuuugagugagcugaugauacacucguggccagcacuguucugugcuguguuucuccacccaguguguggacaucuugcuaugugcacagguaauauguccuucuuacacagaggggugcaaagguugagucaaaucagcauccaaggaguugcugauaaauugagaacuuccugacagcaagugacaccaaaaccucaacuaaaaugaucagcaaagauccauuaagaaaauaucggccaggcacgguggcucgugccuguaaucccggcacuuugggaggccgaggugggcggaucacaaggucaguagaucaagaccauccuggcuaacacggugaaaccccgucucuacuaaaaauacaaaaaauuagcuaggcgugguggcuggcgccuguagucccugcuaaucaggagacugaggcaggagaaucgcuugaacccgggagguagagguugcagugagccaagaucacgccacugcacuccagccuggaugacagagcaagauucugucucaaaaaagaaaagaaaauaccaagaaccagaaaacgggucguggcguaaaccuuggugaggaccuuggaauucaaggugaaaggcagagugugccccagggaguggugaggguuccugcagcauaugcagcugcaucccccaccccagcacccugauuucuccucacugcucagcuccucuggaauccuugccuucccaccucauugguggagcugcuccauugaaacccaagacuccauuccaggccuggccucagccccaucucugcccagggcugacaggggggcuccgucaucuaccccagggccugugccuuccuucuuccuccugguggcauuuccauguugggggccccugcuugucccuggggugcaggaauucuuaagcaccucuggcauuuugcuccugccuucuugccuggaguuucacugcugucugcaggccuuugagaacagaggcagggaggugccagaagcccuugagaguguggugauuagggguuggaugcccugugcgaauggcaaggaggaugauucuugaaagaaaaugucaggguaacuuaaauuucucugaggucagcuugcuuguuguuaauuaaguucuuacuacgagggccgagcgcgguggcuuaugccuguaaucgcagcacuuugggaggcugagguggguggaucacuugaggucaggaguuugagaccaaccuggccaacauggugaagcuccauaucuacuaaauauacaaaaauuagcugggcgugguggugggcuccuguaauccuggcuacucaggagaccgaggugggagaaucacuugaacccaggaggcagagguugcagucagccgagauugcaccacugcacuccagccuaggugacagagcgagacugugucucaaaauaaaaauaaaaaaaguucuuaccaagaaagcagugcuaaguacuucuccagcacugcuucaugucgguuggcuucuccagacaugggccucuuuguggauguuauuggaaaggguaguguuuuaauauacgugcgcuuuucacauggauucaaggauggcaugggugggugggauuacucgacuuuauagcauauuaagugcuuauuuggugccaguuauggacucguacugggcagaugccaugaggaauguacaguggaagauguuggauucugacugcaggagaggaaaccagguauucgaccccccaaauagaugacagauugugugguacaucacugcaucauuggguguccagacgagagauugcaggcaagacaaggaccuaaagaaaguggcaagugcacugaaaccaccaguuaaggccuccucagagcagguuggacugcccugagcuuugaggggugggugugaguugagaugggggagcauuccauggaggggcaggaggguauggaugggagggagaaggacaguggaaggaggugguggggauggguuguucucuugggagcccaggggcaggaguggaggcaggcagccucguuccaccccugguauucagagccgagaaaaggaauuuggacgaggaggugcugugcuaaugagaggcaguauuagagauccugagcugacacacuggaaauugacauaugggcuuauuuauuuauuuauuuuauuuauguuuuaaauaaagguuaagaucuuccagagaagacauaggaggagaaaugggcauuauuuuuccaggggucucuuaguauguaaauaaccugaguucuuaaaaguuuuaucuuauagaauuuuuuuauuaguucuuuuauuuuugucaugggaaaaauucagaagcuuuccuggaaacuugcaugucugcuuucagaguuuuguggcucuuacaaggagccccuuuggggguguggggcaaccuugcaucccaggaagccgccugggagauucuagggcugguaccuccuuuccacucagcugccugggagauucugggguugguaccuccucugcauucaggcugccuccaucagcugaagaggcgagagugucauaacaugacauucuguguaugcgcaauguauuuguagaagauacugaucuuuggauccggcaaucccauuccuggguaucuacccagaggaaaagaagucauuauaugaaaaagauacuuguacaugcauguuuacagcagcacaauucacaauuacaaaaauuguggaaccagcccaaaugcccaucagucaacaaguagauaaagaacaugauggaguacuacuuagccauaaaaaggaaugaauuaagggcauuuacagcaaccuggauggaguuggagaccauuauucuaagcgaaguaacucaggaauggaaaaccaaacauggaaucuccucuucauccuuuuucugucugccuuuccuuguucucauacuuaaagacagcguguugggagcgguauauugcuguuguuuuugucuucuccaaucugaccaccuaugucuuuuauuuggaguauuuaaucccuugcuuuuuguuuguuuaauaaucccuuuauaaaacagcugaauuauaaauugauggauaaauuuauagauguugaaaggcacaaaucugaaguaugcagcuuaaucagguuugacaaaugcugacacucauguaacccacacuggcauguuugcaccagauuaaagaacaucuccaucaccagucucugaacauuggaugcauuuaccggugguguuggguauauuucuuccauacucccgucuggaaucugaaccucuugaucccauuugccucagcaacucugacuccuucagacugaaacuuucuaucccacaguauuuucuuguuuccaucaagaaaggaagagauuuaaacucuguucugcaauucugucugcauuuccucucuggaauccuucucucucuccaaacaaagugguuaccucuuuaaaauaggcagugaacaucaaggaaaaccuugcauaggcugaaaagggcaaagugcucaccuuugcuugcauugggaaguaauuucuuuuaagugugcauagagacagacuaauaaaaaaaucuguugagugugucauguggcagucagucuuuagaaguguuguuccuuugucuuuuaaucauucucagaauuagcacaccaguugugugauauguaaaagucuauuccuggcagggugagguggcucaugcuuauaaucccagcacuuugggaggccgaggagggcggaucaccugaggucaggaguucgagaucagccugaccaauguggugaaacccuuucucuucuaaaaauacaaaaauuagcugggcguguaggugcaugccuguaaucccagcuacucgggaggcugaggcaggagaauugcuugaagcugggaagcggagguugcagugagccaacauugcgccacugcacuccagccugggcgacaagaaugaaacucugucccaauaaaaaauaaauaaauaaaucuuuucccuagcucauuuuuuuuugacuguguuaaauucaguggagcaaggucucauuuauauccuccuuauucauaauuugggguaauuagcauagugguugggcugccauucaccucuuacagcuaggaaaaugaggcuuugcgagaggaaugcaaaaauauaaacaggauuaagucauugauggcaugcucauacuuccuaggagaauuaagucuuuucagguaccacaguauguaugaguccuucuuaacucucauuuccaccagaucuccaccaaggaguuuagaacugauggacuccaagucucccucuggaugagacauucugaguucuugccaauaucaugcuaagcuggguugauaauuuccuuugaaaaauuuccuuugaaaaugaguagcauuucaucuuuuggaaauuuaucauucuucagacuuuucacugaccuguccccucccauagccgacccccuccuguaccccaggguuugauugauauuugcuuuuguauuguaauuacuauuuaauauccagcccuccugagguuugcuucacugcagucacauuguauugcaagcagaaaaugucacgucgccuggagcuguugggguagugugguugugguccuuuggguauuuccuggcacaccuggcucaugacaucgugcagagcugaacaggcucuaggaggaggaaggaaaccuugccuggguacuuaaaauuaucuaucacaguggauccugagucugccucucagccugucuugaaugccaggcuauuauaaaucagcuuuauuuauuuuguguuugaauuuugacuuuccuguucaauaauuuaauauuuuaaaaugacaccuuuggucuuuuauuugucauaagcgagggccgaguuagccacccugcaauuugccucuguacucuccgccccccaguguguagucguuagcucauaauuguuuucuuaaccuccucagagccuggugugaucuugcucucaaccuucuugaccuuccaagguaguuaaaugagguuuugcuuucucuaugaauuaauuaugucaucucuauuugaaauguuccugaacccauggugcuguauuuuggcaaaauaaauacuauuuucagagacuguaagacccauccauuuuauuuccuuuuauuagaagauagaacgauuuucuuagaugagcaguuaucagcugauguucaccuucuuggaggaagggacugcuggcgguuuuacuucaaaugcagccauuugaaguaucugauuuggaacauuccauaccuggugcagaggccacuuguuucuacagguuuguccugguggucuguccucugugccauugaacucccagaguccucugcagaggacauguaauaauucuugccuauuaauuuguggacccuguauguggggcuuuuuuuuuuuuugccuguuugagacuuccugccuuuaggaguagacaaugaccuuucauacguuuaaugcuucuguuguucucaaguuugagaaugugguguguccccuggguccccuccuuacaugaaauccaacccaaagggucaguguguuucuuguguguuucugucuucacuccucuguccgcuuucaucucuuuccuggugagucucugcccugucauaagcaaauaaccuuaguuguuuccuccccaguaaugguggcuucaauugcuguggauuuccuggccugauuucaaggcuaggggaaaaugccuguguccugguucagaacaggcagucucuuuauuucuucugucuugccguggacaaauagaaucguggcccuuacgaguucuuucuaaaaaaaucaccuuuauugagguaaaauuuauaugaacaaaaaaauagaaccauuugaaguaucugauuuuggaucauuuugaaaaugucccaaauguccucucgucaccaccguaaucaagagcuggaacauuucgccaccccagugaucucccuuugcuggccccuggcgaugcucauacauguggugguucuucacgcgaaagcagcugaccucaaagagggugaacaugagcccugcuuuccuuuccucuuugacuuccucucugauccaucccuaaacuacaggauuuugucauguuaguuccuauuuucuauuaccaugaaugacuguuggcgccucaggcuggggaagguuaauuguaguaacaaagaagagguuuuccuggcaggaaccauuuccuuacucaggaaacaaacgcuuuccuuucucacagucaucuucuccuucuuauguaaguagaaauauuaagccauacucagucuguccagguccugagaauuggugucugcccgggucuggguuuguauuagucuauucucacgcugccaauaaagacacaccuuagacugggucauguauaaagaaaaagaggcuuaauuuaagggacucacaguuccacauggcuggggaggccucacaaucauggcggaaggugaaggaguagccaaggcaugucuuacauggcggcaggcaagagagcgugugcaggagaacugcccuuuauaaaaccgucagaucacaugagacuuauucacuaucauacugucaugagaacagcaugggaaaaacccauccccaugauucaguuaccucccaccgagucccucccacaauacauggggaugaugggagcuacaauuaaagaugcaauuuggguggggagacagcccaaaccauaucaggguugcagaggcuuaugugggaggaucaagagugacagcaacugucuggcuggaggggaaggagacagaaccugucccugggccuucgucuccuuuccccgugccccacaccuagcccuggggagcccgauucccuccucacacucccuuggcucccuucuugucucuguacacagccccaagcacaaaacgacugcucauuuuccuggccaugcugugcuuugcugucuccaugucuuugugagcagggaucuuucuccuuggaaggccuguucucuuccugucuuccaggacaucugccugucagcagucagccuucuauauccacugcagaggccauuuguuucugcagauuuguccugguggccuguccucugugccauuggacucccagaguccucugcaaaggacaccauguuuucauuaaacacauagaggaggcauguuggcaaaugucauuugcagaucugucuucucuagcagggcaaugcucuuggccauugaacauuuugccuggcaugccacagguuccaacacuuucuggacaaaugaauaagugaacuggagaucaguaaguuauuuugaaaaugcaccugcuguggcauuugaggagauguaaaauaccuggugcccucccuucccaggaccccuccaagcuggacgagcaguccuggcuccuugguggggcauugucuggugagccuugagggcgugcuugggugccagcgaucuccccacccuuugcuuuguuaguuuuugcuccugaccuacugcuuugauuugagaaacccuucggcuauuaaaauaugaguuaaucaucuaagaaacucacuaacugaacuucauagugaggaaguaugcuuccuguugauagauaauaaaacagaguggaauaauuugaauucuuuauaauggaugugauuauaaaugauuuccccauuuacucauauaaaaggcuaaauggaagaugauuagugaguucuguuuucuguuuuuccuaaggugauuuuuuaaucuucccaacaaauuccugcgauacagggaagaaaaagaaaaacccauuaaaauuugcuuaaaaucuuuaagaagccauuuaaagcuucagaacugaguaaucuuucugcccccuuaguauauuauggcacaggagagaaaacaaauuacaggcaaccacucuaccuugcuuuaacguaggguuaggauugcuugacaucuucugaucacauuauugugcugcugauacuugucauaaauguagugaugagauucuggauguaaaaauauuuauaauuucccaucucuuguuaucccuaaaaaauuaauauuuguaaugggucuaaauccuucuaaaucccauuauuuaauauuguucugcaauuugaugauuaaagaauuguuauuuuuuuaccuccuuuauccuuaaauccuucacccauaaucuccuguuuauaauugcaggugucuaaugauucauaauuaguuaauucuugguuggugagugauuguuucauauugcaauuaggaagaucaugcauaaagccauuucuaguuaaauguguguauguucuuuaccaggcuuguguucaagaguucuguaguuaccacguuauaguaaucucugaccuuauuuuuguuaagcaaagacaucugguucaaagacccucucucaccagcaagcgguucucauucaaucuaagcauguugaaaaaggcccuuucccuaaaugggcuugggagcaauacuggggucguggcuguccucagggugucugagcgcuucuuugguagucugcaggggaaaauaccaacacugguaaugccccauucagaugcaguauucuguccaacaaggcacaauugccugccugggaauaggaggcugagauaccauugauuguuuccuaugucacuugucaaguggaacacaacacaagugaaugucugcacaaaauguacuuugcuauaccuuucuaacggguuuacaugagggaauggagcucaaacuucacaggauauucuaugcagaguaggucuuacccuagggaugcuccugcugcucucacuccaccuguccuccacccaccaaggcacagagacuccagcaaaugugaggaagaggguggggauugguugaugggcagagcuggcucugugaaaggggguuaaucugaggcaucuuaccuccugaagacuugggugaugggagggagauguuucuggagcccagggcagcuacuguggcauugagaccaccuuagccuggguuggcauggaagacuggaaaucuugccuuuauuccugucuuguucguuguccucugauugaaucucugcguuuuagcccauugucuucccaaagcuugauucucaccucuuccucucaacuccuggccucuguaauaauggagaagccuugggccuggaauuuggaggggaagaaagggagguuaagaauccuuaucuuuuugcuuucuucauuauguggcuuccucgaucuuuuuguacaacaguaagcaggcuuuuaugaacuaguagauauuaaaaaccacaucagugccaacuaaacaaauuauauccaccagauacuuuugagcccucugguaugugccaggcaauauucuaggcauggagcucuaucagugggcaggggguacagguggcaguaauauacagcugaccuuauguucucaucauggcaaagagacaguagagaauugcauuauccaucaguuagggauaaaacaacaaauacccacugcuguuuauuaucucuguccucuuauuuaagaaaggaacucuuggccgggcgcgguggcucaugccuguaaucccagcacuuugggaggccgaggcaggcggaucacgaggucaggagauugagaccauccuggcuaacauagugaaaccccaucucugcugaaaauacagaaauuaccagggcaugguggugggugccuguagucucagcuacuggggcggcugaggcaggagaauugcuugaacccaggaggcggagguugcagugagccgagauugcgccacugcacuccagccuggcaacagagugagaccccaucuaaaaaaaaagaaaaagaaaggaacucuuugccuucuuagagcaggagggaacugaguucuucauagagaacagaucuaaauuauagaagccauuauuauuauuuuucaccauuuuucuuauuguaucacaguccaguugugggacauuguggaucacugcaggcugcacacaggcauuugggaggcaugacuucuuucuggguacugugccuuuuuaaagccuuuggugauuuuauucauacuugcuuucauucaacaaauguuuuccagcaccaacugaaggccagaugcuaugggaggugcuggaaagguauuagagccucaucucuucaggaguucgugacucggugcggggaugcaagagggauucagugagggagacacaccccccgccccuuacaguccuguucugugcugcuguuggaugaaacugcucugcaggucuuaggaaccagcccuggaaaccccaccucccauccccccacccccggugcaggaagggaacuuagucuucauuaugugaccacccacuuauguagacuucccacauuuccccccaaauuaguccccaggagcugaguaaccuucucuuugaguccuuauaacauuuuuaucugaaaugcaaaaacacauuugcuugaaaccuccaugcuaguuuggcaugauuuuagaaguuaccuggcagaaugaauacaaaagaagcaaagaaauuuaacaugaacuuggcauuuucuugcuggcaugaacauaauuauuggaugucauuauaaauaaaccuuuuaaaagucacuuuaaaaauagaauaauuggcuacauugcagagaucaugaaagaucaugaauauguauauaacaguuaauuaaaaaaaacugcuaauauuauuuaaaugggugauuguggcuugggaaaaauuuuucugugguucuuaaaaagucccgugucuuaagcacuucagauugacguaaaaugaugacgaaaaugggucuuggugaugauggagacacucacgucaaagggacauguaaaaaguuaguguaaaauaguuuuaugaaauggagaguggacgaaacuacuuuaauauuccuauacaugaauauuagauaggcaugcauaauuaaauuaauaacguguuuuaguaggcacuuggcuuuuaucuguaucuauaaaaguguaaauacuugagguggccaaaacuugacauuuucucauuguaaugcaauucuuauuuaauccagagucaccucacucauagggacagaaagcauuucuauagagcgggauugguagaagagggguucauggacuacauaagccuccagaaggccaggggauguggucaggcugguggaaggaaaagcacucugcagcuuguucuuagagcaccagguuuauuaaauaucuaagugggcauuuuucuaaacgagugacuuucuucaugauaugugugugcugaauucaaacuauacuuggcaaaguaaugugaguuuucaggagaugggcuuauaauuuuucaugcagcagagggagcaucagcuucucaaguggaugcugagaaguucugugauguuuagagaauccaguuagauggcucacuguuuuaugacauugaaccuaguuuugacugagucacagaaauucaugccgggcucagacgcugaugcuaacaggggcaggggaguggaguagaggggugcugcuuuguggaccuaucuuggggagaauauuggguagaguguugguccccggagccuuuaggguagauugugguccugcgggcacuuccagaaaacagucagcggcuaaccuggggugggcgagggagacuccuuaaaguuagaccacaguccccauucucaagaaacaucccccacucuugcugaagugucccugugcaguuuaggguaguagccaagccuugaugagguuacucugaugaaauguaaguagcauuguagaacuaggaauuggcaucauuuaggaccauuuacccgaaguagaaccaaaauaauuugguauuaauuggucauuaaauagauaaggaaacuuuggcuacaaauacacaucuuggaauuacauggggacucucacccuggacuuccuuugucauagcuuuauuuuuauacacaauuguauugaucaaauucuagaccuuacaagcuccacagcugaauuauuuaauucucucugaugaucgucucaauucauuuuccaauaaauguaauuauuuucuugccagcguucguauuuaauugcuaaguuuucucugauuugcucuaaaucaucuuuuacaaaugcguagugaaaggcagcagguuuucucuucugaugguggcaauuauaaauguaauuuuauuuaacuugauaaccaguucgcugccaccaagggccucauauuuuucuuuaucauauguuugggcacacugugaaaucaucaaacaccaaaccuuuuauaaauuggaugugcaugcuuuuguccuuuucgcuuauuauuguacuguuuaccgucgucuucugugacauuuucucuugccuucagucaauuuuggaagcaggcacauucuucugcaacaaaacaccauuuuuuucuugauuguaagcagagaugucauucccgugcuuguguuagauauacccuuagaaauuauuaaaagcuguccagcugccuagugguuaugugcaugguagauaccucaacuguguuuguuucguuuguccuggauauaugucucugaacucuugcuuuuauugaaauuaaucucuuguuucuguuacugucucugaaaauaacaaugauuauggugcuuuuuaaguaacucacaauguguuuaaacuaugugggaaagagaaugugaaagguauguuauauuuauuuuaauguugccccucaaaaugaacuggaagccggguuuugggaggauuccauuuaaaugcauuuaugcugaccuuuucaugauucucauguuuaauuguauugcacuucagagucacccagccugaaagggacuuagaaucccaugguugccaguugguguaugacugcgccucccucaguggucaaaacugagauuaaaaagaaagggaaagcccuguauuuggaagguuauauccagaggaguucagcaccccucagagucuaaggggcuuccuggugauacggccccaccgcugcagagaaaugcccccagccucccuacuuagugcaccaggggucuggaacccucucucccuaacacccaagaccauccauagcucggucacuccccacagacuucacccgcagccaugccgcagccaccagcaccuaaccuccagacuccugaggaagcuaggcggcuccccugugucaccucggcucugccauccuuuucccugcccauacacauggagcccuggacacgguggcccgcacugcccuugauggagugccuugucccuggaccccucccgugacucagcucugcuccuguuggccuucuugucuucugucucuggucagccucuuuuggucucuccuguggacuuugcuucuugccccuguucucuguguguuucuugaugcucuuucccauggccacucccuggaggcccccacaucuggauucagacccccuaccccucgggccucuugcgccuccuccaccuagccccuuccuucuuuuuuuccuuggcuucuccugugcacccacuuuguuuccuuccauucugcuguucacuccagccucaaucuccacucucagugacuuacugcuuccuucuccuggggaccucaggaaaacggaggauucugacccccacaccuaagauaauaggaaagagccucccucccccaggagagggggcugccccugcccacugccccuggccaaguccaggcuucaggcuggcucugccuuuccaggccauggaugauguuugaaugaggcccugggcagggcguggagauggagugagcccucgaguccugggugguggaugcucuugucuccaggagagaugcugcccagugcuggcguguggacaccgugccauuuagucuuccccaacuagcuuuuccuuuggaggagaaaagauugucugacuuguggcaauacuuuuaguuccauaacuguaaacuuuucuuucucuuuuuugguggcauuuauaaaaauucccuguccuacauaucugaccacauuuuuaaaacauuuauuaguuuggauguucauguuuaaaucacaugauguaaaauguuuguugagacacagcugaaggauuguugaaaagcaacuguagagaagcagcaggagcuuguuuaaggggugggaggugugggcggcaguucuggacagugauugcuguucgggacacugggaugcuucuccuuucuggcuuccugggauuuuuuuuccugggcagguucuauuaaaccuugcuuaaugaaggcacuggcacugauaguggcuugcauuuggcaagacauggcuguuccuggguaccaggcaguggcaccggaacucauuaagaaggugacuaauuucagggccguguuaacauagacugaggcuccaucaugguucccagguguuugucggucgccgcuggagaccauuguguggaucagucacauggucugcugcagugugagugacagacggugacuugcuaucaguaugcaaaggucacccggugacuauuccaagaagugucauuuuccaguggagaaugggacuuuuuuuuuuuccuguuaauaauuuauuucuuaauugcgguaaaauacauauaacauaaaguuaauccuuuuaaccaucuuaacacgaacaauucaguggcaugggguacauuuacaguacaucaccacuagguaguucuagaucauuuccgucaccccagaaggaaaccccacagccguuacagucacucuguuucccccuucacacugccuggcaaccacgaauuuguuuucugucucuacgauuagcuucuucugcguauuucauauaaauggcacuauagaauauguggcuuuuuuugguauauggcuucuuuuacuuaguauauucucaggguucauccauguguuggcaccccauuacuguucauggcucgguaguauuccauuguauggacagaccacagguguuuauccauuuaucucuggaugcacaccuggcuuacuucaccuuuuggcuguagcguauagagcugcuaugagcauuccuguacaggcuucuguuugaacgucuauuugguuuuuuuuuuuuuuuugagacggagucucauucuguugcccaggcuggagugcaguagugugaucucggcucacugcaagcucugccuccuggguucacaccauucuccugccucagccucccgaguagcugggacuacaggugcccgccaccgcaccuggcuaauuuuuuuugcauuuuuaguagagacgggguuucaccauguuagccaggauggucucgaucuccugaccucgcgauccgcccgacuuggccucccaaagugcugggauuacaggcgugagccacugcgcccagccugaacgucuauuuuuaauucuuuuggguauacaucgaggagugaaacugcugggucuguuucuguugaguugacugaagaaaggauauucguuuuauugcucuaucuacauggaccucuccugcauuacuucagugaguugugaagguuggucuggaucgcuuucccucuuuccuuuuugaauugugccuuuagcuguagguugaacacaggugcuaucuuucacguuuucagaucucugagaucuucacuggggaucaagguccaaggaaucaaagcucaugcuguguuugcuccugagcaggagagagcguuguuuagagggagggagaaggggaaugcuugaggucagaaucacaggacagcaaauccgucuugagauuucagaaaucaccauaaaucugugucccuucccagagaagagcgugucaaaaugcagcauucguaauugaagaaagcaaaaucagcugacuaagucguaagaccuaggauggugaagagucucagagugaccaaaaacacacagacccuguucucagggaagcuccugugcaccgacugcaugcucuauagaccccugcccugugggggcccauucaugcuuacaggguacauccucugggagaaagcaugacaaguugguaccggggaaccugagggccgggaugaauuucaggauaaaaagagcagacuuagggaugcugccauaguauaucgucuagauuuguacugcccuauugaaauucaaauaaaauacagcuaaauguuccauuucucagucacccuaccuguauuucaagugccugauggacaccugugcccaguggugacuguacuggccagagcugcuguagaauagucccaucacugcggaaaguucugcuggucaggucuggcuggaccguagacacaggaguggccauagcaguagugcugggagcugagaaggugcccagugcacagaggaggaugagcuggaucggggaggagaggucaggauuugauccuggaaaggugucauuguaguccuggcucugucaucgcucagcaaggcaucgcucccgccacagggccccagccucccugugugcccaccacgggccuggcacuggccgcccucugugccacucagggcaggagagugaggguugugccacacauggguccgauugcuucuccauggcgagaagaggacagacacugggaggaaaaguugaggaaccuugacaucccaugcugcucugucauccaaguggcuuuuugguuuucuaggcauucuuuuuuuuuugagacugaggaucgagcaguucuccuaccucagccucccaaguagcugggacuugguacccaccaccacgccuggauaauuuuuuuguauuuuuaauagagacaggguuucaccauguugccaggcuagucuugaacuccugacuucaagugauccgccugccucagucucccaaggugcugggauuacaggcgugagccaccgcgcccggcagacauucauuuuuauuacaauuuacaaagguauuggucagaaacagaaugaaaauggaaggaaauccuagucuuuccccaggucaugggagaauccuugcuuuaagugucucaugggguggggugauguauucgucccucagggcugcugucacaauacaaacgaggggcuucaaacaacaucaguguguucucucauuguucuggaggccagaaguccaagagcaaggcaucaccagggccgugcccucucugaaggcucuagaaggcuguagggcagaauccuuccuggucucuuccagcguccagggcugcuggcaguccucgaugugcugugguuuguggcuacaucaugcucgugucugccucugccuuccuguggugugugcagcuuugcaucugaaucucccucuccuuuuucuuucuuucuuucuuucuuuucuuucuuucuuucuuucuucuuuuuuuuuuuuuuuuuuuuggagacagggucucgcucugucaucccggcuaaagugcaguggcgugaucucggcucacugcaacuuccaccuuccaggcucaaguaauccuccuaccucagccucccgaguagcugggaccacaggcauccaggcuggagugcaguggcaugaucucagcuuacugcaaaccuccaccuuccagggucaaguaaucguccuaccucagccucccaaguagcugggaucacagacgcgugccauugcgcccaccuaauauuuuguauuuuugguagagacuggguuucgcuauguugccuuggcuggucuugaacuccugagcucaagcgauccuccugccucagccuuccaaagugcugggauuacaggugugagccaucgcacccauggccuuuuuuuuuuucuuauaaagauagucaucauuggauuuagggcccacuguaauucuaauuggaguuuaucugcaaagauucuguuucuaaguucauuuguauucacaggcaccagaauguccuaguccauuuugugcugcuauaacaaaauaccugagacucgguaaaauaccugaguaauuuauaaugaacagcaguuuacuggcuugcaguucuggaggcuggcaaguccaaggucaaggugcuagcauuaagggccuucuugccuggucaucccauggcagaaggugagagugugagagaggaugagagggugccaaacucucccuuuuacaaugacccaguccucccuauguggcugaguccucauggccuaaucacauuauuccuaaaguuccuaccucuuugccugccuguagucccagcuacaugggaggcugaggugggaguaucacuuguccccaggagguagaggcugcagugaguugugaucauuccgcagcacuccagccugggcgacggagugagaaccugucucaaaaacagaaaaacaaacaaaaaaucccacaucuuaauaacuguuacaaugucaaugucgauuaaauuucaacuugaauuuuggaggggacagauauuuaaaugauauuacacagguuaggucuugaaauuuuuuuggcagggucacaauuccaugcacugcauaugggaguggaagggguaugccugcggguggggagccaggggcuugagcuccacucugcauucacuuuuugcucuaccccaaagccuucccuuccccuguccugcucccucuaccugugagugucuguguacccuggccauccucgauggcagugagucugaguauugguagggugggcuagagccugggacagcgaggcagcuggagggugguugaggguggacgggugcacgcuggacaggcagaauauucugcgccauuuugccucguuccugcaucuuucuuccucugcuguccugcacacacuuaucuucuacccacuucuguucccgaagggcuccauuuugucagauuauucagaccaugaauaaaacacaagugugaugugcuucauuccccacucacuguuugcaaaacuauuuuccugcaguucagacccuuaagauacuguggaacuggaccguuuuccugucugucgacuucugaauuuuaaguguuuuucagaaagucuccaucauuuggaagucacgcuuugccuccuggaagcugucuagacaggugaccaguuuucaccaauuugggggcuauggaggccucuuccaaggcucucugcccucuccaugagccacuuuagcuagaugacugugcugguaucaagugaaaaaacaaaaagaauacuucaguaauuuaauucaaauuuguucuugccuagauuacgguaaugcuccuauuuagaaugacuuaauuccuggcaaguggauugugggagguuaaggagagcacccuggcuccagagcagagagcagaagaggguguucuugcugucugugcugagguuggcuaagucuuucucuuuuucacgccucgugcuuuuugcuacgugguuucugcugccuagcuagucaucugcaaggcaucacuguagcccuauccugaugcccugaguccugguggcuucuacucugacccuuccuguucuuuuauagauuauuccauccuugaccacauuuucuucuguucuccugugugccuagcuuuggggaaauaaggaugagucaggugcaggcuucgguugcucauuugaacagugauucugacuacuguuagagaagggauaugggagagaagugcaggggauuuacuuagccaaggcugaaggcagagaaaacggucauugcugcauggcacagcuaccuguggccagagaggagccauggcccagcucuugcugggcugacccaaaggccgaggaauuuugugugccaggcacccaucugugacacaaccacgugggccaggaagcugugugugugugugugugugugugugugugagcaauuaauggacaggauccagagaugcugagagcaguccugcacagugaagacaguaucaauaucccucucccugagaaacccaggagacccguuccucaucaucgauaugcuucaaggaaggcauaacaaauugauuuguguaggaacuugaacuggauucacugaagaaucucaggaaguuuguacuuuuuucaguuugggcuuugugauacagaaacacgcagauacuugugggaacaacgucccucaggcguuaaauugacauuugggauugagugaaccgaagcauuggugguagagauggggaaugcuaucugaaaaaccagaaucagcuuuaaggaagcugauuacaaagagaauugauuacaaaaaguauuuuuggauuuaaaauacauaagauguaggcaguccuaauuuaauaagauauaagggauugaagcaauuguugccaucgucuuucuuuuuguucuggacugcugucacacacaccauagagaugccuccuugagugucuucaaagugcuguggauuuccuuucuucagccgccuccgaccaucacguccagccaucuguccuguuugaucaaguccgcagagugggucgaggggcaccaauuggcagaacuggucuuggugcauuuuccccuaucaaguuuaucuguuuuuccggaggcuguuuggcucuuccccaaaucuuccaaagacagaacacuuaagucuaaaaggaggauuuguggaccauauauauuuuagcucaaaaccuccaaguggaaucauuuuaaugugcguuuucuugagaaauauguaaauuaauaauugcuucauacauuauucaagaaaaacuuauuuuguaucacccauaacucuucuaaucuuauauaaagauaugcuaauggauuuaauuaaaauaauuauacugaauaauguagccugaacuuuauucuaaaauagcaucuauuaaucaucaucaucaguaauauuuuuagccagagagacacuuacaaccuuaagcugauacuagauggaaagugcauuuauuguuuuauuuuucaguuuggauuaaguuggcauucucaugagaucugggacaauuacauuugcuuagagacgaguauaaaauuuauuucugggccgggcaugguggcucaccccuguaaucucagcacuuugggaggccaagacagguggaucacgaggucaggaguucaacaccagccuggccaacauggugaaaccccgucucuacuaaaaauacaaaaauuagcugggcaugguggcacacaccuguaauucuagcuacucaggaggcugagacaggagaauugcuugaaccugggagguggagguugcagugagccaagauuacaccauuacacuccagccugggcaacagagugagacucuaucucagaaaggagaaaaaaaaaauuauuuuauuucuuuaaccugaaguauuucagcaauuagaaaacuuuuagccucuucugcccuuuccuguuucuucuuuucccucuaaagcuuugguuucaguguguucuuguccuuuugguucaguuuugaccucaguuucccucccaagaguugugauugcugaauacgaugaguuccugauugccuggauauuaagaggugaaccaaaucuuaagagggacacucagcagccugccugucuuaauauaaauagaaauaguuuuaccacuggcugugauucucucugauuuuguuuguguuaucuuucuguggcuugcuggcuuuccaucagugcucaaugaaugguugggagcccuuaugcauuuggugguaauuucaguuucuccuuaggccucucucaugccugagugugcaugggacccagguauguguucuuggugugucaguggguccugcacacguguugauugguccgaggacuaaaugcagguagaaucagaccguccccccacugguggacagacgaaagcuuuaccaaguugauagaauaacauaagccaggacuuaaacugccauuaaguuauuuuaccuaaguuuaaaauaaaaucugaagaaauuacuugcuuaaauagcaaacauuuauuugguaaguucacuuauaacuuaaugaacaggcgaagaguaaagaaagcuaaaaucagugacuuccucuaaauuguguauagaguacucuucucuguucuuggcugggccaggccauaaugguguauucguacaguuucaugguccaugguucauaccucugggguuggggagcauaagugggccucacuccaaacucagcucugucuuuuggggacaucccacggacuuuguccuccuucccacuuucgucccucacccccagugaacugauuagugauuaucccgcucugcugcagggaaccuugccagugccugggaggcaccguggagcagauaccugcugagggacuggcauccuggccucucacccacaauucaaaacagcuuugcacauucugagcacaguuuuauuuaaauaaagaucuucacugauuuacaaaaauaacaaaaggcaaacaaaaacaggaaaaaucuucaauguccucaauuucuaucacccugaucuuuuuugugauuugggaacugauucuacucaguauuugccacaaugaagauggcacuuuacaaauggaaguuugcaccgaaugaagauucagguuugagagaugugcacgcugaggagguuuuccaugucaacacgugcauggguccacacgcuguccugccgccacugcugcugguagcuguggccaacgucuguugagcaggagcaaugagucgagcuuaucacaugcacaacacgucauuccauucucccacagccccuugaggcaggcccuguugaucaccacuguuuugcccaugagaagcccgauaggaaaugcuaccuucccaaauucacauagcgagugauggaggagcccggacagcaccccagagcccugaccuugucuaccauggugcugccuuccuuugauggugcugguuagggucccccacaugcauucauagauuuuuauuuuuggaggugucuuucggcagauaagauuccacgcagcaccaucuauccacagggcagauguccccugcuucgucuguugggugcucugugucuugacaagcuauugaggcaggagcuguuuccacucgaaagagaccugaauuuagugaagcagccagacuccacagaggaaacugaagguuuuuccugcaagcacaagcagaauccaaaacacuugaaacucugacaaauaaccaauauuagaaaugaaucaagcuagguguggcucuuacaauaguggguaauggaacccuccugccaaggaaagccagagccugugguaggaaggaaucugaguucccuuugcaucuuguccuugucuggcuaaucaaacuggauggggaagacaacuuuuucccuuaguuaaggaggugauuucuguggcugaaugcagagagaggaaugcuucuugaaaauaaagaggucacgacuauauaugaaguuugcagucaguuugggagucauggagggucgacuucccaauguccucugugaggacagaaggagacaaagcagacugaaauagucucuguccuuaccugugaggagcuuauugucuauggggaauacggacaaauugaccuuccauugcaguccaaauaggaaugucucuagaugcuguauucaucucuuuugcguugcuauaaaggauacccaagccuggguaacuuauagagaaaagagguuuauuuuggccccgguucugcagggugcacaggaagcauagugcagucaucugcuucuggugagggcuuccagaagcuucugcucaugacagaaggugaagggggagcaggcgugucacauggcaagagagggaacaagagagagcgcagggaggugccauugucuuaaaccgccagcucucacgugaacuaauagagcgggaacucacugguuacugcgaggaagguaucaagccauucaucugaaacccuccccuaugacccagacaccucccacuguccccaccuccaacacuggggaucacguuucagcaugagagauggagaggacacacauccaaaccauaucugauuccuaaccuggcaccuguguguccuggacgaaaugaugucuaagcuaaggacugagggguaccagagucuaacuguguguuugggguggacuuggguggggcggcagagcagugacuccagaagagggaauagcaugugcucaagccucugagcuggcagaggggccuggcccaccugggaaacuggaagaggcucggcuuggugggagagaguccugcagguaccaagggugagucuggggugguggggccagagcccauggcccuccaugggugugggauagguucccugugucccaugagcaggggacguugccacaguaucuaaauuccauuugcauuuucagaaggcugcucuggcugcccagugaggaguguccuugaggggucagcguggaggcagggagggcggguaggaggcuguggcagcaaagccaaugggaggcaguagccgugcggcccaggugcuguuuguuccggggggaguuaacagccugaaccgagggcucugucgcugccuagaagggggcugugaggaagagagaacacccggugugaugcccaggccuguggcaugcagcuggggcuuggcggugcagcgccuggcacuggaaucccuagggaaggcgaggcagcgguggcuuccaccaaggcagggggaguuugcaaugucuagggucagccaggguggaccccggugggugugggguguggguguugggcucaggaggaaggggagcccuggagauggaucagaauugggagucauuggcauggcaggaggugaggucccuugugggauauguggagggaccccgaggaacccacaggcaaggggcugggggagcagggcccugcgcagggagcuggaaggaggguggagaggcagguggccacccugggagugagggccacgcgugccccagaggugagguggccaaagugucaucagaaaggccacuugagaacagccugaagucaucguggccuuggcaggaacagagcuguggugcgggccggagucaggcugcagugggagugaggaggggucgugugggaaguggacgcaggccuugcccacacugugggguauuguccgauggagcagaggcucgcagggccuggggcugcuuuuccgggugagaggcuggugugggcuucaugauagaaagcaggaggcagaggggugagaacugaaggcucugaggagagagagaggacaaagggcaggagggccuugagcagacagcaggggaagagguuggagccccacagggcaggcaggugccccgaaaacccaaggcaggggcagagguugggagcuggagucuuguguuugguuugggugguuggaagcuuagcgaguuccuuucuugugguggcuuuuguuuuucucugaaggagguggugacaugagaugggaggggugggggucaggcuugagaagagcaaagaaagacugagucagccacaggggagaguggagaaggagaggaaacccggcccuucaggagaacagguggacccacaguguaagacgugccucuccucauguuucuucugaauuccguucucucuguccugucuuuguucugucacccaggacugauagcagaugcggguuccucccaguucuugcuaaaccucauuuaccgaaagacacaaaaucaucuuggucgguuaagcagaauucugguuuaaucagcauuuugggaucacuggcauuccauguccccgccucagggggcacaaccccuucucugagggugucaucaugacauuuuugaugcuaggagcucgggaagaccacggcagggaagacuuugggagcccucgccccgcuuggcggucugucggucccgauucacacaguguccggcagcccaaggggagccagcagcaggugggccauaaaggccugucuuguuuguggccgauucacccuggugaaaugguauuuaugaacuugcuacaggcgguugaugcuuugcugggcacaguauaaaaugcaugaagccaguucgugccucacccucugggcguucgcaagcgaaacgagagaccgggagacugagcaaucagccugugugaacgcuggcuauuaaaugucacaauaaauguuuucuguuuuuuuucaaagcaacacugagguuguggaagcagaacauuugaaaucagaaugaaauuauuacgauuuagugcucuuuugaaaaguugcaucccaaagcagacgguugggaucuggugggccuugaaggacagggcaaacacugaggugaacaacagcauggaucguucuggaguggagauuuauggggcuaaaguugcuuuauccucuacucuauuuuuggugaaguugaaguguggcgguuuugcaaaauuagcuuuggggcugcacagaccaaccccaaaucccagcagugcugaccugggccaaagacuucacuuucacaugucuccacugucuccuccgugaaaggggauaguaauaggccuccuucaucagguugccauggggauguaauguguccauagagcccagcaccuagaaacuugucugacaggugcagaauacuuacgucauagaugaggcaacaugaacucacuugaaaugacuugaccugugcaccagaguugagacaccagccugccauucuuucagucauuucccaucccagauagcuauggaaauauucccagguaauauauucuuagucacuuaaaaaauuaagguauaggcuggacacaguggcucacaccuguaaucccagcacuuugggaggccgagguggguggaucacuugaggucaggaguuugguuuggguguugaccagccuggccaacauggcgaaaccucgucucuacuaaaaauacaaaaauuagccgggugugguggcgggcaccuguacucccagcuauucaggagacugaggcagaagaaucacgugaacccgggggguggaaguuguagugagccaagauugugccacugcacuccagcccaggcggaagagugaaacucagucucaaaaaaaaagguacaauuuacauacaguaaaauuuauucuuuuuuaauguacagcucugccaguuuugacaaaggcauaaugcauucaucccacgggagggccccugagcccccuguauuccccugcccgcuuccccaccagccacugacaugcucuccauuucuguaguuuugccuuuuccagaauguuaugaaaauugagucacaugggaugcagccucuugcauaugucuuguuuuauuuaucacugugucguucacgugcaucuguguucuagguaacagugguuggugcuucuuguuacugcgucgaguuccauuguaugaauuccccucuugaagggacauuuggguuguuucuaguguuuggagauuacaaauaaagcugcuagagacguccacauaaggguuuuguaaccgucauagguuuccugucccauguacgugccaagucaaugugcugcgacucuggguugcagcagagaaagaguuuuaaucguaggaccgccaaaacaggagaaggaggaaaccucauauugucugcugcaggaguuuggggcuagguauuguuaagguuuucggagcaggccuaaguggguugaagagcguggggugaagggacagggagaugaagaaacugcauugcauugcugauuccuuuccucugucggggguuuucaaaccaguuggcagcagcaguuucccuggaauucaggaucugagaaacaccuuaagcaauucuuaaacaaaagacuuaugauucuaaugucagaaauccuaucugcaggaacguuggggaugcagaugaccaguaucuagugcugcgugacuuuggauuacgaguaagugggcugaagugcagccuguuccgugcuuaauuaucacuguauugcuguccagaguucuuguuaaccuuaugaggaugccuucaguuuuugugaauguagguuuucacuucauuugaggagguggccaggaguacaauggcugggugcuacggauuaugaauguuuaccuaugagaaacugcugaacucucuucuaaaguugcugaacuauuuuugcauucagacuagcaguguuauacaaagagcauguuguaggaauucuguuuuguuuucaugauucuuauagauguugcuuguaucuuauugucauuuuaauuugcauuucccugaugaguaauggugcugagugucuuuucaaguacuuauuugccauccaucuaucuucuauggagaauugccucuucaucucuuuugcccauuuugcagggaggggaagauuguuuucucauuauugaguuuuaaggguucuuuguguauucuguguacuaaucuuuagcagauauaugaucuccagucauuuucucccuguguaguucaucuucuguuaucucaguaguaccuuucaaagagcagaaauucuuuauuuugaugaaguccaauuuaucaauuuuuucuuuuacacauugugcuauuuguaucauaucuaagaaaucuuugcuuagcccaaacucacacguauuuucuuccaaaaguuuuacaguuuuugaaguucuacauuuaagaucggugaucuauuuaaaguugaguuuuguacagugugagagaggagggcaugaaguuuauuuauuugcucaugguacuguguaccuuuguuacaaauccaucaaccgucuguauauguucaggggaauacuuuugaagugaguuucugccuacuugcuuuuggagaacaauuguaaaaauuguuucuguaauugcguaguauuuuccaguguucaaaguguuacccuauucauuuuccaauuugauuuugagcuuuauugcaauuccuugaaguaucuggcgugaauguuauuuucccucuuacuuaaagacacagguagaagguggcagagccagagucagaucacuuaaaaucuggcaacuuuucccaacagaagagagcaaagggacucagggucugacuuucccccgacugaauuuaauucuagcuuaguucaguacuagcuuugugaacagggacaaaguaauuaaugucuccauuguugguuuuuuccuccuuccuacucagcuaccuucuaauaggaggugauaugguuuggcuguguccccacccaaaucucaucuugaauuguagcucugauaauccccaugugcugugggaggggaccugugggagguaauugaaucaugagcagcagguuuuuccugugccguucucaugauggugaauaagccuccugagaucugaugguuuuauaaggcgcaauucccuugcacaaacuuuguugccugcugccauguaagaugugcuuuugcuccuccuucaccuuccaccaugauuaugaggccuucccagccauguggaacugugagcccauuaaaccucuuuccuuuauaaauuacccagucucagguauuucuucauaguaggaugaaaauggacuaauacaggaggucuguaagaauuaaagaucaaauauacaaggguccuagcacagugugcagcaugacaggaucuaucauuaauaucauuacucuguuuuuugaggguguuuguuuucuagaagauacauuacuaaagaacaaaaugauucauaauuaaaauauaugcagauauacaggaaaacauuuuuggaauggaacaaagacaguugacuuuaaucauugaauguagaagaguugaagugaauuuaauggaagaggauuauucugagggggacaggucuucauuuugcuuuauccucacagagcucugcagggguaaaaggagaaaaucacaugcaugcuuagcacacaguauaggcacuuaggccacaggugauaaguguuggcuucuguuaauaauaauuuuauuaugugucaggacaaccugugagaaguuagcauuguuugagcauucuuuguagguuagagauucauuuucuuuuuugagacaggaucuugcuuuguugccggggcuggauugccaugcugugaacacggcucacugcaaccucuacuuccugggcucaggugauucuccugccucagccuccugaauagcugggacuacaggugcaagccaccaaugccuggcuaauuuuuuuuguauauuuuuguaaagguggaauuucgccauguuacccaggcuggucucgaacuccugagcugaagcgaucugccugccucagccucccaaagugcugggauuacaggugugagccacugcgccugaugacuuuuguucuuugcucuauuuucaucguguuagccgucagccccucaucuggaagugaucuuucucuucucaguauuucugcgguucuucucauaaggauuacaaauugguaugaacacucccuaaccugcaugcugcucagccuucuuguuucuugauuugcagggggcagcacugaaauacuuaccaacgaucgucaacgaugugaaauugguguuugaucccaaagagcucagguaaguaugcagcccaggcgaaugcuugucacgugccgugugugaccuccuucucagugugcuuaguuuaugggaugcucaggguucugccucaugucuccauaugucagugcccuggaucauucuggaacauguguugcugguggugucugugacucuuugauaaucaugacauuauguggaaaagguaucaccagucaacuaugacaacauuuuuuaagaagauuguuuacagucuaauugguauauaauguccauuuggcauuuugcauacuuugagguuugaauuucaguaugugguuguugguuuugcucuuguuuucagcaccuaaaaauccugacauaggagcuuuaauauuccugcgccggcuucugcuucuguaauagaggcaacuccucuuugggaggggcccugagccucaagcagaagacucagaaguuacuaagaaaauaauuuuuagaaaaccccacaaacaaacuuugagaaagcuggucacugggcuuucagaccaaggagugagauuggacaccaaauccuuccuuuucucucccuaacuugccgccucucaguggccaggugugcuguuuguuuccuaaucuguugguaucacugcauucugaaagugccauugugagcaaaugggauacacagccuuuuuaauuuauuuuuuaagagauaggggucucacucuguugcccaggcuguagugcaguggcgcgaucauagcucacugcagcuucaaacuccuggccucaagcaccccucccgccucugccuucaaagcacuggaauuaccgacgugcgccaccgcucccaccccagggaugcacagucguuuaaaccccagacauucaauagcacaguccucaacuacuuuuuguuuugguuuugauuugacacaauaaacuaccugugggugaagacaccauuuuuuaccggccaaugaagcccuccuaaauauuaguaaagggccaucuguccacugagcggugaaacggaauaaaaaaugauuauccuuccuguacuuuaugucuaccauaggucacucgugcccuggaauugaagggcgaggggcucucugggaggcgcugucccccacgaaucauugugaaucugauguucccuaggauuuaguguccugcagggaaacauuuauuuucugcucccagggcaccaacagugcuggucauaagcuuagcagguccuacaugagaaaaggagaaacacacaggcucacgggcggugucugcccaccuggcgcgcuguagaguccucuccuuggcacaugcuucuccaagagcgggccccaaaauggcagcuccgguagcccuugggaacuuguuagagaaagccaaacuuuggcuuccuccccagaccuucugaauuagaaacugcacaguggggccuggucauuugauuuuaacaaccucccuccccgugcaggugcuuccagggcucucucauauuuuaguagcucaggucuugaaaaacugagaggaagcagagaaagcugcaacuggugugggcuguggccauacucuaggccugucucauggugcacacagaucagcuccgcacccgcggagggguaucgucgauacucucaguuugcgcuugagccgggccuguccucacuguacgcacaaauuagccccucaccgauggaggguaucauugacgcucacaguuugugguugagccgugugcuuggagguccuaggaagaccugcuuggccagggccgaugcaggcugcugcuggccucucucagauuugugcaucccuguguuccuccucaaugccuguuacacugauuuuuaaaaaugacauugaaaaucacauacauauuuguuucuauuuagaaaauugguucauguuuuaauaaacagaagagaugacagaagaggguaacucaaacuuaaguccacuacccaaaagaaucagaaagugcuggaucccuuacacacauacguacacacacacuuaaaaaagucaccauuuuuugguuaggcauggugacucacgccuguaaucccagcacuuugggaggccgagggggacagaucaugaggucaggaauucgagaccaaccuggccagcauggugaaacuccaucuccacuaaagauacaaaaaauuagcugggcaugauggcgggugccuguaaucccagcuacucaggaggcugaggcaggagaauuguuugaacccagaggcagaaauugcagugagccuggaucgcggcauuguacuccagccugggugacagggcaagacucugucucaaaaauaaaaaaaagaaaagucaccauucuuugugaucagcuccugcacuuaagacaucuuccucucccaugccacgagggcaucuucugcaucaucauuguuaguaacuuucaugccgauccaucccaugcuggccuaucuuuaagcagcaacaauagacgcagcaucuauuaugugcuuucaccauguaaaauagguuuugcacaaagcacuuguauuaguccauuaaucuuuacaacaaugguaugacauagguucuauuguuagccgaauuuuauccucaauaacuuguccaugauaauucagcugguaaauggcagugguucaaggccaacccgggcuuuuugaauacaaagaacaggccucuagcuacugugcuaccugauggcuguugaguuguauucaaguuuuuuuaaaaaaaauauauuauaaaaugcuaggauaaaauuuccuguagcuuaauuguaguuucugcuccuauuuuauaucauuaggauaaaaagagaaauggcauuacuugguuuugcauuuucuuaaaggauuuucaguagauuuuaucuacucgucccccuccagaagguaaaaccaacauucuaccaguauacguuggugucuguuuucccaaaauauugcugguacugggaauuaccauuuuauagaaccuugccaguaugacuggugaaaccguaucugcccauuuuaauuuguguuuauguaguuacuaacaagagcucuucuaaaauuucuucauaggucuguuagccuuuuguaaaaguguauuuuuaaaaaauugcuuuauugugguauuauuuacaaacgauaaagucaccuauuguagacgguucaauucagugguuuuuaguauauuuacgaagaugugcagugaucaccagaguccaauuuuagaacauuuuuauaaccccagcaagaucccaguguccauuucuggucauuuuuccuuccuagcccagguaaccccgaaucucuuuucucucucuacacauuuguguuuucugggcauuuuacagagcuggaaucauacaacguguggccucuguacuggcuucuucuacuuagcauaaaguuuucaagguuucuccauguuuuagcaucagugccuccuuguuuuuggaaaugaauuguguggcuauacugcauuuuguucauccauucauuaacugauggacuucguguuuuuuuuacuuuuucaguauaaugaacaaugccacuuggauucauggacaaauuguuguguggauauauguuuucauuuuuucucggggaggugguauaugccuggaaguggauggugacuauguuugacauuuugaggaaaugccuaacuguuuuccaaaguggcugugcuguguuaccuucccaccagcuuggugugacuguucucauuucauuauaucuuuaccaacacuuguuauugucugucuuuuggauuauaggcacguuagugauugugaagugaaaacgaacacuuucaaaacaucauuucuuggaaugaguuauugaccccauagugcaugagaggcuguguugaacauacuggugacauuaaugaccaugugaugaccuauaucucaguauuguaacaacauuggauccuuuugcuaugugucucaaaauuauuucccuuguguuuuuccucacagcaaaauguuuacugaauucauccucaauguucccaugggcuugcugaccauccagaaacucuacugcuugaucgaaaucguccacagugaccucuucacacagcauggugaguggaaccccaagaauuauucacuuguccuguuauuuauuuucugaagacauugacccucugaauugccucuucuugacaaaaggaguagaggcugcaaccaauuaaaacugcuguauuacaagacaggaagauuuagcccuuacaagagaaggguaauugacauguaaugcagguaauagaucauugagaaaugaaggcaaaagcucguaguuuguaauuuagguauacaccaaaguccuaggguaaucagcauacauuguagccuuuaagauaugugguugucuguccuggggaggcaaucacuucgcuccauugugaugauugcaaggaaaagaauucgaguuuucuuuaaaucugaaaguaaugguuuuaucuuauucugaacuuugcauucuuugacagcauuucuucaaauccuacucaaaguaauaagaauuucaaugauucuucaacucauuuauccugcagaacacuuuauauuucccuauguuaucucccugcccuuuuuaguaaucauuuuuuuucuauuuggacagauuaaauuaauauuuuacccuugucaagcaguuuuauugaaagcuuaaaaccucugcauaauuccacaaacuuccucauuuauuggaggcaaaugugaagucuguugagugacauucugacugagaagcauggauuuauucgauuccauuugugccuggacauuuggcugcuccauucauuuucuguuguccucauucuugguguuguucucaguuccccugugcuuucacggaucccagacuugggaugucccuguuaaguuacgggcuggguuuggaacacacucugugcuuggcuugguccuuugugccuucugggaugcgaauuuuaaucuucuuucuuggcuuaaccuuauaaaaugcaccagaguguacacguguugcuaaggcuaauauugaaagaaaauguugacuucauuuaggugagaguguucuucucuagaaaaaaacacaucaaaccaagaagugggugacuuucugcagccccuccauguagaccucucucuuuagucagaaaccacuucuuacuuucauaaaagaaagucaguucucaccauggucugggacucaaagcacaugacgcuccauugagcuauuauuccugacuguccauauuucaguuucucacuggaaacugaauugcccacucaccagguguuuuccaagacuuggguacucuagggggcuuaaggaaaggcugaugauagaggugauggccaggcacccugcuucaggguuuccuccuacagugaauaagcuuuguaccacagcaaguaaaauccuccgaaaauuuuauaucugggucuuauuagguggguuacugaugcuccuaaccauucaaugccaagacacacacagcgacauacugcaucaccagcacuaccgucaucaguaucuucaucaaauuaacagcugucaaugagugucaaccguccaugaauaacaauuguuguaaauugucgaugaauugugcuugauuuuucuuaaguguugauuuaacgaagaucuucuucaggauauauuuacauauauuuuuaaauuucuguugcaaaacuuuguucuguaugucauuuaguuucuuugaauaaggauguaagccaugaaagauucaauuagauuuuuuuuuuuuuuucgagacauaguccugcgcuguugccgaggcuggagugcaauggcacaaucucagcucccugcaaccuccgccuccuggguucaaaugauucuccugccucagccuccugaguagcugggauuauaggcacccaccaccaugccuagcuaauuucuguauuuuuaguagagaugggguuucaccauguuggucaggcuggucucaaacuaccgaccucaaaugauccacccgccucggccucccagagugcugggauuacaggcgugagccaccgagccugaccccagauauuuuuuccucuauuaaaacuugcucauuucuuuaggucguagaaagcuugaaggaaacuuacuguuuauauucgaugauuuuguuagcuuagguguuuguaauuguguucugucccucuuuccuaugccccauuucuguuucauucuuguucucuaagccuuuuaucuuagacagccugaaguccuguuuuggaaguaugcaggaugugaauaacugcuuagcuuuguuuaauauggaauuaccaggucauguaauauuuugaaauaauuaaccugcugucaucuuuuuaaguacggaauuaggauuuugaucuuaguauaagcaaguuguacccaauguaguaaaugagguuguaugaaauauaugaaucccaaauuauugugggcuaaaugaaccaaaauuagcccgaagcuucgugucuuacaagcagccccagaauugccccaucaguagaaguugucuaagcuguaacuggcagcucaaauguacuucuaaaugcuuagugguugccuagaagcauuucggaaugcuuuggccaacgugaaaauggucccauuuacugucuuugaguuuuaagcguuuuucuuaaaacaaccuguuuuucucaucugcaagcucucugcuuguucaaagcagccaacagacaucuuaccuccuggucaggagagauuuaucaccagaaaucuuccaguugguccauucuuacaaaagaugucauuacuuuugcaaaauauucugugccaccuuugguauaacaauuuaaagccaaacuguuuucugaugagacauguugaaucugauuuucaugcuuuuuuccuguuucuuguuaauuuguacaaaugugguuguuuuuguccuguuuccugaucccaguggaaucagucaaaugaacucucuuuguguucagauuucuagaacuugguauaacuggauuuagcugcaugugccacugaaugcacuugcccuuaguaaacauccucuggaggauguguucagaaugugucacuguauguguccuccaggcuccuucgugggggcucccugggugaagugagauucccaagucuuugcuucucagcuuguguguugccuuacucacugaaagagacccacugguugcuuugcacuaaaacauuucuuuuuaucuccgccugauauaaugacaaguagaucuguuugcaagaggcuggcagugaauucugaaacugguguuguuccucugcagaaaagccuuucguugccaggucugggucccaguaggccaggccuuacagugccuugguuguuucuggccuuguuuuccccauuucucucucuuggagaacauggaaaccguaggugcauccugaguuuguugggcuucauaggaggcacgucuuugggcuugucaaagcaagacagcucugugugguccaguccaugugggacuggccugaaugaggacaccaggccugcgucacugcggccauuugcucacagagcauucagccuuccucugcccuucuguucuauccaggcccucaaggauuagaugauggccacccacacucugcaggauggacaugcuugacucagucccccaaucccaaugcuaaucucugcuggaaacauccuuacagacacacucagaaauaauguucagccagcucucugggcauccguggugcagucauuuggcauuuaaaauuaaccaucacagaguauuucuuccaagaggccugugauugcccugcuuaaaaagcccccuacaugccaccucauggcuccucauggcacgccccccauguggaaucauuguauuucuuacuugcuuauuuguaggccuuccauaggaugagaacuuuccaagcugggccuuguucaucuagauuuugcucuucugcugguaccuagcgcaugccuggcuucagcaugccuguaauggauauuuauugaaugaaugaaaugcuuauggguauuccuaaccaggaggcaguacagagaaagaagcaggaccagcuacacacauguguaguugacuugauugaagggagguaaagguuuggauucacauggggaaauuggcaaucuuuccuugucuuagcauugaaugaauugaucauaggggagaaaggagaggucuuagaggaggaguaacaucaggagcaaagggagagggagaagagugagagacuugaggugugaagagucuucucugagcaguuuuauaaaaucaagaugcucuucuauuugcaucugaucuaaucauuccuguuuucuggaaauaggaggggggugcaguucagaucugugcauucaagauaccuuuuggcuauaccuuuggcuaaaacuauggaaaauuucaaauauacaggagggcagagagaagagaguaaugcaugccaguguacucaucacucagcuccacaaauuaucaacucaugauccuuuuuuuucuuucuuuuuuuuuuuuuuuugagauggagucuugcuuuguugucaggcuggagugcaguggcacgaacuuggcucacugcaaccugugccucccggguucaaucgauucuccugccucagccuccugaguagcugguacuacaggcgcaugccacuacacucagcuaauuuuuguauuuucaguagagacgcgguuucaccguguuggcugggauggucuugaucucuugaccucgugauccacccuccucagccucccauagugcugggguuacaggcaugagccaccgcgcccggccaguccaucuuuucuuaucuauaugcccgucccccagauauuuugaggcaaaucucugccaucacagcauuccauuuuuugucauuuuaaauguauggugguaauacagagggcaaacaguguuccuaagaagagguugugcagaggagcugauccccaugcugauaaggcauccaccuuggauguucccaccccuggcccuuugcugagguagagggccugugaugcauuagcauacugugugugagucagugaaugggcagugugugugagagucaauaggcugugauggcuuuaagcuuugucucgccaugugacuugacuacuugaaagcugguugauagauuacaugcuucaccaaaagaugacucuugcauauaaucugugguguggagugagcagauuuucaaagcaagauagauacaaagagaaggaaaagucaaagcuucaucauuugugcauuuguagcuuuguuuccaugugauuauauuguugcccacauagcugacaaaagcugugaaaauuaaagcuuaaaucuuauagaaaugaaaaguuuuaguguaauuaaacacuagaacacugacguuuaggauuuaagcucacaaaauuguguaacauuaauguuauagaaauuggaauaaaaugaaucaagcugagcuaacauugacuuuuaaguuaguaaagagcauuggcuauacuuguaagaagccuuugaguggaggugagaguccuccuggaacauguucucucacccacuggccccuuucugaaucugacagcuuugggaagcuuguuucaaugaacacugggucacuuauuugcuuugcaagguauaauuuuuccauauucccauuucuauaguggccaaagcaguggacagguuuucuuuggagcuuacuguguacuuaucauuuuguccucacuuaguuuguuuuggaugggaguaugagacuuugagaguaaauuuuagugguaaggcuaccccuuuuuggucuugcaaauaguuggauacucuagauagauugcuuuucuguaagccugcucuguguaguuuucuguuugucuguuuguuguuuuucuggugguuggacucuggcagugaguaggaaugggaaagaggccauucccucauacccuggcucuccuggggcuccucccuucacuauagcaaacaggcuccuuguagacaguguucaugagucuuuucaaacuucauuugcuuucauuuuugagcuucuugaaaguguaagccugguaaguuuaaauuauuuuccuuauucuuauuuucaaggugaaugauucuucuaguuaucaagcagaguaaaacucuccuuuuuaaugguggaaacauuaguuacagcagcccuuugaaaucugagggcaaaaucccagacacuuacugggacuagcuauuaggaaauauugaagucagauuucuacacuauuaucauugugauuugauccaugauagaaauuuauaucucaaaaauuacccuauuaauaaacuuauuaugccuuaaauuauagaaaaguugcguguuuaaaacaaacccauaauauaccuucuuaauguuuugauaaaagcauuuuugauuaaaaaaaccaaaauaaaaucucuugagcuuuacuguuguggaaaauagaaauauaucgaaagggaucuuaaaccuggagcuacucugcaguaguuuuguuaacuugauagauguugugcagaaggaaaaauugggguuggggucaauuuugccacauucacuuaauguaccacucauauagcauucugcaguacuuuaauuagauaguugugcugaugacuucugaugaacgguaccagcugugaacccugaagacugauucuuuuaaauaaugguggaauguaaacaucauuuucucuucuguuucuuucaugccuugagaaaacuuuuuaucuguaauacugcaccuuuuucaucccucauucuguauaucauucucugucuuucauuauauauguuuuugaaaagaccauuuguuauaacacugcaggauuuuagaaaugacuuauugaauguaggagggugaacucaauuucagguuuuuaauuguuucuguuucaauuccaucauaauucauugaauaucuuccgugugcucagaaccauugauuagcgaguuugcuuccuuugagagucuucagagucaucuacuuaaaaauguagaauuggaaaagagugauuaucucaaugcucagauaaggacaccagaguucagccagaagccuggcagggagcuguccaccgccguggugcugauugaggagguggcuucuuacaaaucuaucagcccacucuuuucuuaaacuguuucacacccaccauaugaguaaugcauucugaaaacugaauuuacuucaaaugccauauggagcaagacaaaauacaaauaagugaauaaauaaacauacaaauaaauuaaauguauaaaguauacaguguugugcuuauauguucauggaguuuuaauaguuuuucucuucuuucugugugggaccuuuaucugugaucaaauugguggugccaacaguuuaugguauaguugguguaaacuuuaucaucgucuguugaguucugcugucacuucugggugggcuucuguuccuguugcuggauguugaaugcaagaagaacgaucugagaagagacuguguugguugugcuguauuuagucaugugcacacugggcaccaggaaagcaagucccugagucucuuuaguacaugauuucuucuagcuccugguagcugauuucuguaacugcaugauguguugucuacaguaacuagccugggacaguggaaagagccccaggucagcaugcagucuccuagguucugcuuuaggaccucugucuuuucuugggcauaaacuccucccugggugcacaguccuuccgcuaagaugaacugcaacacaauauaggguuuugacauauguauuuuauugucagagcaaccaggaggggaguuugugcaggaccacaugggccaagaccuauguuuuuuugcuaccuuuauucuccugguuuaaaaaauacccaccauuccacagcccuguauauucucucucaguuuucucauccuccauguggugagauccugccugcagacugacagcccuguaaauucuuucugaacuuaacacaagccacauccuugauguacccccuuccaccuagaaaacagacuuccugccugaccaauucuucucacacaguguuuucugcauuuuucuugcaucuugccaauuuuuucaucuacugauaaaugggacucauuugcaauuuuucuccauuggcucuucuuuaauuucuucccucugacaacuuguuacuaacagaguaauggaaguuuaauccuuaguuuuccagaguaaaagauacaaaauaucugcucccccacugccuuccuuuaaaggauggcucgcuuuuuuacaaagccuugugccgauguccagaaaacauauauuugacaaacuucuuuuuccuguuguucaauaguccacgugcuacugugcccccuccuuccaauuuccaacacccuuuuacuugcucugucaccuuuucauuucaaauuccaugauacugaauaccucaagagugaagugcagauuaccgcauuucuaacaauuucagcccucugcccaguggcccuguuccagucagaacacguaaaagguacugucgggcagcuuggaacagaaacacuguacaggccauuuguguuuacuccauuuuacagacuaggaaacuaaggugcagaaaggaaaagugaccuaccaaggguaacuugauguugauuuauucucugguacugcuaacuuucaugacuuguuagguuagaaugauucuugaaaaauuugcuuugcgucuguuauguaaaaaugccugaaucauacagguuuacacacacguguaccugcauggguccuuuacucugggggcuccagcugaggaaucaggcuuuuuuuuuuuugagacggagucucgcucugucacccaggcuggagugcaguggcgcaaucucggcuuacugcaagcuccgucucccagguucacgccauucuucugccucagccuccugaguagcugggacuacaggcgccugccaccguggccgacuaauuuuguuuuuguauuuuuaguagagaugggguuucacugugucagccaggauggucucuaucuccugaccucaugguccuccugacucagccucccaagugcugggauuacaggcgugagccaccgcgcccggccggaauagacaucuaauaauucugacuccgauggugcguagaggugcaguccugaaggucccuucacucagcucccagcucccacaucugugaaguguggggcuaaggagauggcucugcgauuccuuccagugucggcaccgucuucuguauuucuguuguuugaagacuugaauggagggaggaaagcacgugaacauguugaaaccuguggguccaggauucuuagaugguuggaaaauaagacaauugacuauacaagaugaauagcaaacaccccccauguauaugauucuuacuguuuaauucuuaggaaaaguguuauucuggaucucaguucuauguaacacagaguuauuaaaugcacuuuauggaucauuuauuuaaugugaccaaacuaaaaauuaagaaguacauuacucuguucauaaaaaugaauguuuucaauggacaaauucauucuuguauuugcaucuugcuuuaauguagagcuguaaugggguuauggucagauauucugcuugggcauuuauaagcugauaaugcuuauugaauaccuuuuauaaagauuaauauuuuuuacucuguccucauuaccagagcauuaaucauccuggcuucggcccuugcagcugaggaugaacagauguugaauuauugcugucuguaaucauuguggaucacacuggggaagggccgugaaaggguggcuggugugauccucacagcugauuugcauggagccuggcuaccuuuauagcucugugcauggcagaggaaaccaggauagcugugccagcugauucuagcuuccucguaggucaccguagccuaagucagcacugacaagcacuggcgguccuggagucacguacgugugacagggugucugauaagagagagcuguggccaugacucugcuuacaauaaaugccaguucauaaaaaugagaagucacauacaaggucuuuaacaucggcuuucuagcauucucugagacugugcuguccagcagaaauagaaugugagccguguauguaauuaaaaauauucuaguugccacauuuuaaaaaaugaggcaauugaugaaaugaauuuuagcaauguauuuugucuaaaacaucacugcaacgugaauucucucuaaauauuacuaaugauacauauuuuacauucuuuuuaugauaugaagucucugaaguccaguauuuuacacuuacagcacaucucuguuuggaugugaaauuuucaccagacacuugaucuuuauuuucaucauugaauauaauuuaccuuugaaaaaugagauucacauaccccaauuguuccaaacauugguuucuaacaaguaaaucaaguagcacuuuuuacauuugaguuuauauuaauuacaauuaaauaacauuaaaaauuccuuuccuccauggcacuaauuagauuucacaugcucagaaguuuccauguuggguaucacagcucugagguauuaguuuucuuuuguguccuuuuaguugaacagcugacuuuguauaauacuauaccuucuguuaaccaccauuuguuguaggcucauauuugcuaaauacacacaucguaucauuuaguucucagucaaccugggagacgaccaacagcauccccauuuugcacauuagaaaaauuaagaccuagagaguuuaaguaacucuuaaacgcucuagauacaaagcaaagagccagcaggggggauugcauuauuucuuuauacguguggguaaacugauuaaaaggcuuuccccaaaucccauaaagugacccagguuccuggacuucuggucaaguguuuguuccagaguauucaaaagaugauguguuuuucuuuaaaauauaagaccccuccuccuuuuuuuuuuuuuuucuccugguggauuauuuguuggcuucccaggccaucuguuuuggaacuaaugggacuaucagugccaaaccuguagaaaugacauuuuguccaugggaaaaguauucaggacauuuagguguguuguccauaggaagauaggagauuccucuuccuuggcugccagagacagcuguucaugcuuuaagauaggucauuguaggguauauguauaugugugugugugugugugugucuaucuguccgucugucuguccaucugucuguuuuuguaguauacguuccucagugcucuugauuugcuaucuuaagacaaaauucaagagucuuacuguuacuuaaaacguguacucccaccacuucuugaaaaaaccuaucuguagacagaaauauagaguaagagaagucccuuaaaaaaugagguuuuaagaaauuuauguuuuugcuuuuggggaaggcagcugaguggcuacuguacuggauagugcagcuguaaggcuuuaguuuucuuuguauauuuuuaguugaaaaggcugacuuuguauacugauauuuguauuauuguuauuaacagcuaccauuucuugaggguugagaguggcagaccugcuuuuaacugcagacuuuaguuugauaccacaugugcguaauugcaaguuaauccaagacacacacacucauaccaccacuaucaucaggccuugguuuaugugcuuggauaugccauuuaagaaaaauaggaaggcuucugcucuuauggagauugcauaucagcaaggaggaacagauaauuaaagcaaucaguauuucaguguuccgauaacggggcauuggaggccuuccuguaccuggguccagugggggcugugcugaggccagcagaucacaggucaccagggaggugcacuccuuggcuuugcugccuucagcuucgguccucccacccucuccuaguggcucuggggaauugccuuucuuugggggccugggauggguugcuguggaccaggugacggacgguacuguaaggugccauagccugugugacccucugccuggaggcaugguugaaaucccuggcaugggcagacugaccuuuggccuuuagggaaagagccucguugccagccugguccuccucagugaccugguucuguuuuggggucgggguggaguuuccugaugcugauggugccgggggagaccucucacugaggcauguuggauggcuuuuuacacaguccuuccucaagcagcaucucauuuugucucgacaguuaaaguagacaucgccccaccuccccacuugaucuugacuggccauggauggcugggucaugaaggcugaggugcaguuggauucuggucuaucaggaugguuauaacaauuuuuuuuuuuuuuuuacaucuucuugggggcuuagugaaugaaaugucuguauugggacaaaaugacagugacauuucuaaaaguuuuguuguuucucaucaggagaggcuggauagcaaacaggugaagguagcgcaguccuccaggugggguggauggugaacguuaccaccagguaaccaaagaugguugauagcauccuccagccaaagaugaacagacagacaccucuuucuucucaccagaguaauucuaacaaaugagaccagcacacucaauuagcucugagaauagcacagaucacaacugccuacccagcaugacagauaaauggugcggugagggaugaauuuaggccaggacaucuggguaccagagccuacagggccagcucugcuguuucugagcccagugcuauguuccucugauuuucuggaaucacuuauggacacacccuccuuccagccuguacuggcugguccguuagaccuuuucccucucuuggguccguccuaagcuugcuucagaagacggcuucuaagcuuauguagucauuuuuuuccuuagucacauugucaggggcugucauuaccugcucaggucuuagugguucuaacugcugccucugagguuucuuggaaauucagcuuguuuuccagaaugguggcagugcuagggaugaccaagugacaggguugggccagggcucuccccauguugagguuggcacagugugugauguguuuccagccaaagggcaagaggacucauuugggagauauuauggugggcaccacgaggaagagugcuggcagggcggggcucagauaagggugugcugaggaagcauuccagccagcugggcuagagcauuuggaguuaaacccuacgucggaugcuguguugugguuaaggucagcagcucaagagucacuaaaguuggauguaguuuguaaacaucgagguucuauaggaaaggcauugagauuuggggguauuuguggaaauagugugucccauguguuagcguuuccaggcuggauucacucccaugaggucauuuucuuguucauuucucuuagacuggcuuuguucucggguggcucuaacacuagggcagucuccuacacgggcagcccaucuuggcacugugcucucccucacugacauccugugggauuccagacaccacagccuucgaggcugaccuggccucuuuccagaagaugugcagcucuuagcacgucauacauuucuucugccuaaguguugacuacuggcauugugaaauuaacagguacauucuuauuuuccuauauuaauuggacaaaacuucuuguaaaaauggaguugcucucacuccuuucuuggcgaaucaacaaaaaauggaauuggggaaggccuuggccaugagccgcccacaugugauccgcuggagacaggggaguagagggguuuguguuucuucucagucuuuguuucucucugccugcuccccaguccuucauuacaguguaguucuugggaaaguucuaagugugcucuguguacuuagaggaaccauuccaauguugcaugcuuauaguuuucuuauauaaaagaaacauuaaugcaaaacauguuuuaauguaucuuuaauguuguaagucuuaaaauauaaaauccugaaaaccggcuaagucuguuuaagguuuuagagcacugcugucuccucuugugcucugcguuuaaaggaaacaagaauggcugggcuagugucaaaacacagaacugguguuguaaauagauaguccaugcuggagaguggaugaugcuccagcuaagcuggauuucccaacuggaagagacaauuagggauugcauuucaccuuucauuguauuuguaucuguuucccuguugcucuguuauuuucugaacauccuuccucugcucuuauugaaagaacaaauggaaacccaaaccugcuuugccucugauccuuacaccauggcaucccuucauuuuauagccaugcgucccagaguggggccucugcaccugcuuuucauuuccuguuccuccucagcccacuccaggaagcugucuugagaaggauucugugugccuuaaauugccacauuccaagauuggcaucuucuaccuaggagaaggaaaucauacuuuggcucaccuuggcauagaugagaaaagcugcaauucaaauaauuuguguuguaggaaguauuucuuuuaauguugcaaauuagugaauuuguaguuagagaaaauucauuaaaaaacccguguguggcuaacauggugaaaccccaugucuacuaaaaauaaaaaaaaaaaauuagcugggcgugguggcaggcaccuguagucccagcuacucaggaggcugaggcgggagaauggcgugaaccugggaggcggagcuugcagugagccgagaucacaccacggcacuccagccugggcgacagagcaagacuccgucucaaaaacaaaacaacaacaaaaaacaaaaaacccauguguguuugugucugcauuuaugugcacacagugggauauaaguguguguguguuuauauauaucauguaugcuugcaaauuauuaucuguuuaccugggauacacacauagaugcauggaaguguguuuguaugugaauuauuuacaauaacagcagacacgguguucucacagucaaguaauugaccccccuccagaugucaguuccacguguugcacaacgugaaugcaaacugcuugaaagggcagacaagcuuauagcaaacacgaguugcgucuugguggguuucacacugacuggcaaugcuguguccuguguagacugcagagagauccugcuucccaugaugaccgaucagcucaaguaccaucuggagagacaggaggaccuggaggccugcugucagcugcucagccacauccuggaggugcuguacaggaaggacguggugaguguuggcucugugcgugacguccugccauuugccugaaccugccauuugccuugcaguacaacuuuauucaguuaaaaaugaaaggucuugauuuuaaggucuagccucucuuuuugucucgguagaguugcacccuuaaauuauuuuuauuuauguauauauggugauuauuacaacauuuauccuuuugcauugaaaauuguucuuuauuuccugugucuucucgacgaaaugucucucaggaccuaaauuuucauccuuaaggucagacaaaaaggcuuugaugcuuaaaguuggcuaauuaucugcauucuuucuucuuauuuuuauuaaaguaauacaugcacaaaguuaaaaauaaauaaauaaauaaagccaggcaugcugagggagucguaaggagaagagcagcucuuuuccuccccucaggcucucuuccccuaggucagugcuuugcuuuuguagcucuacccuauuccuuuuuuuuuuuuuucuuuuuucuuuugagacagagucuuacacugucgcccaggcuagagugcaguggcacaaucucagcucauggcaaccucugccucccggguucaagugauucuccugccucagcuucccaaguagcugggauuauaggugccugccaccaugcccagcuaauuuuuuuguauuuuuaguacagacgggguuucacuauguuggccaggcuggucucaaacuccugacuucgugauccaccugccucggccucccagugagccacugcaccuggccuacccuauuccuuuugcauuucuaaauuguaugcuucuuucagggacuuuuuuaaaaaucagaaguuggugccagcccagcgaaguagcucacgccuguaaucccagcgguuugggaagccaaggcaggaggaucgcuugagcccaggaguuuaagaccagccugggcaacauagugagagccugucucuagaaaaugaaagaaaaaauaaaaagcaaguuugugccagcacauauggaaaagucugacccugugccuuucacucccaacauaccauuccuguuggagcacacacaugaugcuauugaucuuccaggugugccuggaaaggugaaagcagggcuuugucuguccuugccccuagcccuggacagaguggccaggauuucuaaguagauaaggcuugucccuggccguuuccugcaugaccuugaaaaucccuccuagucaccacgcccauauaccuggccacccacuccgcuguagcccuggcucauucucucagagccugauuagugaucuggaagaaaaagaucggauuaaaucuguucuuggugaugcuggaaaccucaccucuuacaggggcauugccuuuggagaggucuuggaggccuucacccaaaggccagccuccaguggucccacuucaggcucuucccuguuuuuauuggagaaaagcuugggguaagagcuuguauggccaaagcucacagaggagguggugaugcugggaagggccuagagcauguguuuaagcagauucauaguucacgaagaagaaucaacaaucgcaucccacacuaauaaaagaguuaauuuuuacugaaugccacagcagugugaauuuuagauaguuugcuaaaugcuguuuaaacauucuauccugugugacuguuuaaguuauuugcauuugacgugcagaaccaucuaggacuguuaucugccugccuuccauuuacagauggccaaauaucuuuagaaaacuaauuggugggcuaaucagggaucauaaacauuauauuguuuaaacagauuuucuuuuauuuuuaagguuugcuuaaauuaaauuacuaugauuauauauguaacaaauuaucauuaauggacuauaauuaauaaaaaccccugaguuuuuuugugagagcuuuugccuuugacaagggccauuuuucaucucauuaaggguuauaauugauuuacucuuuacaggguaaauggauucaaugacaaccacuggggcuugcauguuaauguuucucugguguugguguucauugguguguccuuccccaggggccaacccagaggcacguccagauuaucauggagaaacuucuccggaccgugaaccgaaccgucauuuccaugggacgagauucugaacucauuguaagugcuuggugacauauguuuggauauuuaacuggggcugacagcauccuucuccaacugcuguuugaacauagcuuauuauacugcaauguagugagcaguugagauacagcuugguauauaaaauguccucauuuuccaaaugaaugucaaaguugaaggguaagcaaaccaacuuuaaagauggaaacauuuggcucuuguuuucucauuacuuacuuauagcaaaagacauguauuuucugcugagucgucauucuucuggcaguuucuccauaguguuuacacuuaaggugccauuaauaaaauuuuaugaaggacccuaaaaaguaauugagauucuucaccuuaguuauuuuauugucuacucuaauguauuguagguguuuuucuuaaacaguaauuaggcaggagccuauucauuuuuuucaagaauauuuuacuaauuuagacaguccaucaaguuucugaucauggugccuuuucccaggguucacugcuguccucugcacccccuuaccuuaagucuguuuccuucagcaaaaaaugcaugaguagaucucguuuaauuuuuuuuuuuuuugagguucaagggguuauaauuucuuuccuuuuuuuuuuuuucuuuaauuucugggauacaugugcagaacauacagguuuguuacguagguaugcgugugccaugguggucugcugcaccuaucaacccaucaucuagguuuuaagcccugcaugcauucgguauuuguccuaaugcucucccuccauuugccccccacuccccagcaggccccggugugugugguucuccucccugugugcauguauucucauuguucaccucccacuuaugagugagaacaugugguguuugguguucugguccuguguuaguuugcugagaaugauggcuuccagcuucauccaugucccugcaaaggacaugaacucauucuuuuuuauggcugcauacuauuccaugguguauaggugccacauuuucuuuauucagacacauguacacguauguuuauugcagcacuguuuacaauagcaaagacuuggaaccaaccugaaugcccaucaaagauagacuggauaauguuuaaaauauuuagcacauguuaucauuuaagucaucuugguggauccuuuccaaaaaaugacuugaaaggagaaaacguccuuuuggaguuuucccuugacaucagagaaggcacccugguccuuccuggugcgugaccguuguucuuguugcauaucuggggugugaacagggaggugaugugcgucuucuuggacagcauagucagaacggagcacugggguccuuugcguuuuuaugucuggugucaccacagaggacuccgugucgugugcgucacagacaggucgcacagauggacaaaugcugccuuaguguguuuccauccagugaaacaguucaugucuuagagcuucagcacaugugagguucagauuuuccuuuuuaaaguguuuaaacuuaaaguuuaaacuuaaacucacauuuuccuuuuuaaaguguuuaaacuuaaaguuuaaacuuaaacacuuuuaaguuuggauuacaacauguaugaaucaggaaauaaaauguuuccauguaaauuggcuuuauuuacaguagacuuuuccauuauuacauaaacauaaauuugccugccuuuucuuauucuccaugauaauuauucauagucuugaaacacauuuggaacacauuaauauggaaugggcacugagcccauggagaaggauuugcagugacuccacgagccaccuguugaccccugaggucuggcguugaccccugauguccagcguugaccccugacgucugacguuccugucuucuuggagucgugccgcaggugcacucugcacagucucaggaguggaacuggaaagggccuuauguagagcaaagagcauguggcuugaacuugaaccaagugugguucugccaagacccucuugggaugggcggacuuagagaggcuggggaugacaugauggcaugcaggggugguggcagaugagggagaggguagaaguggaggcagguggucucaugagacuguuuugucucuguuuaggggagcaugguucugccugugcuuagggaaacaugguucugucucugguuagugggucuugguccucucucuccgauuaggagguccugucucuggucaggggggcacaguccagucucugguuagggggugugguccugucucuaguuggggcacaauccugccuccaguuagggucuucuuuuuuuuuuuuuuuuuuuuuuuuuuuuuuuccccugagauagagucuugcucugucgcccaggcuggagugcaguggugcaaucuugacucacugcaaccucugucuccuggguucaagugauucuugugccucggacucccgagaagcugggauuacaggugcacaucaccacacucaagauaauuuuuguauuuuuuaguacaguugggguuucaccauguuggcuaggcuggucucaaauuccugaccucaggugauccauccgcuucggccucccaaagugcugggauuacaggcaugagccaccaugcccagccuuauuuagggucuuuaugcuagguguguguucacuugacuuguagcccacuggucaacaguuaaacuggagggaagagggcacagaaaaagcucauaaaguuuggaugggaagcugggaauguggagagauuauaagaugugcucacagcuucaucaaaggguagaauagacccugcagggaaugauaucuccucucagaccaugugguccaggaugucuuugagaaauuucuccuaucucaggcaugauaauaagugugguaguaauaauggcaccucuucacugagcaugcauuuacgugcuaugcacucuauaaugaacaggaagauucucauuuaauucucacagugcccugcagacagacaagaaacaguucaagaucccacagcuagcauggcagcacuuguuuccagccuggauuugguucccauguaugcugucagucccuucuauaagacacaggcacacgaugcugauggccgugguccacuucagaagucaucgaaaggacugagcugcuccuagaucccuguccugcuuagggagacagcuguucagggaaauaagcaccuuucuauuuucuaucaugucguauccaugguccaacucuaggaucuccuugcuagaagggccagaccacaagcuaggugcccauuuccugaagggcuugggaugcuccagcuuggaagaaccccuguguucuaaggaacccugaggaguuccucaggaagaagccuugcauguucuaagaagggggugugacagcgaggacccaugcuuggucuuauccagagccacauugauaucaagcauuuggcauaggggucuaagcacuguccgggaauggaagagguagaacaaacuucccaccuccagaaccauccuccacagcccugaucuucccaaacagaagccucaaagugggaagaggagagaggucuuaaacggacuccucccaauuccaccaucucuaagaucuguaaagaaguaaaaaaaauccuuggaguuucuuuuauaaaaugcagcugucuugaaaggacucucaaaaaaauucugaauaagcuauaaucauuuaaugagugaugacaacaucaagauguuuucaagaaggguguuugccacugaaaauucgaguuguuuagugggaccuuguaauccccaaccagccacgagcccccucucuggagucaacagagcagugugagugaaaugcuacccuguuuaggaugccugcccuugcucuuccaauuugcaucaaauguagauuugugcauuaacuuuuuaaagucguugcucugugaauuuagauuagaggaagaucaaggcaaaaaguaucccugacaagguggacaaaaaccuuaaucaguagaccuucuagaguggaaaaagaguagaaaauaguucauaggucuguuuuggguaggcuguuccauuccauuauaucuuagagauuucagccuuuauguguuacucauuuuugcuaaauauaguggaaauuauguaacuaugaaucagcuuaaaaauucuaaguaaucacugaaaaugaguuuuuaaaaauuaaagugauuaaaaagaacucugaaauuaauauacuuuacuuaaugauuuauuccaugauguugucaacaacaguacuagaaauguggccucuuuccaucggaauaaggcauuaacugggaaugugauuaugcccugacagcuucccccuauuaauguaaggaauagaaaacuggggaacuucacacuuaauuagauaaauugggauaugcaauauaaggcuuuucuuuaucugugggauuuuacaaaaacucgacuuugcagucaguuguauauuguuugcuuuaguugauuauauuugaaaugggugauuggaaugcgucucgugccuaggauaauaaugugcuaugauccgaaguauuacauccuuaagaaaaaaccaaaacaacucuauuuggcaguugcagaauuguagaccaugugaauaccuagcacaugcccagagacagaagcguugcaauaaccuugccacagaacaaaaaggucauuuuaucuuuacucugauguagucugaugcuguagaagcauggagugaaauacuuauuuuuauauuaagucagacuucaggauuuauuucagccuuccuuuuugagaagcuuucuaagcccucagcauuaagcagcauuuuuccucaucacacacggaucugagcaggugaccgcggcugggauaggugcuguuguguugugugcaggugggcuggccagccauuggguguguguuuuuccuagaguaagaagcacuccaggcugagaugagagcuguugaaaugaguaacauuuccgucuccugugauacgcgcugcuguugcuucuuucaaaugaucagauuuacauucuuuuaauggguccuuuaaaaauguaaucgagugagaaggacuucuaaacauuuuucuuuggccuggauacacacgaggggauuggaaauuacuaauucaugaaaaugaaaaugugggcuucuuuuaaggaaaaauucccuuugaacauugacagaagugggcauagggaaggggaagauuuugccuggauucuccacuuaacucuugucaccacuggagcauccugacucccuagacacaagugauggaaguuauuuuguuuccacucuaaacacugucucagggggacauugaugggaugguggaggguguguuucauugugacaacagcaucuuugguggggaauuugcuguuggugaaaacccagugcuuucucugagcaugggugauugauaagggccugacaugcuccuucauuuggaaaaugguauuaauagaauugguuucccagugaauagugccuuuuacccaagacucauaaccaaauauuuucacaaagauguuauauccccaugcaugagcauucauuuugagauguucauuauaauagaguuuaaguaugaauguguuuuaaaaaugauuuuaaaaucaucugcaaaaaaauguuguguuucaaauggacagugucuggguuuuguauagucaucauaaaaaugucuauaauuguacuguuugcuaauaaaccugccugcuuucagaaaaucauccuaacgugugugugugcaccaaugguuuuauaaguucauuuuucuuuggggcagcuacagcaauuuuagguuuguuuucauauuccugugacccugguauuuuuucaagguugguuacuagcuauggguuuacugcagaagaaguaaaaaccacauuguugaaugggcacaauaugcucugcaauccuuacauauucauaccaaacagcaaagauauuugcaaaaccagacugccuuaaguuaauuuuugcgcaacuuaaaaugaccuugucauugaccaaaauguauaggauccacuguagcaugaugacuuuaugccaguucaugaaauggauguucuuucugaucuuuguaccacagaguuguuuacuuucaguaaauaaaguggcugcacaugcagugccugcaaauaugcuagugauagaguuucuguaggucaaagaagacgugcuggugugggaagcagcugcugugaucuuuaggugacacugcugcagccaaacugcccugauucauaaugaaaucaacuuucacuugcugauaaaaaugcuaaggaaugaguccaccagugacagguuuucuaaacaggccaugguguuacuaacaccaugacauagaaaaguucaugccucuuucuuguuuccuuuucuugcugucuucuaggaaaggccaguauuugauggucugucuucacaguuuuaauuaagaguuguguaucuugguucugauaugcccaugugguuuccaaggaaaacaguguugcaggccauccuccuugugacuguuuauagguuggaguuggucugccugaggcugggccaugacugugacaccauuuacacccaguaguccagccacaucucagaucucuguggcuguagauaacuaacugccucucaggguacaugggaaaugcugccaacugccuaaguuguuuccaagguagcaagguuuucccauacuuugagccccuccccauuuaucuucugcuggagggucagagauugaaggagcagaugcaggacuacaggacuucugcuucuuggaagugaguugcacacuuguagagugacuggugggcacccuucauuguaucugggugucuguagaacaggaccuuugaggcagcaccaauaguuggcucagaaaugauuauagaaugagacagaacccucccucugucugcucugggcugugcauugggccuuccuucccuuucugcaugugucagaagaggaauccccuucuucucccugaagaacaugcgaugguagcaggagccuugagugucggucugcagugcccucucccuugcacauggacucugugguugcagauacugggaaaaagcauuguggccucuccucuccuaggccguccaggugaggcaaacaccagcccacgugugcagauggguuaguauuaggcuagugucagcaggagagguaggcgcucagccuaucucccacuagggaggggaagaagaaaggaaggaggcggcugaucccuugaggcuggggaugugcucaauggaagaucuagagagaagcuaccuccccugggccauggaggcaagauuuacaugccacaguguacuguggcaacacucaauguauuuagccauuucuucugagguuaagaauuaaaccucauauaccuccugcuaugagccugugugcauccuaaaaugccaccauguguuccgguggugaaacuccaugccagggugcauaggugggcaagcgucagucccuucccuccccaagccaggccagcucuggcuggugggucaggcccaggccuuacgaugcucuugucuucugcagaccggaugaaaugccuaucggcccaaacauucuuccuuuauuauuauuuucuuagauuacuuuuauguuccccaauuuuugaggccaugaaauaaguuuaauagccacauaaaacaucuuugauuuuuuuauuuaaaaauuaauaaagaacuuaacgacaaguauaauaauuuaaucucuauaugcaaugccauguguacaucuacauaagggaacccugugcguuuuaccuugcuuuuguaucagcguuuuuacuugaaucuuuccaagagaagaaucaccaucuguuagugacguguugcaauuaaacuaugaaaugauuuugacaauaguuuuucuauuuugaacacacuuuaauuuuuagggaugaauuaauuuaucuucagaaguuccuuuuugacucugaacauuuuaauuuuauuuuuuuuuggucuagacuggugugaaacagugacauuauuuuguguacuaggauguccucuuguuuagacagauuuguguuacuaauuagaaaacugcuaauacccuuauuucaauuuacugagauaguugggauucuuaaaacauaaggagagagaacuuguuggaaacauuuuuauaacuuuaguuaaaaacaguauaaaaaacaugaaacccauuuuuaaauauuuagucuacgugaaacaguuacacuuccuucauguuacaggaucaacuuccucauuguucuugcaccaaaauauuucucaguuccuuuuauugauauucagggauucgaacuucauauaguguuuccgcagaggaugugugugugcacauguguguuuuaaauuaaagcauacaacugcaguguuguuuggcccccgaagaauguuuacacgacauacucuucauuuuuuuuucaaggcccgaucugguuacugaucacuagguccuuguagaaucaaaacacuuagaacuaaaacagauuugcuguugagucaggaggaaaauacauggcaagaagcagcuccaaucugacaaaagcaggugagauccuuuuaccaagguuagccacuguguguuuggcaucuagucaaugaggugugcaugucagcacuccacuagaugugaaacugcuggacagaaacuucaagacuagguuuuccuguaugcucacaaacuauucaaaauuuaaguuguacaaaaaaaaaaaaaaaggcaaaguaagaucccuacuuccuauugugaaaaucaaaaaauugauagacaaagucauuaauagacuaggggauuugauuucuauaaaaagauacuugcaaaggugcaaagaaaugagugaaaaaauaaaggaacuaagauuuacauugcaauguguaaucaagagagaacucuaaguguuacuguugauuuaaaaaauaccuaaaaacauuugauucacagcuuuccccuaaguauguuguuuaguacaacuuacuaauagguuaaauguaggcgacauugucccuugguagcagcuaaacuaaacgcacuguuucucuuugagauggucagggcuuccaccauuaauacaaagcauaacgaauuguacauaacgucuggcugcacuuaccauggcuaacagugucucggaggaucgauccacaaaaacacugucugccauggcacagaaugccugugauuuauugguggguggauuauccaucguguaucucuauguauguucucagauucuugccagaauguauuauuuggccuuuggguaccaaaagauuaaaaaugagaucuaagaaaacuuaguguccaauagcucugacccugucuacuugcagugauuaaaggcauauccugacuuugggggacuccuggcugcuggccauuuggaaaaugagcaguaaacaugucguaagucuggagaugaagaggaugcuaaauuugaggugucguugugacacugagauguggucacuuggcuuagcgcuauagcacaugaaggcaaauauacauauagucacauuuuagagauuauucauggucuccgaccacuugaaaaaauugugcuuucuccggaauuugaugugcugaaaauugcacucgcccccugcuuauuugcaaaaugaaacauaaaaaugaaguccuucgcaaacauaaggcuugcuuuuucuucucauuauuuaaaaaaaaaaucaaggcuugaaaauaauuaugaguuauagcuguguacagggugacagccugccaucucgcagguugauaauguauuacuugcagaucgggggugggggaaaauuuuuacuuaucaucuuugacuacguaaguuucauuucagauuuuacaucccacaucagugaacugcaaagaacagcuggcaaggagugacacagaauaccuugcuucuguuaauuaucuauugguacaaaggccuuuuugguacgcagggcgagaagugggaggugccugaaugggcaccacaguucccucgauccuauucauuuuggaaaaguauugacuuaaacuccaguggguucuaaagacggccucgagacuccagacaccgugaguguuaaaggaaccagaguuuccaucuuccgugcuuuuuagauucaguuuuggauuuuugcuugggaguugaggaguaagucuccugagaguaaggcgaagguaugaccugaguuuccucaauaggguggaguuuucuuagaaccggcuggaguuugucuucuugcugcuuaaaauccagcuccacacuagaaaagagagagagugaagacuuuagcauuugaucuuuuccauaugaagaucccucuuagugucagcaagauuugggcaugaucaguguguguuuguaauguaauuuuaugguuuaauaauagcaauucgauauacuauguuuuagcucugugcucccgugaaauaguucaaggaggcucacuuccuuuggaaaauaacuuacuugcuucuguaggugaaucuuuaauauuguguuaaugugcacaguugguguauguauuuguggaaaugaaaaaugugaaauaugaauaaccccauuguuuguccacagucuguucacaugggccucauggaguaaaacagaaaaccaaaaguaugagugggcaggggucaccuuaguacaucuauaccaagugcacgcaagguccguuccugugcaauguaucacaagaucagagaaaucuauuucucugaucucccaccuaaaacaauucuggaaggaaaugaccuuggcugacauucuccuuguaaaagcuuaucugucugaaaaucugauaagggccauagugcccaacgcuggggaaaauaguguguucauggagucaacaccauugaacgguacuccgccauuacuaaccacaguuucuuugggagaagcguggggaguguucaguaaagacaacacagaaguaaaauuccaucacucaagccauggcgugcaagcacagagccaauguggaagcacauuugccaagcagugauaauguuugcauuagaagaugguguuaaagaugauuuuugaacuauguuauuucuuacagcauuucuccgaaaauugcugucaacuugucuagagcccucucgucuccaugucuuugaaaaggaccacauuugaucuucuaacuuggaguccuaacaggucugcuuggcagcugggauaggacccccgguccaugcaucguuuuucugugaugaucucugcauugaggaguucugcuucccuucccacucacccugucccuccuugggaccucugcguucugggccaggccuugggaggauuccgcucuguccuccuuccaugucuggucuggaugccagacuaaaugucaguagauuucaguaaaggcucagcguugaugauaaugcaugagcucauaacauuuuauaaccaguggaaccguaaaccauuuauaaacaugaaauccuauugauuuagagaaccauuaauccuagacaaauuuugacauuuuggaaagacagaaacagccaagcuauauuaucuggaguuuuaaaacaaguucaggacccaucuaaugggccauuucauguuuuaaauccacuguuccauuuuucucauugucagugacucuaauauuacucaaaaaauuaaaaaaaaaaauugccagagaaguuuauggcuagugaccuccugcucccaaaacaaguuauccuuuucccuuuuuucgaagagccucuuugaguuaugcucuaauuuauaggaaguagaauaaaaucucaugaauuuaagucuugcuaauccagacuacgugaugauggaggcauagucucuucuaaggacaguugugaaaagugcagucuaaggcugugcugcauuaaugaaauccgggccucaguuccgugauguggugcacuagaaggacaugggguuuccacccugccucuuccaccugaugcugguuugggagucgggggcuccuuaaacuucaauucuuucacuucaagggggagaaaauaguuccuucccaggcugucguaauuacugaauuguggugacaaucucuccccacugaaaaaugcccaugaacgagccuccuaaacuguaagaugcaauuuaaauauuauuguaccauuauuaucuauugaucacuaaucuuauaauggaaacaagagcuaaguaauaaagauaucuauuagggaucucuucaacuuggacauuuaacaaggaaaacaagagccugucaaucgagucugugaauauacgguauguuagguauagaagcguaauucuaccaaggugcuuugguaauauugaagguguguucuccagaucguaaccguuucaacagccccagauugguuuuggguuauuagaacagagagaaggcgcuagcaucuccuaggcuaacaguacaauuucggcuaccuguaauuauugaauucccauuaagcaacuacacugggaauccuguuauuaaccaauuuaucacaccaaggaaccauguaaucacagaguaaucuaaucugaguucuuguuaacaaaaugacucgacuuuaucugucgaguugauuccuguuugcacuccccauuaugcugcccugggaaucugcaaccagaggcagguuccuugguagagggcacuuaugagucugugagugcccacuuggaaacgccugccagcaaguugacccugagguccgccccccagcccaucuccccaucugucacaugugaguugcaguggaucugcgugugggaugacgcccgugcaccagccaggcaacgugugcagaggugugaaggaauaaugugcauuguucuggacacugcuuccugcucaaggacuuuucuuggggaagcacaccaagucucucgguugaguuugacacaccaagucucuggguugaguuugacacaccgagucucuggguugagucugaagcagaaaccugacuggaggaggcagcaucagaagguuaacggucuggccaacucuggcugacaucgaacaaaggucccuuuagucuuaauagcuaaauggaucaaaaggcagcaacaccugcucuucugguuagaguaguggacuuggagaaaagcugccgguagauguuccagggcacugggacugcccugcacacagaccucccucuguauuugagacagcggcuuguucagauagugccugggggccugccugguggagggcccauggcucuugcuucagcuuccccuuccugcugcccggcagaccuguggugggaguguugguugcccuaccuggggccacaucuuuguccggugcugccagcuucaugauuaucacuuucuccccaccugaaacgccuuucugggcucauggcauggcuggcauuccuuggcccacuguuucucagguccacauaaccuccuuguugucugaccaccuucccaaauguugcccaauccauccugucuuauuuguuuuugcacuaaccacagauaauuauucguucccauauuacuugccuucaucuuccuaaaugcaucuucucgaaugcaggcaccauaaucagagaugccaugcggucauccucuuucuguuuccagcaacuauagcaggggcuggguccuagcaguugccuacguaauauugcuagaauuaaugaaugagaacagagucuuaaaaggcaaauucuggccaggcacgguggcucaugccuguaauccuagcacuuugggaggccgaggugggcggaucacuugagaucaggaguucaagaccagucuggccaacauggugaaaccccaucuguacuaaaaauauaaaguuuagcugggugugauggugcaugucuguaaucccagcuacucgggagguggagguugcagugaguugagaucgugccacugcacuccacccugggugacagagugagacuuugucuuuaaaacaaaaaaaaaaaaaaagcaaauucuaccucacuuuuagucccaguugcccuggacugcuuuguuuuggccaaaaauuauguuguguccuccccuguguccucccacaaugagaccccuuccuugccacagacaaauagggcucugccuggaggcauugucagaaccacuccagauggagucuguggccugguucuauucuaucagaacuuaucgaagauccugaaacauuuucugcaagacauacuccaggaucuuuuuggagccuggcucccaugccacgguccccuccuuuccgucuucuaggauucuacaguaagaucuuggauagaauggguggggccagcagggucugcuugugagugaccagcuaccacagucgcugugcuaaggggagcgugagaguuacuuuguccccuuuucacuugccuguggacagcagguggaggucuagcuggauguuuucugggugauguuuguucugagcaccaucacggucccaggccaccagacgugcugugugcaccugcuuucccagggcggcuccagugcaggggcucauucuacagccacacgggcacgugggaagccggggcuccaaaccuuguugugguuucugaggacucuggcuguggcuuugcacaguccccuugcaaccucccaggccucacucuccagcagcucaggaggcaggaggcugcagguggugcugcugcccuccugcuggagggaucugguguuuguaaagcaugggcaggggaguguccaugucaugaggaauucuuacuccuggggaggagcagcagccuggaaaaaguccugauucuugagauucaaagcaugagucugaagcagcuggagccaggccagccuuaccugugcgggguguucuguccuauaaacaccugagucaaacacaggcuguagauuuugcugggugagaagggaagaucccuggauggcuggggauauugacaagacacgaauuccuggggacuguagggauuuaccuuuguagcccucucgcugccugcaccuccauucucccuccagauaagggaaccauccacccaaacacucugugcccuggggcugugucgcccucgcugugcucuuggcaagucccugugaugcaugauuaaagcaacugagaguagauuuaauuucuugguuggucuuucccuuuucaaaaugaaaguuuuaaguguggggacuuucuuacaacaugauuauucuguacauuuccaaagaaagaagaaucugcccuacaucucaggcugcucuccagccugcaccuaagcuuuauuuucuucccagagacugugcuaggcuuuguaguaacacuucuccccgcugccgcaugugauuuugcagagcggcauccuucuugcuucuccagcuuauucucuguuugucucaugcuccuauaaauacucaggcccugccacaguuucuuuagcaagcugucacugaauccucaagauaauuuaagaggaacacauuuuuaaaguugccuucugcagucguccauguguaacaguuaagaguuaaaagcaggacaaucuggugccccggagcuugcuuucuggaagggaagaaaacccuuugucuuuggggucucuagccucgacagggccauguggcucgguggccagcaggucagaggccucugccuuuaauucucuuugaauuagaucucagagucuuccccagugcuaaccguggcucugugcugacucaggcucuaccacuguggauaaaucaccucaccuuggggaccugagcuugcuuggcugugaagugauggcugagaugugcucccacuucucacagcagucuccuggaacaaggccugggcccaggagggcaggugcaccaggaugugggcuggcuuuuauuguguagcuuuggguaggaccagccauguccccaaagcacaacaauuuaugucaacugacauuggcgccaacuuggccgguuuuaugugagugccaugggcaacaccagcauuguccagaggaaacuaaaaguugggaucuggaucccaggccuggcucucccccuugcaugggaggugaauucaggcaaguccuuucugggccuugguuuauggaugugacccuggccaccucgccaggcaauagaagaaccaggaccccaaauauuuguuguucucuucugaacacaucuccgugugcauaucugaggggcacuggaaauccagcauguccagaaccagaucuuucccccagccugcaucucuguccuuccagacucagccugcagcccccauucaucucccuggaugacugcagacccuggaaucaagcucaacuugcuccuccugccucagcaucccugggucgaguggauuuacccucagaacacccgguguccuuccucuccgcccaccuuccacugcucuaguccagaacuccagcaguuuccuccuuggccauugaaacagcuuagucucccucacucucuguauucucucccucuccaguuaccagagucaccuuaggaaaacuggcaaacuccuucucaaaucccugcuuauccuucaaaaccuaggucacacgucacuccuucuuucuguggauuuucuagaauaacaaaguccacccuccccccugccucauccacacaccucugggaugaguuacugcucuggcagcauugucucuagguuuccaugagagccugucuccugugggaucguagcugucuucccccaggucugugaacucauugaaggauggaccauguuuaauucaucuuuugucugcagugcauuuagcacagugcuggcucugaaccugcucuauuuguuuguugaauuacaauaaacugaugaacugaaccaaauccccucacuucuaaucucagcaaagugcugccgcccuauuuucuguuuucauuuaaaauuuauacauuuguauaauucuauuuauucugucuauagaauuuguuauauacuauuucuauauuauauaccuacauuaaauauauauggaucucauccuaauaguuuaaaauaucagugguuuguaguuaacuggcuuuucaacacuuuaaauauagaaaugauucaccguaacuuuguauccuuccuuuaccacuauuuuacaugguaggugcauuaaucaauguuuaugguaucacuguagggcuucaaauaccagaauaaauggcuaauccaugauaguaacacucaaacuguaagaucuguccccuuuuccugguauacuaugaacaagaaauuaugauuauaguuuuuuuaaaaaagcauuagccagauauccuagcuguauauuuuacuaugaaggauccaaaguuagaguuagacgaugagcugagcuuuccaaaugcaucuuggauguuuuccgugaccauacuggagaacuugcuugacugaagcucauccuaggugcccaucuuaccuguggcacucucuggagugcaccugcggcucuggguccugagccucaucuaggugccugggucugagggcaggucagaugcacaggggucagagaaccuggcaucccauaaaauagugccaccgaggagcagaggcagacccaagucauuuggauugccucugcccaucguaaguucuccaugaggaaagacaccccaugacuaacagcaccgccacaugucuaugaagcauaucuuaugccaucccccuaggaagccaggaagacgagucaugauaaucagaggagucaguccuuucugagacguagccugcagaacacugcuguuccugaccucagugaagaacagccaguuuuccaacuuuugacagaaacuguguuauaacugccuugaaaaggagaugacacagggcuguuguccuccuguucuaagcugguugcugugagucccucguggccaacccaacccugagugggaucccaugacccagggccaucaccuugccugccugucuccuuuugaagaugggagugcgucugucuagagacaugggugacgucccgggcucccaguguuggugugaaggcuacaaagccacccugccucccugggccaccagcccggaacccugguuucuagauguggucaggagcucccacuccauccugauacccauugagagcaucaucuccacuaaacguagcagugauaguucucaucacacacggaaaccauuagcugcuugugugugucaucuggugucaccagugaccggucuaaacgucagccugugcauuccugcaggaggucccuucucaaacagguucuuucaagacgccuaucugugaggaagaaccugcccuggggaccccgcacccugaauucccuagucacucuauuccccauggaauuucauacgacccagcccuagacaucguggccaggacugcgucccguauuuacccccagaaaaaucuccauacucaucuaaacaugaauuaucuuuaucuucccaugaaacugacagcguaguccccucaugcuguuuuggacauugguaaaugccuccuuaacuuugaccuugggguauaaccaaaggcugggacuaucaguauaauuagccuuucucugcuaauaaauuuuaacuaauuguuucacaaauaauauguugagauggguaaucaguuuuaguuacaguuaauggcuguaacaaguuuccuagcaucuaaauaagagaauuaaggcauugcuaaacauuaguaaaaaugacuaaaccuaaauccguacauauucgagggacauaaauaauauauuuuuggauuucaaauagaaaagaaaaaacuuggauuauuagcuuugggaauuuucaagaagaauuuagagaucugucagaaucauucuuuuuuccugacuucauuaaacaaaaguauuuccuuaccccagaauaacauuguguauguaagguguuauccagggauuccuuucucucaucuuccuacccugucacucaccauaaauacuaagaacagagcacuaaacauuaggcaaaaggcgaauuucccccaccucaguucaugcugcuaaagaacuuaauaugcacaagugguggucauugaagcagggcuggaaagggcacuuccaugaagagauaaucgcugaaugacaaaggcugcagagacuccacuccaagugggcuccggacaggcuggaauuggcacggauucugcauacaaaugcaauuaccacucuuaacaauaggucuccauuagucaggaggugcccgguucugccggcugucuugaucgugcacuauccugaccagcuuucuuuuugcaauacacucggaaucagugaagugccagugugcgugauuuuaucuagaacucuuugcacccucuguuuuguggucuuauugguguuguaauacauuaccaagaaugaugugagaaaauacaacccaucacuuuugugaauucuucauucagucucauaauguuagauauuuuccucaucuuuccugaaauccuccagucauuuggggaaggaacuugccuucuuuuggagcuuccuacuugagaagccgucaaggauugugguggacugggauguucuccagccugucuaagggggaguguucacgggucgcgagguuucccauccauccuugggggugcccuggcuguuuguccuccuaguuccugccaguuguuccuaacgccguagccuggagggcucuagagaggccauccaaauccucccuaaccuggccucccuccacgauuaucuuguuuucuuuggagucugcuuugccaggucgggcacccuggcuuccuucaccuccuccucgccugccuuuuacguccuugcaccuguggcucucaccuuccauacagagggcucucucucgccagagcucuguccuuacccucaucccggggucccaggguaaggggcaugcauggaggugucuucagcagcuucacacuccucccagucucccagggccuggugcagaacuuguccuuaggaggucccuugaaaaacaccuguucaauuaauacccuuuaggaccccaaauggaaagggcuaaggcauuuuuaucaaagugguuguuuaaaauuccaccuguccuugucugggcacgguggcucaugccuguaauccuagcacuuugggaagucgaggcggguggaucaugaggucaggaguuugagaacagccuggccaauauggugaaaccccaucucuacuaaaaauacaaaaauuagccaggauuggcggugcgcgcacguagucccagcuacucgggaggcugaggcagaagaauugcuucaacccaggaggaggagggugcagugagccgagauugcaccacugcacuccagccugggcaacagagugagacucugucucaaaaaaaaaaaaaaaaaaaaaaaaaaaaauuccaccuguccuugaccaucauggaucauaucaaacagugaaagcauggaguacacagcaaugcguuucacaagcucccccucucugaugucagacaagugguguggagccuuguggcguucccauccagucagguuccaagcccacucauugauccacugcagaauuauuagugucacuugaggccacuuugugugguggcugugaugauccagaaaugaagcagacacagcgugcuccgggaggauguggucacucagggcuugcaacugaugguaggaauucuaccacuugacgagaagauucuaaauucugggagagaugcuguuuaaugaaucugagucagaauuccuguuauguuuuaaaucuugcuuucaucuccaaaagcccuuggauugcaguugguccauguuauuuucaugaaaauguacacauuagaauucaggccauuuugucgcaguacuauguuacaaauuaaccauuucagcgaaggagagaauggcugguuugccgaugauguuucauuguuccuuucugaaaccacauccgaacaaaagcugaaucauccguggugugacucaucagauuaguccgacaaaagaauuaccaaaauagggcuggagagaagaaauuucagcugcuuaugagcaaagauuauauuaguaauuuauccacaaaacauuuucugaaauaauuacggcauauuuugacaagaaauauggaagauaagccagaaaaguuuuccuaaagaaaacggaaacuggaaucucuuuuaaucuucuuucaugcugagaugguuuuaauuagaguagcacagucggucugcaucacaaccgaagggaugucugucaucuuagaaaaagauguagcugugucaaccaucucaaaauuugucagaaagaucacguuugguacuugggguuucaguggucuaggaggaagcccaucaauccucugccgaagaaguguuacucagcucugagucaauagauuugccaauaagggagagguguuuuucagcugaggaaugccuugugacucuccacacuuuuacccuucugugcagucucuugaaacccauaguuacaucccuugcauaauuguaaaaagcagcuccugggauuucagaucuggaagggaccuugaugaucccuuagugcaaccccagaggaccuggagacugaacagacaccccacccaagagagagggcagagaagcucagcccuaaccuugcagguacgcggcaggcucucacgggcugauguuucucaccuuucgcuugucguacuggugguuuuccccccgccuugaaauugcaucaagaccguuuguccuuuugaugcuuuucccuaguccucuauauuuccaugacagaauuauuuuucacagagaaauauguaccgccucccauggcaaagguacccauuuauuacaggccuguggugcuaaagccccaggcagccgggucuugaacacaguauccuuuucaucucccugggccaggcauuacuggaaacacgguggauagcuaugcugcucggagaggguaauuggguuucgagugaaaagugguguuuaaaugcaagacaggcagggucaaauucauuucccuccagggcuuuuggccuuccagaaagcaggguaugacauuacaaugugugaacacuggcagcugugauggccccacguguucucaagccucugggacaaccacagucaugugacauuuuaagauuuauuuugaaauuccuuuaagcuacccaaucccgggguguuccaggcaucccauggugcauauggagaaguggguuguaauggugguguagggacucacaggaaaguuccugaacucccggauucagguccuugcaacuaagagccaggcuuugaucugacagcaaggacuguaaccugagcuauacuuuccccugcugcuggaauuguguuucuacagauucauaugcaggaauucaaggaggacuuggcuguaaguuugcaugggagaacaagacauggauguagauuuguaaagccuuugaaauuuggagacacccucuggcucacuuggagucuauacuuccgagaugcuguggccacccauguacacugcuacugagucaccugaauaggugacuccuccugcccaaggaacucacuggguucugaacacuuuucuaccgaagaaacuucuauucuuaagcuucugacauuugggggugacucacagaacugaccgcaagcugcgaggucauccagcucaauccccauugcucacccuccccuuucucuuugcucagugggacccugagggaagugacccuguguaucagcaacucucagccaccagggcagaaucacacagaccagugcuugguagucagauaggauuacauaagcccucuuagcugaugugcuagauuaaccauauggcccuguccuuucacgacauaaguggugcacccaugaugcugggacccuuaacuaacuggcuucucugucuuuguccugugacucucuguccuuacuucucaagguucaugcuuaccaagaggaugcuagauuuguuccuggaccuguuuauacaauuaguacucacuauugaaaugaugugauuauugaaugucaugcaaaccacugaggcaugagaagauagucauugcuguggauucagugcuuuggaaagagugggguaccacaaaauauucaaugaaaaagguagagacaggucaaguauggauucagaaggauucugaucucagauucugccacaggacuuugcuccacuuuaaagacaggaaaauugguguggcucauggcagaucauuugaaacuguagugggggugccacauucaaagaaaacgucugggccucaccucuaaaggcugcccuaacuugaaaucauucaaaugggagauuucaauucaugcgauucaaauuaaaauaacauguuuaaguuagguacgugucaauuuuuuaugauuuccccauugauugauuuuucaauuaauggaccagaagugaacuuucacucccuuuaucaucucuuccugcagaccucagaaaacucuuauccaacauaauaaccaccuuaagaguaaucguuaaacuuuaauuauuuccauuauaacaugauagggaguuuaggaagcagcauuugaugagcuauguuccacuugguagucacagugcagucuuuauuugaauacuaguucauuucuugaguuucacacuaguuuauuucauugacaggacucaaugaaauaaagacuuugggaggcagcaggaguccagccgaaauauuacucugcagacuguccugggaccaaaagccuuccaguguaacuucuguuuguagcagaaguuuggcuguuguagggauguuuugucauugugaccacuccaaagggagugauuuuaaaaaucaggaaagaaagaucuaaaacuccacucuuccucaaacacuaccucuucuagaaugccucucccauuuauaagggggugacagucgggucugcaggcuaccgagggccacaucucuauucaguuucugaagaugccacccaaaucacccgucuguaaaaucacaucugcaguaaaaguucucgaugaguagucaugcauuuucccugcucguaugagauaaccagagcgaucacagugccucgcccucuaccuagugagucuuccuaagucuuggcaaauuccuguggugcuuggucacucgcaguucuucuagcaaguggaccaguggcugauguauucggauucauguagagugauguuugagccaguucaaaacagugaccacucgagucauuccugaaaggacagauuucuguccuucagagacuuauucagucacuuuuaaugucacuuuuuauaggagugaauucuggauuuagagcuaaguucauuuaaauuauuucaguuagguuaaacaguguucacauauauauauauauuuuuuuucgaucacccacagaauauuacguagguuuaggcugaacagcucauucucugaaccuacccuggaugucuugacucacuguugcuugguugcguuaaagacgguaugagcuuuagcuuccaaacuaacagaagcugaacucugaguacgugccaggucaucuacacucugcacuuccuaacguacugauguucacggagggucauuuuaugucaguguuacagcccuuuguuguugauucaaaauucucuuuugcaagaugaguggagugaaaaguuucccauuaagcaaacuucucugaucuguugcuaucauugaguuucuaauuuggaggaauuguugaagaaaagaccugcauggaugccucauuuuaaccuccucacuggcaauugccaagaacagucagcagcuuggcgugccaugccaggcugcugcaggggccccuccucccuuccugcugccaggaggccuuaccagcuugugugugccucuuacaacacucuaaggugggggugguuucaguaagguaggcuuucucaaccucagcacuauugacauuugggacuggauagcucuugguuguggggguugcccugugcaggcagcauaggaugucagcagcauuccuggccucuaccugcugcauaaccggcagcagcuccucaguuguggcaacugaaaacgucuccuuccagacuuugcaaauggcccauugguucagaaccucugagguuaaggaaugugcugauguggccuucggugccuaucucuaccugugguuucuucugccuccucccagacaaggucuccaggugacccagcuuugcuuuugcuuuuaaggaaccugggcccuaucugggaugcucugucuggaucggaggcauggacggccaggucuaggcuuucccuugggagagaacccugauggguugaagauuguguagccucaagccucuuugcucuccccaugucuguguucuuaaugcagaggacaguaacuuugaauaacuuuuuagaggguuuuuugguuugguaauuguuuuuugauaauuugguggaucacuaaaauuauucuccagucuaaacuuuagaaaaagaacuuacucauaacauuucucaccgcuuuuauauuuuguuugugaaaaauuacauuugcaaaaagaaaagaaaaaaggauagccauccuucugaagguuuugacuauaucuuaaaauccuaaauuacugaugcaggccaaacacagcuucuuccuguugggaguuucugcuguauucuuguugaugucagucauauaaacaaacuucaaauuaaaaaccacaaggaacagcuguaggggcucuggagcagggauucugcccggagacaggcaggcagcacaauccucgagaguucccaggaaaugaaauuccacauuuggugugagcagcccaggucuuuccaugguauuccuagcacauacggugugcuuucaagccuuugaucuauacccucugaagggccuauguuuuacagccuuuccagaacacagagcccagggcucacaccuaucgauuccaagggagcaagccaucaaacuuauaccaauucuugaaaccacuaagauacauuugcaagauaaauggguucaagcucuccuacaucccacgguucuauacuuggggugggguauuuagagguagcuuagaauuacagucaaguaagguccuucacuuuuugucugauagaaucaucccagcauggccccagaucguucuugcauuuguggguaaacaucauuugucacucauaauaagaaagugggaagaggagaauguuaacauaccuauagauaauacaugcacuguuccugcaugugucacaauuagcugugucuugccccguccgauaugaaagccuacaagauaagaacaggagagcauuacaagcgguggcugggggucacuggcuuuauagagcagaugccucaaaucaaaugccuucccaaugccaagcucaucauggucauggaaauugauuaaugcaugcuucccaguuugcuccugucucugcuuucguuguacaaaaccaaugcaacaccuacagcuaagaugauauuuaaauuaaauuuagaagugaacauaagcuccuggaugaaguaaauaauaugauuucguuauaagcacagggaaugugggauguuucaaugcagauuuaugguguuuuaaagaaacuuugaggaaaaaccaaccacauacacauaugcugacuccauggcuuauguuugcucuaccccaccuguccugcuacaacugggacuggcaaagugcggccugcaggccaaaucccgccggggccugguuuuguccagcaaacuaagaauggauuuuacauuuuuaagcacuugaaaaaaaauugaaagcauauaauauuugugacacauggaaaugauccgaaauucaaauuucaguguccaugaauaaaguuuuuacuuuugaaaauaaaauggugaaaauuuuuaugaaaauaccuauuucuaguauccucaauuuugccucuuggucugcaaaucccugaacauuuacucucuggcucuuuagagaagaaaaugccaagccuuauguuagaaugucuuacucccauugccauaacuucugaguuacuuucccuggcuuuauucucuggucaguucugucagaccccugaggccgggcagauuuuggccuuuguaggggagguugcuaauucuccccccuaauuaaaaaauuaauaauaaugaucuuggggucuuucuguaguauauuguugaagguuguauaaacauaaaggguugaugaugagaauuuucuggaccaggcuggaguugccuuggcuguuucuugguccagccacguaggaacagcuggggaguguuucaugccuucacaguuucuccuauuuuauccagccuuuccucucugacauuuuuaacaugcagauguguauuuucuggauauuauuuuguguccaggcacagacaugauaaccggaauguuaaauuuguggcaggagaaaagcucccaucugcauuagcuuauaaacacucugggggcaaauuuccacguacagagcuacucaccagaguaacagugugcacagaaggucuucugucaacauugcuagucaguacuuuuuauccccuuugcuguguaaacuucucugcaucauggguuuuaaauugaaaauaacuuuuguuuuccucauuauauugucuguuacaucaacauuugacaaaaggauugucugcuacaugccgugauugucucagugggcuugcaaaacucagacgugaccucaugguuaugugcaguuuguugaucaagugaccauauucugcuccaaaguguugccaggcacuuucugugauucaucauauuucagccagaauuggaauuacaguauggcugucucuaucgucuuuccaucaucaccucccacaugaggugccuuuggaaccccacagcaggccauuccguucucccguuggcuuugucaggagagagggggaugaacagccugugccuuauccccuccccuuguuccucaccagacacggugauuuuguaguccuuaccccuuuccuccucauggcaagccccaagaaugcauuccuccugcaccuucccaccuggcuccagauuuguccacccuauggcaaggcucuuccacaugaugacaucacccuucucccuucucucuugcccuauauagacuuacagccuuucuccaucagcuaauucuacuggagcucggcucuaagcucagugcugaccaaggucauuuugcacagugaagucagugccauccuugagcucaggugcuggcaauggcacgguccacgcugaauguguuguuaaacuguuggcuuggguggcagaugagguacugcucuacuauuguguugugcuaguggguauaagccagcagucaggagaaaguaccuaguacuugucuauaugugcuagucauauccaaauuuuagguucuuacagugggcgaaaccagggauauuuacaguuuucugaaggcacucuuuuugugcucauaggaaagugugaauucuaagcuuauagaaccuuccugcccuaaaccucaggggaaaugucuaucaagccucaucaacaucaacacuccuuccuugcccaguguccaaguuucccagugccucacuugcauuagagcccugagccuucuaauuaugcuagccccacuuacagaggagcauacagucacacuucagguccaggaucucauuauucuuaggccccaggcuucugaugcucccugucaccuugcuuguaugcuggggcugguguucugcaccacauguaauuggcagcuugggauaggcaaugaaccugacaaugagaggacaaaggcuucaggcaccugaaauguacaagaggaaucuuccaggaccuuggaguacuucaguaagaaauugcuuuucugaaucuuuucuucucuuuucuuuacuuuucuuuucucuuuuucuucuucuucuucuucuucuucuucuuuuuuuuuuuuuuuuuuuuuugagaccaaguuucgcucuuguugcccaggcuggagugcaaugggcacaaucugggcucaccacaaccuccgccuccuggguucaagcgauucuccugccucagccuaccgaguagcugggauuacaggcauacgccaccacucccggcuaauuuuguauuuuuaguagagacgggguuucucuauguuggucaggcuggucuugaacucccaaccucaagugaucuucccgccucggccucccaaaguguugggauuacaggcgugugccaccaugccuggcccgagauauugcucuucuaaagcccuuccugaaaagacuuuacugcagucacuuuguagaaagcacauauuccuccauuacggucaguaagcaaauaguuauuaaguacauacuaagugugaaacauuuuucuggcucuacaggagacauuugcgaauaagauggaguccuuguccucacaaagcucacaguggcgugggaguggcagaagggcaacauaaaugcauaaaugagcgaacgguuaauuuuugauacugcugaguguuaaggaaguguugugaagcaguauuuuggucuagaaugaacucuaaggaggugacauuuuuagugagaccuggaugguaaugaaaaagcagucagucaucuguugacccaggguuggauguugcaaacacaaagaccgucacguguuaacauccugcagugggaaugauguuccucuguuugcaagucagaaaaaaaggccagugcugcuggaauagaugcagcaggugagaguggggagagaugaggacauguguauaaaaugagaggcccuuugggcauuauuuuaaauugaaugggaagccacuauaguuuuucuuauaggugguugaaugacauggaaacacuucuugacuuuuacucucaauccucuccuucuauaacaucauuuucacucaauuuucuuucucuugcuucuuuuauuuacaacccagcccaauucaccaauuccugagaaaugguuuggcugacguuuguugguaagaaccaaaggagucauuguguuuucuuuggagacauaucuguggucauucuuuuuuuagcuaguugaaaacaguggguggucugucaguuucuaaauauauguauguuucucccaugugugagaauuauuuuuaggacuucauuaccaugaaggugagguuuuguuuaaguuuuguuugggaucuuucuuuuguuuaaaggaaucaguuguuuggaguccaugaaugucagcaggagauuaauuugugaauaaaauuuaaaguguugaccuugucaugugguuaauucacaggcagcugccagcagcuggugucaaucaggguaugccugcuaaaauuuuauuaagcacgagaguguucucaauagagggcuuaaaacuauguaauccauugugcuuacugcuuucauaauccaucuaauuguccuugaagcuuccaagcuguaggguuuggcuucacugauaauuuuauggucacauuaauaauugggcugcagcaucugaauauguucuccaaauagagaugaaacagauaaguuauuucuacaggacagggaacacagagugcuguuauggaauuucccuauuuuuuccuucucaacuuggaaacacaucagaaaacaguacuuugaaugauucucuauauugccauugccauaaggaagaacaaccuaaaaacuuuaaacugcuagagcagauucuucuccagugacaguagggcuggagaucuuuuguagauuagaaguuuagagaggagaaagcuuagguuauugauguaaaaccugcaguggaagaacauuuggaucacaaauuauaaauuuucugucuugcagauuaauugcuaccuuuguaaagcacucuucccuuuugcuuugaggagccuguauuauauauacauaggcuuguaacuccaugcgugauacaauaccugguaccuucugggcguucaguuaauguugauguagccaagucauagaguccauauuuguauuuucauaaguccagaauaacacacuuaccuauuuaaagaauuccaacugaguguggacaaaaacccugacagguauaaauugugaaaaguucuagucuucauuuuucuccccauaugaacuccuuugggugcuaaugauaagcauguucauuguagauauggauuuuguggcauucacuauguaucgucccauggcaguuaguuguaaguauucucuuaacaaugcauauagcuuggaaaacaucgcauucagcaccagggacaguguuaaaaguccaaggagcucucuuuuuuuggugcuuuuguuuucuguucuguugacccucuagccucccauccuucuagaacuggguuuuaucccagggaccaauuuggggacccuggaccucuccuugcuugaugccuuuugaacacuccuuggucaagguaggcuugccuguuagaggagccuggacaugaacuguuaauagggaagcuauaagaacauagacucugcgacagugcaugaaagagaaggugaugcucuguuagaaacagaagggaucuggacaagccaauucuacaaggugguuuuuguggaguccaguuuuugagucauuuacauuucuguuuuguagugaaccaccuuucuucacaggacuuugcucuacuuuaaagaaaggaaaauaaacuuggcuuacagaacacagcguggagcucuagucagggcuaccucucuguaauggccuggaccucucagguuuagcucagcaugcaguuccccaguuucucuagcuaccuuauaccuuuauaauaaucggcucuaauucuucaguuguuacuaucagcaauuccugaauguauaaauaaauauauauacuuguauacuuacaaguauauaacauaccugaauuuuuuuguguguaaauacacacacauacauaccuuuguaaauuuauuuucaaaaguagugacaauucggggcaugcaggucuucaguuaauccuuuuuggaccaauagcaaaagagggaauauaugcaccuuuguauauuuauuuuaaaaacuggugacaauuugggguauacguguuuucaguuauuccuuuuacggaccguuggcaaaagagggcaucacggguagacauuugaaaagaaacaaagaagggcaggcccauggcagagcuggugcugcaguuuuugugacaccacugcaggaaugauaaaggaggaggguggcugccggccucagccugagagccgcaccauggccacguccuggguggcagggacuccgaggagcagggcacgggagggcuggacggcaucugcucuuucaugcugacaccacagggagaucuaagucagcagggcccuggguguuaggaaggguguugagaaaugucagagaaagaucacugcaagcuuucuucccggccacauauccaagcucugcuuagugucuccgagaccuugaagauggggccugagaggcaggacuaacaacucugaggcaaucauaacaaaacaugaauuguuugguuaaaaggucaggaaagaaaaaaaaaaaaaagucucucacugugcugucauuagaagcaaagaccgagaaagugacaagcaucuccuagaggaaugguuagcaaguggaaacuaauuuuacaguaccuaauaguaauuacaguacuaguauuggguuauuggauugauguaaaugugcuguuuuuacugccauagucucacaacacuguuuccuucauaagaucuuaaauucucaauggaaaguucucuucucacauuccugggugacuggauggggcauuugugugugccuggucugguugcagaguucagcagcaugcugugggccccucccuggaagauguguucaguacucagugcaggggagggcaagugacccaguuguugauuugcugcucuuuuaaaugccuuguuaauuuucagccaguucagagcuucuagcaugucagggagcagcacguuggauagugcugaaaucaaagcaugaccuucuaaguguggucuucaaaauguucauuacauaggguauggcaauugucacacugaaucaauucagaggcuguauccuagguuuaccuguauggaccuuagcuagagauggugguuguugcagauauaaaaaaggcauggucucugcucucaaagaaaauguuuuugccguuaauuuauucucuuaaguuugaucucucuuguucuuucaguuuucuuacuggaugcaacaaccguuuuuuucuucugcauucuuacccagguuugugcacuagcugucucuucucgauaacuaagccaucauuuaugucagcaucuugaagggcuuuuucacuuaauagucucaaagugacauuaauuagaggcauaaaaugauaccaccacuauugcugggagaaauuaaguuucaaaaaguaguaaaggcacuguuuucagugauucccuccuauguuugagagccacucugagcaguagauuuggcuuguuucugaaucuaaggucucaccaggaguuugccagauuaugccccggacauguacuuauuuuagaugucagcuguuuacagcuaaaguggauuuagacuucaccauauacucauggaaacgcaaguacauugucuuagcauuugagcuguuaaaugcuagaauuugagggaacagccaauuuaugguugcuaaaagaauaugaaguugauuuucauaaccaacucccaggaucaccccuucauuagucaaaggcgguacuggcuuuuggugaugguuugucuguucccuuuuucccaguagcugauaggacccaucugucagccagcauccaacuugcugaagugaggcugagcaguuaugagauccuugcuggccuuggaucuccaaguagacaaaguaaguuguuagugguaaaaacugaaguugcaauuugaagagcacaaauugugacccuccauacuggcaaggcuguuuggaguacugccucuguucuccccugcuuuugggaugucgaacaggggugaguguugacaccucuccagcugcccggcugccaccuuuugagaguucugcuggagcagcuguucuuuacggauccuuuggcuggcucucccccacucuccucgccucugcuccauuuccucugccagaacaccugucuugccauguugucauggcaggcuaaucuuucuuuguucgccagucacagaggagauggcaagaaagaucuguggguacauggaaugaugaaugaaggaacaaaugaaaaaauauaauugagaaggugucuuugucucagaucuauggggguuggauugaccccuguuccagagaaacuuagcagcuuuuuccugacaguuaaguaaaacucuggaaaacugucucccauguuuucugcucaggacguugaugaugggacaggcagugucugugguagaguuacuuuaauauaaccaccacucauggguuucgagaacguuaaugcgauuugauauugucugauugguuucucuuuucuccagcucuuucgccugcagauauaugucaggugguaaagcugaucccauuagcucucaguauucuccauuugucuagaaugucuuucuggggaagggcaaauacuucuuuuucagacacccguguaaucucccugaauaugaacaugcauuuucuauaguguuucuuguauacaguugugucccaauugauuaguuuaagggagaucuauuuuugucaucccaugugagaacuuggaaguaauauaucucuaagaacaugauaguuagaucugauagcauucuaaugcugaaucuccauauagauuaaaggauuuugagggcuacccuggcaaccucaacacaaauuacuuagcaaugauguuuggagcacagcuaauucagaaguugaguugggucugucuucaucccauuucucuuuaccuuacuuuuuuuccaugguagggcaaaguucucagaaucacacacaucccauuccccuaaagccaggaaucgagauuuaaacccuggaaggaucaccuguacauguaaacuccauguggucucauuuaacaugucaggauaauuuucaacaagccuaguuauuucuacuuaguguucuaaucauagaccuuaauggacuuugcuacaaaggagccgacauaacgagccggccuccccaggccugccagucccaguucaucuggggcuugcugugugucagcacugugcauggccugugcuggggaacaguugcuuggaagaauaaaacacaggucucgcccccagacacuuaaaauccagaagaccuuuguuuccaaaaugaaggaauucuugauggguuaaggaagcagagucacagaacccugaacaguagcacuccuuccaugggacuguucuaacccgcaugcaaaccugcauccuugguccgggcccggcuucucucuucccuccggggcagcacagcacauccucagugcagcacucccagcaccuuguuuguggcucucuugcagaccaugccacuguggaaucugaugaucagaugcacuuucucuguccuaugggacugggcauuuugcuggcugggaacaugucuuuguuccucuucacaauccuagcugauagcuuggugacuucugcagaucggggcuugaggugcaucagcaaugccugguccuuucaugcccagugaaagucaguuuccuucccaccucucccucccucccugcuugagacuucuccgccacauuuaucgccauggaguauaccgggagcuguagcuauuucgcuuucccugucucccuccacgagaaggucaacacaaugugggcagagguuuuugucuguucccgggcgggcaaacuuucagugcccaccucagggccagaaguagaguagaugacugagaaauaucuuuugaauaaugcuugagugaaugaaugaaugagugaaugaaugaggagucugugugagugcccuuuugggugaacugauaacaugcccuuuugcuucugaaagggaaaauaggacucucacaauuuugugaugcgucugucuaaauaguauucauauuagcccauuuuaaauuuccucaaacaaguagaaaaaagaucagucgucuucugcuuccgacacccaguuuugaaaauaaauagcuuagucuugcaccuaaaccaggcccacuuccgugucuggauaaagccuuccuuuuuuuuuuuuuuuuuuugcccugaagcaauccugguggacguguuccaggaagaaacacccuuaaugaacucaguggcuuucuuucgaugguguggacaaauuaacuuuuauuggccucgcagcuccccagauguggugacacuauaauucuggggaggcucuggcuguuagggaaguuuuaaugcuuguuuucauuaucaagaauuaaaggguaacaaugcugguggaucguggcaaagcaucacaguuagcagggagauuccaaccuggguggcgucccaggggacgcaggggucagccgggcucccucuccucucuuucucccuuggcccuuugucuucccugucauuugccuccuuuuuuuuuuuuuuuuuuuuuuuuuuuuuuuuuuuuuuuuuugagacagaguccugcucugucacccaggcuggagugcagaggugcgaucugggcucacugcaaacuccaccucccagguucaagugauucuccucccucagccucuugagcagcugagauuacaggugcccgccaccacaccccacuaauuuuuguauuuuuguagacacgggauuucaccauguuggccaggcuggucucaaacuccugaccucaggugauccacccgccucggccucccagaguguugggauuacaggcgugagccacugcucccggcccugccuccuuguuuuuguugcuccucucuguagcccugucccagcaacuuguaugcuuccuuuuucacagagccaucaugcaugaugaagaaaauggaaugcaucaguauuuuauagacauuauuauugucagaaauacaugcagauuuggacagggacaaauacagagaugaacacuauuauuaaggcaggacuuuuuauuuuuuagcuuuagugccuuuuaaucauauuuucauaauauaaaaucauaacauaaauaucaggaaagcuaguaauuauuauuuuguguguggacugccuggcuauauuauaaacagggcaaagcuuacauuuuccuuccuucauucaugcagucagggaaauacuaaguugcaaaaugaugacaaugauacaaacaagucauuuggcccagaaggcaccaggagcagcuauuaauaaggaaaacaacuuuuuccagcugaggccgaguugauuaacuuauuuuccuggaggagagauaaagcuuaagcuauaauuuauugaaaauuaaugaaaaugaauuuugguggcacuggcuaucaaacuagaaugaaaauaagaaugugaguauacuguauuaaaccaaauuuuccuucaggacucccauauuucuucagcucuuguacugucacagagguucgaauuugaaagcauuaauguugucauuuuuugccagugguucugaugguaaauauccacagagucuuuuaucuuuaauuucuuuugauguguguuuuuagaucaagcuuaguuagcaauuuuuaaugagaacuuauacaucuuggagcuuuagugcuuuguuucaaaagccugaccuugcauuugcuuuuuaaacaaaugucucagagcucuuguugccaaagacuaaaaucuugaaauuuuggugugaucauuuauaaauuucuugauguccaguuaugagacuuugcuagggggauaaccuagugcuguaaccaaugacauacugauagaaaaaacuuuacugccuuuuugguugaaggaugcucguuguuagaucauuuuuucccccaggaucucaauuuucaugaauguucuuuccagccuaucuuuaagguuuauuuuuauauugcauugcaaacaaugcaguaucaaauguuuguuguucacauggauguggacaucaauaugaggaaggaagagccagacaggcaugugacgguccucugaaggaccacugauauuacaaauggccugugaacuggguucccaggcagguuccucaaggagagacguugcauccuggcacccagaucccuggacuuaaagaucaauggccuugauuugucugaaauuacuucacagagaggauuccuguuaaugauuacagauccuucccaauacacuuuauuuaugggacccucucaaugaggggaucucugcugucucuagcaccggaaagaugcuuucuccagaagaugaauuggcaugaacccuaccaggccugggaggguaggagcuucuguagccuuuucaaguaaaagggaaaauccagacuugcauuagcaaaaaaauuaaaaaauuuaaaaaaugccugcauuuucuuauuuauuuauuuauuuucugagacagagucucgcucuguagcguaggcuggagugcaggggcacaaucucggcucacugcaagcucugccucccgggcucacuccauucuccugccucagccccccaaguagcugggacuacaggugccugccaccacgcccagcuaauuuuuuuuauuuuuaguagagacaggguuucaccguguuaggcaggauggucucgaucuccugaccucgugauccacccaccucggccucccaaagugcugggauuacaggcgugagccaccgcgcccggcccaaaaaaaugccugcauuuucauuaguucauguugguuccccauuuucaggggagagagaagaugagugggccggucugacagcccagaugugaauucuggcauuaacaugucuuaccagcuuuuugaccuuggagaagguacugagcauauccaagcucuagcuuccucauggagggcauucccaccuuggauuguuacucuaaagauuaaagaagauaauaccaaauggcuggcacauuguaggugcccaaaauaggugaccucuguaggucaucuguauggggauucucauuucacuagaacgcucccucagcuccagugggaaauagagcucaaaccauuuuugcauagcuuagcaggaauugcauggaguuuuuaaaauuauuugaaaauuagaacuugcauuucauuuuuuuuuuaaauccaaauucugggacacaaauccauaaauuccauaaauguucaugccaugccuugaauugcucauuuuaucugcaaaugggcugucuggauugccuaguggcucgguggugaggcuuuuauucaccuaccaacuuaaaaggcugaggagguauuugaaaucuauuuuggcauucugcacaggaagauuauuuaaauuacauuuucauguaugugugauaccuacaugaagcccaaagcaagaauuugaaauguguuuuauauucuuucaaauauauuuugcuuuauuuuucauauuagagauggaaagccuuauuauuuuuuaagaacuuaaaaguaguguuuacaaaguuauauaaauauaagcuauaaaaaaggcuugcugugacccugugaauuaaaugaagaaaaugauagaaagaauaugaaaugugcuucccauuucaaaauuucaaagaaaugauaacuuauauuugggguuucgaacuugaauauucuauugcaaauaaauaaaagccauuaguuucaacagaaaaagaaaagaaaauggcuucccugaaaacaauucaaaggauugcaaccuugcaggacagagaccaacucuagcauuuguaguacugggagagauaaggaauugaugaagugucaagaggaaaaagaaaacagaacagugggaucauugcacacuuuuauugauggagaucugcagcgagguucccccccgccccgaaacuuuuaugaauauuauaaggcaguggcugaaauugugauguucucagacaucucuauagaauauguucuuggagcagaaaggagccucuagggccucuccucucauuuggaccauguuccuuucauaucaaaaaauguagcucagaggcuaggccagggugaacuaaaacaaaauccaggucuccugacgcuacaucagcuccccugcccgugacaccaaaugaacugguccuguccuuuucucuggaaaccaccaagacaaagcuucaugucuccauuuagugauccucaccaccaccccccauccccaaaauacaccacccuguaaaauaaagcaagaaaaucucuucccuguguucaagcuccuccccuggcuucaccucccugaaucuuagcacuuggaggguugcuucccaguagcaaaguaaccucaaagguaguaacuuacugagugcaaacauagccugaggacugagacccucuuuguccauaauucauuucaucuccaagagaagcccaagaggcagguauucucagcuguuuguuacagagaaaagcugagguccagagggguuaauaagccugugcacgcaggucaggagagggaaggucagcaucucaggaccugcagaguggagagccuggucaccccacccuaucccucuccugaaucucacucuggaaaaauggaagaaccaagugcaugggaggcugaccucagccagcuggcuggaaugauuuaaaauguuuuggguuaugauaaauguggagagagacaucgaaacugauuuaucaagaauauuagaaaaugaagugcugacauuuccaugccauucaaauagggagugcuaaggcacaggagagcauuuggcagcaacaaccuuuuugcuucugaucucagcucagcgcugcuuucucucugcugcucacaaugcccugcuuuucugugaugcaucuggccagagccagggaacacggcacucaguauuccagagaagagccacaagaucauuuucaggacugcagaggcuguugagagacugucuaaugucacccaccuccucuccucaaaauugggccauucucagcuaaccagguggaagacuuugaucucuauuaaguggguagguuuuggcaagaacaaccuaaucauccugcuagagagugcauagccaaauugggaugggaucaccucacugugcccagcuuuccccuuggcucuuggaggggugagccugggaagccaggaaaucagacucuaagcccacaccuucgugauuccucagcguuuaugcacagcugcugcagcggugcacaauuuuccauguggguucuuucugcucuguaacuuaaauaguccccuuaugcuuccucuguaauugugaugcaguauuuauucuguuugggcauugguaauuagagcaaauucagagauuucuuauccccugacaggucucucugauucugagugauuugucaauaugaggacauaagauacagcaaguauaucauuucuacccaucuagcaucaauauucuagguuaacgcaagucacaucacgcaaacauguucugugauggcuuuuuauuucugcugcugggagaaugagaccuuuuucauguuuccaagagaugcugucauauacauuauacauacauauuagguauaugugugucauacacacacagaguuccaaagcaggaccccagguuguaugggcugaugaacaauuaagcguauauuugaacagccugaaugccgaugaacugugaaccccucaaaggcugggcccgaauuccuuugacucucacauccccucauugccuggcacaguguccaucacuucagugauguuuggcagaaaccuucuaaaugugugaaugaaugauaggccggugugcuuggcagucacacaccuuggacugccugcacccauauucuggccugaacauuuuuagcuguaugaauauggucacuguauuuacaaaccauauaucaggaguccauaaccuauggcuuguggcccaaaucuggcuaccaccuguuuuuguaaauaaaguuuuauuggaacacaaguaugcccauucauacagauucucugugggugcuuucaggauacaauggcagaguugaaucauugugacaaagacuggcugucaauauguauuuacuauuuggcccuuugcagaaaaguuugcugaccucugccauguaggagcugacccugagccccugcaguaaacacagauguccaugagacuaaguccuuaccucuuaaguauguguaugugcacaugaccuuccauuacuuguuggcuauucauuguuuuugguaaaguugagcaaaccuugguacaggauaccacacuucgucuguauuaacucguuccaucccucagcucuuucuuccucucucccuugucuugaacaccaccguaagcggcacccucacagagccccugaacucaggggguuccuuuagcuucuuuuuuuaccacugugugcccgagacuugggagagcuggccucacaccaccaagaaaccacccuuucucaaugaggaugaacagaaccccugcugacagggaacugcccccaugaugggguggcagggaugaugggaggugauaaaugacuggguuugccacccuuccugcaagguacuagacucuuuggguugguguguuacuuaggauuuucuguuuuuaaucauacucuugccuuugcucugaauuaguaaagucacaaagccccgaagccucagggucuuaucacuaccugcuggucauguuuaagggccugggguccucuugcucucucccccuaccccaagccugcagguaacacccagcaaaugcugagggaggccuggcccauagaagaaucugcuucacucugggcagugacagauucugaucaugugcuugauauccucaaguaaagcuucucacgaucauuucuggucuucuccaaauagcagaguaucauuaggcugucaccagccaauggacacuucaagagacuaaauguuuggcguaggaaaucuaagaggcaaagagcgcugucgggguugccacacuguaguugcuggugaguuuacccaaugagccaccaagaccuacaccccauuggucugaggaucuccugcccaggaaucccauagcugcuacagugaauuagcacuguucuaauaauugauuggguuuuuuaaauccacugucccauuugccuuguucuuagccuucaaugacucccauuagugacuuauuuagguagccugugugacccugaacuuccccagaagacacaagcauaauacuaagagcucugaaauaagcaggauaauucuuggcauucaugcaagcccgcacugcauaaagcagagugauuuuagugaauugccccaguguuuuacaagggacuaaaaggcgugauuuugcauacuuuuugcacaucuaaccuacuugcagaauucaucccacugaaaugcucguaacaggauauguccuuuauucagcgccaacugugugcugguuauaagugggagcuuuguagauacuguauuucagugucuaccaccccuaguugauuucagacaaaauugaagcucacagagguuaaccugucucagccauaaacauucucugccgaagccauuuggaaaucuacauaagcaaaugaaaauaaugaaggagagucucuuacgaaaaauaauuuggaagcuacugagagcgguuguagccagugacacagaaauuccugcacagguuaagaacuacagggaagcacuugccugacaaacucaauagugaaaagaaguccuauuaaagagauuuuacaauaaacauguucuaagaaacauacauugcccagggccaucagcgggauucaaagaauacuggcuucccaaggagcaggcccaugaccccuuugggccaggucagaccuuaaguauaguguggaaaugugggggcaagauuugucacuuguauucaaacucaugggcuccgaggugccugcccucacuaggacucuucugaaugcagaugaaauucuguuggaagccccuguaugcuuuauugggguggcaaguggggagaggaacugacuuuccccagcuucaagaguguucuccagcuccugauuuguaggcuuuagaauauuuuccaagaaaaguuccauugauuuuauuuuuauuuuuuugagauggagucucgcucuguugcccaggcuggagugcaguggugugaucuuggcccacugcaaccuccaccucccggguucaagcaauucuccugccucagccucuggaggagcuaggauuacaggugcccgccaccacgcccgacuaauguuuguauuuuuuaguagagacgggauuucaccauguuggccagacuggucucaaacuccugaccucaagugauccacucgccuuggccucccaaagugcugggauuacaggcaugauccaccgugcccggccuccacugauauuuuaacuuggucauuugaguucauugucguaucauauaauaacuauguaucaguguacacagagugcauuuuccuguuuucuuuuuuuguuuguuuguuuuuuuaaaccaugagaugcaacuaaaauaccaacuucccaguucagaucugguacauaaaguaagcccugugaaucccucguucuaaaguccuagaacuugcccuucaagggauugguugggugcugaguggagcagaguguuacauuuuuaggauuucaugagauugaaauuggccacgguagcaguauuuacaccauggaaaucagcagaugcuacuucccuucccuccagagccuguuguuccagaugucccagcccagugcuggcugccacugcucacagcugucacuccugggacucugugcuguacccagggucugggaagggauggagaaugagcuugcaucuuaucugccugucucugaggcugcaguccucuccuauguucugacauggagaagacgggugggaaauuugaauuucagccaaauuaaugacccuggggcauugagcaagagggggccccauaagguggccuugaauuuuggagcccauaagguggcacuugauucuuugcuaucugaguccagagggcucugagagagaggaagugaauguucccaggaacacaacagagaccugccuuucuaccuuccaccgugagcuugugcuggcagcaacugaacuaggauugauuuuaaaguaaaaccauccuuugucuugauuuaaggugcccaaguccucagaugcuuaagaaccaggcacugugccauguucugggauaccggagugaaugacauuucgugaugauggaaauguuccguagcugcacugucuuauguauguggcuaucgagcauuugaaaugugacugcugugacugugaaguuucaauugucauugaguuugaauuucaauagccacgugcagcuaguggccacuguauuggauagagcagcuccagaguuucagggacagucuuguguggcagccugugugccgggcauauaggggaugcauucaucacauuggacgcccacaagaccacuaaguccuccccagaccccugcuccagcauugcuggccagcaagaucaacacucaugccacuaguggacaucuacccauucagacacaccugccacuaggcugaacacauuagaaggucaccccaugucauuccauccccugucugcaggacagacagugaucucaacuuacaggugaagaaagaaggcacagagacauacagcccuugcccaagcccucagugccagauuccuacccagacaugucuuaguaaacugagaaccacacugcuagauggauggcaucucagagaacccugaggaucuuauuuaaagcaaucuuccauacuuguucuaagaggaguguaagaaggcgcucccauauaucguacgguuuuccuuucuuguguucguggguguucagcccucucagguucuucuuugggcacacacuccugugaguaugcacauuaguguacauauuucauuuuacaccauuuggugaacuuuauuucaccaaagauguuggcaucuuucucuuuugcugucugguuuaauucacuaccaacuauaucaacaucagugacugggucaauguuugaccuuuuaauuuuuuugcaggaauguggacuacugaucaguaaaucacuggucucccccaccccacgccugaugaguguugcuuuuggaucuguacugauggaaaugggaugaaaauggagauguaaacccaagauugaacaaggccuuuuggaaauguuauaugguguuagauuaccuaugaaucuacuguuaagauuuuuguacauuuggcuggcaguucuuuuugcuuaagagcaucaagcuguagacaggccuccugcaccaagcuggagcagccagagcccagggcaggaccugccccagccucuccacugcuggagcugggccuuucaccucagccuccaccuuaaggcaggagguguuuccuccccauucuuugcagucagcaaacugucuaacucagccacagcaauccucuuaaggaaacuuugugcccaggugguuuucuguccuggaaauacauuacuuggcuuauuucaggcuggcuucuagcuugcuaaacccagggcucagggcucgcagagugaagggugcacaucacaugaggcaacagggcgcugccuccgauguuaccuccaguacacaggcuagcaggaacacagacacuuucaaggggcaaugggcaagagaggucucggcaauccaggcgaaguccgauaacccccagacccagaguagaacaggcugcuuuguaucagcugagcacaugccggccuguaggaggcuuccgcacuggggagcucaagaacuaaaaccccaccuuuaggucauuuguuuuuaaagaugcugcugcacaguuuaaacuucaaaacaugaagugcaagauggucuuaucaacgcaauaaaguauuggccgugaaguuaguaucauucuuucugcagccccacuggacacauagggcagcccguggggaagggcaucugucuccuaaucauauacagucaggacuggucucacaaugcccauugcuucuuuggguuccagguacagaauggaaaacacacugucuaugauguaaagccuuguacaguccugaauaccaauauuauuucaauuauuuauuauaagcaagucagcauuuacuuuuccaaaugucacaugaaauuuccuuucucuuccuaauacgauuccuaagaggccuguggccucuucucuuccugauucucuucuuauuuagaauagauauuuuggacuggcauauguuguuauacauuaucaauaucauaaaccuuuagcccuagcagaauaaaaggaaaggucuaucaauucauucuaagcauagguaugguuugaauucaaggccagaaagaugaacauuaaccagaaagcguaucgugcaggaugcagugacgucuaguaucauaaaauaaucugcgaccccuuggagcucgccacgcccuuagacuaugaccuguuuacggaaaugcuggcuuuagucucauuacagacuuggguuuggggcuacagauggacucuguggugaucagccugcauagcuuccuaagacaugggugaacauacauacccuucccgaugggccucuccuuuuuccaacuccugaaugacccccaagagcacuuugaugguuucuuggcuugaacugaucaaguucuccaucaucugaaguugugcuuugaggucgaccacuuccguaugaggcacgauucguuggcauucuucaccugcagcaaccgcugugggacuaggcugguuccccagccccggcggggugugagucugcgacggcugcucacuacauucgggggacaggcacugcaucgggggugagcaggccagggcaguuuccgagggcgccuggagcccguugagauguguggcucuccuccgcucgucaucugccgggcagagugaccacuggcuggcggcugcagagucugacaaaccaggcucgggggcccuggcacugagggcaggugcguaaacgguggcaaccuccguuuuaaacacccuccugagggcagguggagcgggcuccucggaguuuggccucccccgguccugcuuggcccucccgagcagcugguaaucgggcucuucggauggaggccgaguggaguuuuggagcgcagcuucuccauagcugagcggcuccgggcuuuuacagggcucugugcaguugacccccaaaggcugguccacuguguucauguguugguuggaauggaaaaccaaggcuguggucuugugcacccgccccgcgccacauggccgggccuccuccauggguccagccucguucuucucuuucgcaucuguuagaaacccauuguuuuggcuuuuaaagggaucugcagcugggaggcuuuugagguuccccuuuuugcgguccagagggaacgucugguaacacuucuuaaggucgggcgaggucugcacgccugugcucuuggugacguuggggauggaccugcgugcgggcacugucauguauuugcgguaggcugcucugcaggacacgggcuuggccucccgcuucucccccagcuggcccgaggacagcugugugucccucugcucauucugugccucgcagauauccuuaaaccgcaccugcagggcuuuguuccguuuuuuaaucugccgguugggguccagggcguauuucaucuccagggccaggcaggcggcggguuccacuucacucuccgacguugugaguaugcauuugccgguguccuuacugaccaugguuccugcauucagaaacagcaacagaggugucagugggacagaaauacacacucaagcaccggccgcacaaacuuuuagccaccacgacgacugccuguuuccuaauuauauuuaagcaggugaggucggccuuuauguuaaggaaaaucacacgggcugagagucgcuggcagcacagcuugaaaugcuucucagauauuaaagccugcuugcuuuuccaggugggauacacucgcuuuccuuuugacaguaaugcauguuuccccauuagacaaaccuguuuuacuacauucaucaagaaacccaaugaugcugccucuucugcuuugcaaauuaucuuuucacacgcgugacuccccuucuuaggcagaugguuuaccaagugcuacuuauuugguuugcguuuugacuauuuuuugaggaugacgucauuaaucuauugcuggaaucugggagagcugcuguuuuaaagacuuacuggagcugccacgucucgagcagauaaauguggagagcccuccgaggaggaacggaaagaaaucuauuugcgugagccguuauggauuccgggggagaguuggccgugcuccugggugggaaccgugaaggagaagucgucgagggguggucgcuucucauggguuaacaucagcucuaaaaggaacguggguuucccugcaucuacaaaggccauguuugcaacuccuuuuauuccauggagagugguacuggaaaauaauucuuaaaaaaaaaaauaaaagaaauuacucauucuagaaucaaguuuuguguugugaucacaaccuccgaaaaugaaaacaaugguggugguuucaguacuuaaauucugaaagcaaauaaaacuaugaggcuuuauguuaaucaugcaaauucauccugggcugaauuauuaaaugcagcuaaaaagaugcagguggccaaugacuccucucggggaauaccagugggguaaaaugccuucacuuuauuaggcggauucacagcuguuuauugcacauggaagaacuuauuugauggcugcgcuuaaagcaagaaaauagaguuaaguguguuguuugugagugaggcuucgccuuuuccccccuuguguuugagaagaaaacagucaaacggaaggcacugaggguguacggggcccgaguggcuggagcugagugcccagagaggcaaggucauggacaugggcccgugagagcugcacagaaacagacuucguccacauugcccccagcccagcugccgaccuugugcccuguccugggggugucugaaaaaccagcccagagaccuguggcagcacucauuggaaaaugccacaagaacuaugacaugcgcagcauggccacugcuucuggagugaggugguucgagugccagaugcucugcucguucacauacagaaugccuugcuuacaaauguuccugaaggucaaggcuacacuucccauuucaaggaggauacuaggguucagagauguugcgucauuuuucggugucacacaggaaauaagcagcgcaggcaggagcaggacccuacuuuaguggaccgcugaauccaugcuguucucauagacccagcuguccaacagacagaggcaugaccccuccccacauccuuagcccuuacugaguuagcaugacaggccgaggugcacggugguuccauaagggggaagaagagacaacuucacagccaccaucuaaaaguaagugacaugacuagcccucuauuaaaaugaccucuaugucucaggccagccuggucuugucaccuugcuggccuccacugcuguucacuggaugaaagagugaaggaaucaaauucuucauacauuaugcuaugaacaacuaacagguaaucauguguaagaacaacaaaaaacaaucucugcagcauuugauuuaggugggaccagaguuucuaaauccuggcacuacugguauuucaggauggaucauuugcuguuggaggggcuuugcugugcggugcaggguggucagcagucccuggcuucuccccacugaagaaguagcaccgcucccucccagugugacaacuagaaaugucuccagccauuaccagaugagccugggagcagagucuugccuggcagagaaccacugcauuagcccuugcaccucuggaugccucgggcucuuguucgauuauccuauaguguguccugaaaggugaggcuugcguagacagcaaaggaaguccuuggugcuuuacuaggugcuggggguauuuggagauugcugcaauuugaaacuugaaaaacugggcaguuuuagagaggagagaaaaggcaagaaacagacuggagaugcaccaauaucuuggccccguuugggauggcuagaugauagguggaaggagggacaaggcgugccugcucaggagaaagcaucgauggcuuuuagagauucuuaucccagcagguuaaacagaugcacacaagacagcuuggugugggggacaguauggguagcaguggggguggaauaagaaaauuaaaucuuaaccuucacucugaucuccuauucauucuuuaacugccuuuguuguccagguaugucagaauguauugugccaucauucugcagaagaccuucauacuagggaaaauuugaaagagagagcauuuuuacaaaaagcaauuuacuaguaauuuaucagccuuuucccugcuacuucugaaaaaugugugucugaauaaguuuguccugccaugcuauucaucaucaccauuugcuagggacugcacugaaauaauuuucuuacaucaguuggcugggguaagaaauauucuaggucuuggacgcaaccaucaaacuaauacaacaaaucagaagaauuaauugcugguggccaaauaauaauaaaaaauucuaagcucuucucuguuuuauagaggguugcugguacauaaaaaucauuucguuguuaguaaaaaaaugaugguaauacuuaggauuuuuaaucacuuuaguuuguuauugcugacuuaaaaaacaguaauaguaauugaguucuuauucucugauagggaaaacaccaaggaauuuuuguggcugguuuauuuuggcuucaaaugagguuaugaguucuuucugacggcuggaugacauuuucuaaagcuuuaaaauugaauuucuggacauuaagaauuacuaagguggacacaucuuuucgggguguucauuugcucuuuauuggggguggaggguaaggcuuacagugauuaccauuaagaaaaugauuuuguuaugaaaggaaauggggcauucuacagaggacuuucccuaagacaaguggaaccuucucccacacuauuucauucaucauuccuucaugcauuuauucagcaagugaauguacauacguuacaguguagcauuaacauucaguaagcaugcaguuaagugcuccuaugugcuaaucaaaugucaccauuccccuaugcauagcaguuguguuuucuagauuugauccucaucauauccuuacaaggcagccacuauugauacccucauacugcagauugagaaaccgaggcacacgauuuugggauuuuuugcaacuugcucagagugaggaggcuagugggccacacccauugaaacagcugaauccguuugaaucacaugcccuaacccacuaccccugcucaaggaacucuguaacuugaagugauccaugauaaacuugaaaacaucaaacaacugaaacucaucugagcaaugcccuugucuuguucccacaguguaucugggugcugguuaggcaaggacauccagguaguuccgguaacacaguggguguuggagcacugagugaauguugccuugaauucuggacugagcaugaagcugcaauaggauucuucaugauggcuugccuuggcugggucacccuagagaaccauggacucugguuuggggagcugaucucuuggcucuaaagcagcaggaguucauaaaguuuauuuuucguaagaaaauuguguuuuagaauucauuggacugugcugucuugaggugaaaauggcuagucaugguugugccuguuuggcucgagagagcuagaugucgaggagcuguuuggaauauaaaugucuuaauuacccucaaauuaaauuucauaaucaaagugagcuguaaauacauaaacccugcauuuuuagauuagugacggagaaccaucucugcaugcugcuuuaaauuaauggcugauaugaaaaugugcauuccaacuuaaauaagugaaaaauggaagcaacuuaauggcuaacaauagguaaacaguuaaguaaauuaugguuuacauucacucugggcggccauuaaaaggauaauuauagagauuauuuaguaucauagaaaaacacgaaauaauguuaagugaaacaaagcagucuacagauuauacuggaaaaaaaugaacaaaaacggucaucguugugguauuaagauagcacauucggagagauuuauuuuuccuucuguuuuccaauuuggggagaauggagggagguacagcgucguucugguuuugccaaugaaaauaacacaagguaaaaucuaauccacaccugaagcaggccucuggaaggcauaaccacuaguaucagaauaagaaaaacccagaaaugaugagauggggcuauaaguaauuugucaaaggucaucuuuuauuguuuugagggagcccugauaaagaaugaaaaugaauuucaaguguguauauguauguauauaugcauagguauauacgugccugcguauguauuuggcuauguauaguuaaauguuuagcagaagauaugucaauauuugagcaaacguacuguaaggaaggaaguuagcaucuguuuuaauuagaaauaaaacagacucaauagucugaaggcaauuuugugggguuccauuagcugccaagagaaacucuccauuggauucuguccauucuuaaaauguccgugcugauuugcagguuugcaguuugacccugugaugggauuugugggggaagaugcaggcagcugccagucugaccgagacaccucccagggcccagcagucuccgcauauaguaagauagcuaggcaagcagucagaggagugccacaagggauuguaugaaauuauggguuuuccuaguggcuuucucacuguucagacaccuuggagucaaagaugcugguggggauucaagaugaacugggucagcauuuucuuccauaugccaagggggugccugaacaugaggcuacucagaaugggagaauggugaaaaugaacaucccauucuucaccaccggcuuccaccggaaggggagguaaaauagaaccucacucacuaaaugaagucacucacauugugaaauaguuaacuuagagaccuguuucauaggugccaauugagucuucagaacuggaaguccucuuuuccuuggggcaaagccagcugccauagaugguggacugugucuuagauucauuauccgguuuaauuuucuuuauauagugaaauguuauuuuuucccuacauuuguuguuuucagcagaggucacugaugaggaccaaaaaggggugacuggaugaauucagacacccuugugugacugagcaaugcgugaggaacuguuuucuugcagaacuauggcuccuuggaggaaacacggagauggcacgccccguucccucgauguguagaauauugcagugaaaccucugucauuaagaacugaugaccaccuaguccaaagcagggaaaaggggcacucacagagguuaaauguaggcaucgaggcagaagaaaaccuaucuuagguucagcccccacucaugcauaucugcgguuuuagaaaacacucuuaacgaacaaaaaaaccuauggucaguugcuuuagccacauaauguaaaccacaaaggcucacacuggccuacuucggggagugagaacaaaggagggcaagcaugcaugcuuggggcuuggugcuuggugcucauguuuuaaaagaaccagggaauggcccucuuaaaugguccagacuuuuaauuuauguuucacuacccaguucuuugauuuucagcuuauguugauguuaaccuuugcucauccugcuacauucauagagaugaauuaccaaaauuuuaugauguuggugaaaaucaacuggaaaauaugccuccuugaaaugagacauuaugucaauguaaaaaaaguuuuauuugcagcaguuagcuaugccagcuaauaauggccaaaaggaguucaguacaguugguuccaacaacucaccaaaaucaccugugagauugguaaaaggaacuaauuucccugccucccuguuucccaucaucaugacagugacagagugugagacaggagggcugugcuuugaacacagcucaugaguaccuuuaguuacgauagcaggugucccacugacccuggaggcuuccuggugaugaagcaacaaucagcugguaguuuggggcccaucagaggcgggaguuggcaggacacagaagagguggucucccuuuuuuagacuuagugggaaucucacucacaugaaaacacaaagauacauacuagaauguacuuggggagugcuuugccuuccugauuauggugaaucuuuuuuuuuuuuuuuuuuuuuuuuuaacuaaacagcauguuuugacucaugauuuaucugaaacuaaaacuaggacauugauuuuuuccccccuaaaaaugacuuauaucaaaggagucuguuuucccugacacuucccagucuuauuugaggauacccuauugggacaaucagggcaggauaucugcuuggagguaauggucacuacaauggaagucauuuagaguugaagaugcagucugucuuucuggcaaggccaugggaaugcccaucaacucgaccaucagaauggaucccucuuguauuuucaucguaguaugaaaaugccacaauguuucuuugguuuggccaaauccuaaacuuugcauggucuucgguucacugcagagguagcugugccaggaagaaaaggagacuugagcauuucuuguaaugagcuucuauuccuaagcugauagccaaauguagagaaaauaaccugcacuugggguccauguacacaauccuaaccgaagucugcagaaagaguuagugcuuguaaucuucucggcccucauacaguuugcaguucauggccuagucugaaaagacugucuugguuugaaugagcuauucauugcaagugugcacagagcgaaauuuuagcauucauaacacaaaaugucauuuuuguuggggggcuggugaagagaaaauaaacaaaaggucuauauauuguauacuugaaacuguauauuuuauuccuuaaaaaucuaccucuuaucaauccugguguuacucugccagguuaguugguuguuuaauuuuucccuugaccagcagcuguugugaaccucugucuucucugugcaugauaauaaguagcuacuuuuuaaaaacaugaaaccauauccuucccucacaaaguuucaucuaaugucuucgaagguuuaucucuuugugcaugaaaaacuuggcagugucucugguaaucuggaggaggaggacucaguggucuuucuugggaagcagucugacaugauguaaugccugagacccaaggguggccuggacucaacccagcaacacagcuacugugcuuaccccagcugagcuuggagcaaaagacaccccauguuaaaggcaggacuggacuugguuugcauuggggucacgagacccaucuccaacuuaguagauucugucaguauuuuuaugcugaaggcuuccaacaagugcugccaacggcuugcucaauucauuccccccccagucuaaucccccaaaucagucgucaccaugcccuauucguuuuuguuuuuccuuccuguugcuucuccuacugauuucuucccuuuaguuccacacuguucccacccugaucuuggccuucauaacucuccugcccucagcucuccauucccccaugccccacccccgucccccauccugcagguccugcuagucuuggcuucaagugcacacgucgcuucucugugcauauaccuggauacaucccaguugguagcacuuccaaagagucucuuauuauaagaucaucuauacuuuuuccuaccugcucaucuuucuagauuucucuuggcuacucagaaaugcuccaucugcugacuuccauuaagccauuuccugcacugucuccugaacacaccauggucagucucuacuuugugucuucacuuccacugguucauuuuccaggaccgcgcccugguccuccuuccucauggauagucuguguuugguggucuagaucuagucuuaucuucuaugccuucuccaguccuuaccugucaccuucauuuacucacugaacagugcaugccuggggugaccuaggcaccauacuggaugcugggcacacaggaaaaaacaaggcauacucuuuggcagugucuaguccagcaggagagagacacguugaugccugacaccaguccacugugcacaagaccauguaagaggagggaaguacugagagugcucccuggggagucaggguaggcucuaccugggagaugugcaagagcaggccugaaggaugcucacuuugcuuugcuuugugucgguuuucucuccuuaacacaaauauaaguguucuguggaguaggucccucuaagucuuccuccuaugcucagucauccuucuuuacuuacugguuuaagaaucuuaacacuggccaggcacgguggcucaugccuguaaucccagcacuuugggaggcugagguggguggaucacaaggucaggagaucaagaccauccuggccaacauggugaaucccgucucuacuaaaaauacaaaaauuagcugggcguggugaugcgugccuguaaucccagcuacuugggaggcugaggcaggagaaucgcuugaaccagggagugggagguugcagugagccgagauugcaccacugcacuccagcaagagaaucuuaacacuauacaucacaguauccuuagagcugggaccuuagcugagauacagcaagaagacuuaggaugaguguacaauauuaauggcuuccaaggagucuuuuuacauuaucuggauccucacauuagguagaaccuggcuguauaaugaaacaugaguaggaauuagagaaguggaaaggagaagggauaguuuuguucguugagguaaaaccauauccagagaucuuuaucuucugaacuuuggcaugacuaccuugagugguuguuguacaaauguuuccggugcugaugggagagaaggagauggcacacacacucacaaaaaugaguagauggcacagaaaugguacagguucuauauuuaaccaugcaguauauuggggccccauacuguuguagaaaaugugacuugcuaggaauuaucagaagguuuguucuuauauuacucaacuuucuucuuggguacucccaagauaugguaguggcaaaauaaauugaguuuaauuaaaaaaucucaauagcuuggaauaacaacguuuuagagcauggcaccuuuccuaaacucaguugucuaaucugcucuagaggaugaaucacuggcuuucagagggaaaaaaacaauagagggucuggggcauacccaggguucuagugacuuccaaggguguauuaguccauucucacacugcuaugaagaaaugccugagacuggguuauuuauaaaggacagguguuuaacggacucuccguucugcauugcuggggaggccucaagaaacuuaaaaucauggcagaaggcaaaggagaagcaggcaccuucuucacaaggcugcaggacugaaugagcgcaagcaggggaaaugccagacacuagacaugguggugcgugccuguaaucccagcuacuugggaggcucuccuuaacacauccgauagacaaccaucagaucuccugcgauuucacucacaaucaugauaacagcaugggagaaaccgcccccccgcccccccccgauccaguuaccuccacccaguuccacccuugacacauggggauuauggagauuacaauuggaggugagauuuggguggggacagagagccaaaccguaucagaggggcauaaacauaugaaugaaauagcuuucauuuuccuguucuuuagacugagaacaaugaauauaaaauuauacuaaauaaggaagcgcaguacuuaggaaucucaugccacacugcuguuguccauugagaugaacguggagaggaaggagaagggcaauggggauguauaaagagagagagguuguuaggggaacggugagucgagagaaaugcacagacaaacagacacaugcacacacagauacaggaggggaaggggaugugugcuggaacauaaguccaggucagcugugggacaucugugggcuguuccuugaaucaggcacauagaguuuugauagccuucagccaugacucccagcguuuugguugcucuuaaagggccaguugcagcaaccccaucuccuguccagaagggaacgugacaauucaccccggggcaaaacaagagcccaggcucgggcaggcacccaaagcaggacaucauacaguuuccuguucuaugaagcacccaacacauaacacauuaaguguuaaacucaaugaagagucccauuuucagcaaauauuccugcguuugccucuaucuuuuuaucucuccagcaccuccuuggaacagaugcccugcuacuuuacaaggcuuguggaaaagagaaagagaacaguagcaaaagccuguguaguucaugaauagaaguuagcaucguagugaguaagcaguacugaugaucugugaaaugauucucuguggacuugagcaugcuaaaaagaucuugaaaaaggaaaacauaaaucuuuccaaaaccucacaugaccccuguaugcuuucgccuucuugaagcuuuggaggagagcauagguguggaugaaauggagucuuuuaaaaguuguuuugguuuuuguuuuuguguguggguuuuuaaagagagcauauccugccacguagaagaaaauccaggggguggcuguccuccuacaggaaggagguaaacaagcauuuuuccuuaagggcucuauucccucagccucgcucccucgaaggccacacuuggaggccaggaaguuaauccauuaaaaaacaaggagaagaaagagagaaagaaagaaagaaagagagaaagagagaaagaaagaaaagagagagaaaagcaagcaagcaagcaagcaaaagcaaaagcauauuggucucuaccccaguccagguaaaucagaacuucuggaggauggagacuggguuccacuguuuguuuuaaaugccuaauauaauuuuaauaaugcacauacgauaaagaaccacuggccuucuuccuuuaucuuuuucacccuuuguugucuucuauuuccugcuguaucuccaaagcuuagagaaguuuguggcauacaaaaaguacccagaaauauugacugaacgaagggcuuaaugaaugagugaaugucacgggggagcagggagguugagccccuuccauuuuuuucuagaaugaaccuggacaucagccagguguugggaugaucaccagcagaucccacacaggcccacagagugucugugcccuggccuggcugggcugugcugugcacaaacagaugggguggauucauguuccacagaggagagagcuaguggccaguuauugucauggaugaaaauccaggucuuucacaacauccauuaauuaugggauggcaaauuccaaguaaauugucacugagcagacccauaguaggaauagggcauauucacacuuuuuuuuauguauauauauuucugguuggagacgcaaaacauuuagaauucuguucccuucuagaaauuccauggcuuggggcagcucuuuucaaccauggaucugggguuugagaccagucauucguacauugacagucuuugcacagugaauaacucuggaauuucugcauuagagagggggugcucaaggucuucccaugcuaccaugguuugcuaacgugguuaauuucuggccguaguccuuacgaacuggggcuuugagaccaccugcuuggauuugaguucuggcccuuccccuccacuuaauagcccagaacucugggcaagugaucuaaccugggagagcaaagaucagaaaagguaacacuuguguauaacacucagcacaagcuagguaccguucugugcuuuguguaugucugaaccuuucauucuccaaacacccucugaaggagaaauuacuauuuguaauaaagauggggaaacagaggcacagguaguggagucacaugccaaaggucacacagauacuggcagagccaggagggcaaaggaggacagccuggccuggagccuguuaccgcaccaccacgcugcacuccacugugagcugggucagggcucagguggucggcuccuaggaagcgcucaguacacagcccuggugaugaaguggauguacacaaagacagcacaccuugggauguguugugcauguggaugacacuggaugcaggaccuacgagacacaagcuugagaaucaccaccagaagguuccaaccuugaguggcugauuaaaaacuguacgguugucuuagacuuauacuuuaaagcugcauuugcuaguggucacucucacugacucuucagauacaguuagaacugaugcuuccauguggaauuauuuuaaauaauuacuaggagugaguugggguccagucucugccacucacucaguaguugaccugcccagugcaguguggggccaacccugccagugagccugggcacucugucugaggcuccaguguccagccaccugcuaacuucugucauucagccucacccuggguguuuuugccacauggacaaaugugauagacacaauaaauaaaguagauauauauucagaauaaauauuauauagcaagacuaaaauauaaauagcaagugcaaaacaaauuaaaugaggauaugaaugacuucagugaagccacugagcuaacaacuaccuuuaaaacuaaaacaguaaguaauugagaaaugcaguuaucauugggcaagaagucaaaugaaaaauacgguuugaaagugaacagcauauuuucagcauuccuuuaaguucacacaguacguuugcacauggcacauuaucuaagcuaugggagucucaagugcacgguuaaguggacacugugcagugugauuuacgcaaggaaaaaaagacaaaaauaaucuuuaugcagcgcugucauugauuuuuaaaaugauaaauuggugggucuggcacagagaucaauggaguugaagucacgacgucaaauugagaugugagguuaaggcugagagacagacaucuccuucucucaugcuggcccgaugaacucuccaguuuuuuuggugagcucuggugaaaacucuuuuuaacccagaaugucagcauuuggguuauaagaacauuaauuuaucugacugcagugagauacauuuucucaauucuccuuauuugcuucuuuuacccuaauacuaggucaccaaauucaaagacauucuuucucuaaaaacucaacuucuacccaacugaauuuucaccaaaggaaucgcugagguugaguuuggugguaaagaacccaacccuuuggugcuuuuuucuuuucuaaacacugcauggccagacgucaguacuguucagcccuggaagccgucuuccucuuuacugccuucucacgguguuuccuuuaauuccugcuacacaaaaaguuacaaguggaaauggaagaaaacaauucuuucccaaucaggauucccugaguugguagcaaaaucacuggcuagguuuguguuaguagccucauuaaauauuuauuaagcaccuguuauagauacuacuaugcuuagucauuuaaggauuugcgcugugaaucgcuucauccaauuuccuccuauuucaaaguauuucuuguggacauucuaggacguaagagauaaugaaaaacuuauuuuuuaaauaauauuuccaguugaaaauucacacucaaauauuuaauagaaauccuaucuuccccccccccccccccccguuccugcuggcucccagauuucuguugccauuaaaaucccccaccgccuugcuggccuuggguagcaucuuuaaucccuucuuucuaucuugccacauuacaaagacuugucugccagaagguuuuacucauagcugcccccuaacuuacuucccagugcuacugagacuggcacauucucaucugugacaccuucucaacuggucuccaacuccucuccucugguuugccucuaguuauaccgccuuaaucuucugagaauauauguucuuguuucaaacaucaacagaggacccucuugcccugcugguuccuccucaaacugacuccagacuaugccuccacucucugauuccagcaccucaaccuuugcugaaugucacuucucacucuucccauacaagucuguagcccugagcacccuaccacuuggcuuaagcuccaggacuaaugucugcugggcucaggagugcaaucucaagcaucacccacgaagugagccggggcaucacucucugccuguaaucuccuauccugauucuaccugggagucuuuaggcuccugccacuuccuugccaccuccuccccuccuccuggacuugagcuucuuggaguccucucacuuggucuuguaacaccuuacacauugccuuggccacugcugcaacagcucaguacauauccacaaaucagaaguccucucugaacaaagccaucugcauauccaucuaccuucccuaugcuugccccauuuaaaaaucccagguuuuauaucuuugcugcauuuuuuaaggaugcuaaaaucacuuacuacaaaaauaagcagauuucacuguacaaaaugcagguaguaagagguaucuaaaauguaaccacuaaguacacauagaaaagauuuuuaaaaacaugaagaaggaccauugacaaauacaagauccuuccuagagaagaacaagggugggggaucucacaucaccaguggaaugaccuagaaacacaaagacugcucaauuucauuaagguuggcagugaauaggauauagccccaugcugcuuccucaacugaacagcuguaaaaaggcccucaugccaucagccugugcuuuuuccucuuucucucugggaugugccuguccauggaaccccugcuuugggauauagcugugaucaucucugcugagauggagugagagcaacuuuuauuugcaaggcugccuguaguauuuucagcauuccguagccuccuucccaugucucucauauguuguaguuuacugcauuucauuucauggccaaagcuagauuauuaagggcugaacuggaauuuuccauauuaaguagaauauaaacuucaacaagcauuuugauauggugggguuuucuuuuguuucuuuaccauucuauuggauagaauaguauaauucauaugaauguaugcugugcagagauguaagacucucuucuuuucuuuuuuugcucaaacuuccuaacagcaggauagugugguaaagagaacaugucuauggaugugcaauacuuugaauaaacaguucagugcucuauaaaauaaauauucacaaauaaugacuuuggggagaguuauuuccaaaucccuuugaaauauguuguuagccaaaagguuuauagaguaauuuagaaucauaauuccugcuugucccuaauaucugcuguucuacauucaaguuaauuuucucucagucccaauuagagcugggaauacauacucagcagaaagagacacauuugucagguuagaauguuuuguuuuuauucagguagugauuugucaucugauaacaucuuuauacaccucaaagucccucaacccauucauuaugguuugaauaaugucuaaagcacguacgacucaaaugcacacugaauauccugugacuuacaguagaggggucucugaaaggacuugaauuuggagccaggaaaugucucugaaguuaugguuuuucucaaugugagagguaagauccuugguugccuggagauaccuuaguuagugccuucaggaucugaaacagacacauuaucacacaugguccaaagguucaaaccuauccuuucauggcuuagugcuuaacacaagacauuguccaaacaacuuguuuacagcaauccugucagggucccuauaguuugguuccugcaagucuguauucuguccuuaauguauaagaacaauguacauuuuaaauaaacugauuaaaagucaugaaguuucacuacauauauaucauagguuagcuccaguauuggaauaaagacuucucucaauguuuguaugagaauuucaugguaaugaaagugucgucauguaguaucaaucauauuaaauuuugcuuuaaaauauugaagucaccccauaauguuaugaaauauuaaaaucaaauaugugagacaaaaaaggaucugcuucauaaaucaugccagcuaauuucugguuggggaauguaggucuccaaccaguggaaucaugguggggagggguuguggugcuucacauuuaugaaagacuguugaaaaugacgaugacacugguuuuaucuggggaguuuuuaugaccucacacucccagaaugacggugguuugccucaaguauguagaauuugccugccuucccaacugagcuucuuggaugcuauggacgcguugaacagcauccuucacaagcguuaaaauccguggugaaccugucacugcccuccuacguaaauaucugaccacagagcugcugcuuugggagguagcugugaucauuucuguaucaugagucucugagaagcauaagucaccugcuucucauauuccagaguucaguaguugucucuaaaugagauagccauggcugggcgcaaacaagagaauacaaaugucuacgugaacgggucuguccugccacuccacugcgauccguuguuauuucugagaaucauuuugauuuuuggacugcuuauuucaguguguaggagucuuccuuguagaugaaugccuuucacguacaagucuuucucuuauuuauugauuuauuuaaaaauuuuucccuacagagggagaaacaaaacacaaaaauucccuuuccugccacaggggaaaacaacuguggcaaaacagagaagcccccgaaguaaacagaguaauagaguacccagccucccauagagcuugcagaaaucucauugugcagacauggagcuucccagcuuuugccuuguuagccuauuucuuaaccaguaauucuguuucuuaauaggauaaagggccugacuuacaugaaagcucaaagucuuaaucacaaugauaaaauacaaagucguggcaacuguaauaaguuuaaagacauauguagcuuuucaaggacaucuugucuuuaaggaaaagucuuucauuuagcuaaagaaauuaaacugaauuguuuagucuuuuaaacaaaaugaugaauuuagugaagaaaacaaaacucuccauggcuaauguaauuuaugcaaaaucaugcaauuagugauagcugugcuagacuuuuucuuuuccuuaaccaaaugcgccucuaauaaaaccaucgugaggagcagugccaucuaauguaaguaguaaacauggauaguaaaugauuaauaucuggugaggcaugcagauggcaggacuuccauuuuuucuuugagcuccuugugcauguuugcuaaucauucuugcaaaaaaauugcaaagauaaauaugaacuuucaaaaguaacauucaacaggauaugaauguaagaaauaguacagugugggggaauaguaaaaaccagcacuuuccgccucugcauagugaaaugacgguaacuugcuguagcguaagcuuaauaaggguuauaucauuuucauguauguacuacucugggaauggcccgggucuugugagugguauuuuuucaucaaguacccagccagcgcagucacucugacaguccccccacugagauaaggcauggaaagguaacccucuagcaaguccucguugaggggggagcguucaagugcacagacgucuacccugugcuauccugagcuguagucuucugaaaugaucguuuggcuucccagccaaggcagggcucccccaaaguucauucccacucuugcaguuucaccucgggaugcuuccgcagaauuucagcgccuaagcagacaaggucaaaguaaaccgcuucaccgcugcuucuggcgcaggggcccagagcgcgugcagcuccccagcacagaccaacagcaggagagggguccgggcgggagcccugggcuguagauaagcaaaacgcacccauuuucucuccuauuuacuccagaggcaccucuccucccccacuccuggcaucucuuuaucacuggcucccucucccuguggcauauuuuuggguaguagaaugcugaggucacagggagcggcucuuuauccaagcaguggggacaucagccuggagcccugagcaugaaccagcaagaugcagacucucgcucuugacuuugggcuccaggagcugccccgaccccgggcugcccgcgggcucccuccucccuccugcccucgcccgccagcucgcagucucuuaggucugcagcguugguugguuucccacgccugucccggucugacucgggcugccaggcaccgggaagccccgcggcgccgaccccaacccgcagccccgggaaggugccaaccccagcgaguggaggagacgagcauuucacgugggcaucugccuucacugcugcucgcgccucuccucaacggccggcgucagggccccucuguuccaacucaucccccccccgaaguuaaucagccguacuuguacuuuccagggcgcuuuaguuuggaaaauacuuaaaagccucgaaaccuuccggggagacggccgcccccagaucucccaguuuugccuggcuagggcugucgggcgcucacgaagcuguggcgucugucuggaacccacaucgcagaggcgcagccccgcuccucccugacgucgccaaaguugccagacgccccucagcgacccggucgcgccagaugcaguugcauaaccuugccccccaccugcgaccgcaccggguccgcucccggcugcaccggggugucccggccccgggagccgccgaguuuccggccaagccgguuuggggccgagugugugcgcccgaaucggggucggcgcccgucccagcggugcucugcccgcggccaaguacgacgggcgcgggggcgcgggaggagggcacgcggggcuccgcuuaccuuccgcugcuuacagauaagucgaggucgaugcagcgccuggcucgggcaugucucgcugcggacccuggcaagccuggggcggcacggagcacuccggacagggcauccgcggccagacucgccgcgcucacgcggaggaagccucggcuccggggacuuggcccgcugcgcgccugcugcccgcccccuccaccgcugccggcccggcccugcuggcccggccggcccccgcgccgcagcucgcgucgcucgcgucccuccggccccgcuuagcgacgcgcgcggggaggcagcggcugggccagcuccggggacgcccgcgcgcucgcuugcucgcgacgcggcggagccagccacagccacccggcuucgcgcuccuccgauguccucauuuacugcaauugucuucggcgagaucucagagccagggccaggaggcgggggcggggcagaggagggagcaggagggaaguccuuuccgcugcuccaggucccagcuacuccgcggagccgggcggccagaggcgagggcgccccaagccgcgcgccugccgccugugcgcccggcuggcaccgaggcgggcggagccccgggccccgcggggcggagguggggcgggggcggcgcggggccgggccgggccgggccgcgugcguggggugggggauagggagggaguggaggagcccccucccgccgccgccagagcuggaggaggaggaggaagaggaggaggagguggaaggagcugccgccggcugccgccggcugccgccugcgcgcggggcuccgccacagcgcguccuccggguuucugggcugcaggcggcgcugcauggcccgggaacuuguugagucuacccuggagccgccuccggagcagcuggcgggcgggggacuccguguguucucucagggauggggggucgcuggggacccugcugcaugacugucugcugugccagccagccuggcccggcggggcuuugggaagccaggcuugaagggugcgugucuuguaggugccuggccgcucaccugcggaugcugccuuguagaagcaggaguucggggauccuuucagugcuggcuccaaccuggugucagccucucuacauggggacaggagguccuaugaguggccugaggacugaagugggagggccugccugguaauguugcaugcugacauuuagggacacuccagagcaggcgccacugccacuccuagccaggaacccuaccccccauccagagcacacaccacccgucagcagaagccacagggcgcagaggcugaguuccuuuguggcagaguagaauucucuugggagaggaaaagaccuaggaugcacacggagcuauccccgcccuuaauuucccacccaccaaagaguauuggguguuuugagcucagagcagcagacccaggggccccucugaugccugucaggcccuggggucugggccagggacuaagcagccagccgagugcagggcuccuggcccccuggauuugcuccuagaauguaauguaaaauguaaguagccacauuuauuagucuguuucucaggaaaggucagagaaguaguggaccccagggaagggacaggcuucggagaggaaauugggaggacaaauggaaagucccuucacccacccaccucuccagacacaucagugggcagugagaccucuuugccuauacaucccugagucucugcaccuagcaccagcucugugccugugaccaagccauagcuccauccuuguucgcugagcugaacugagccuaucacugccuuauagagugucuguuuuuuauaaaugacuuuauacgaaauaccuucuuuguauguggaugcuuugggcaguguguccagacauuucagaagaaaaaaaaaucuaaaaugucaucuauuucccucuuuaccccgcagcauccuuugguauacaauuuugccagccuuggggauccagauaugcccaggacgggaguccugagccuguggauccaaacucugcccaccucacucuucuuguuguucuucuuaacucagaucccccaagcugauuuuccagcuuaccagggaggcuguugggagcuggcuggaaagagaugcuuaauuuugugugagcaguauggaaacugcaguccccucuucugccuggaaggggccugggaagggaauguauaggaguuggggacguuuaaaaccagauaggagaaguugccacucuccagcauguucccuuggggaugugcuguugcagcugugggcuccaguaauuuucccaguggucuggggaacuucuguaaaucuuacuuuauuggcaauccauaaaauugaaaucugccuuccgucuuuuaaagugacuguaaauaaagcugccaggaaacuugggcauugggcugguaguaucagaaggcugaaguuuuccgggaccaagagugaaaacaggucaacauaaaugcaugcccagcaaggcagugcucagccacagguggcacugugaacuggcaagaaaacagcuccaaggacagugcuaucugagauucgcaugauguauaacuccaggaagaaaauggaaagccguaauuggcagguuagaaaauccacuuacaugaagaggagaguauaacggaauucuguagcaucaucaggacugcuuagaguuguucaauuguguaguagacuuacaguuguuuugcuaagucuauuaaaaucauuggcaucgcuucuuuuuuuuuuuuuugaaguaggaaaccauuuacauauuguagugcuuaagugcaugucuucagcaucacaaaucaaaauauuggugaaaacuugccucaccuuaccuuuggcucuggagagauauuccacaugggugaggugugugucaucaugcuccaggcuuuaaagcaagcaucaugcugggggcuggcuggagagaagggaguuucagccaucuuccugcccacagaucccucuugcauuuuuuuuuaauagaugggauguaggcauauuuuuagggucuagaaugagucaauaugcucggcuuccucaggaaaaaaaaaaagugaaacuugauagauucauuuuaggaaucaauugguauuggcuuuuuauauuuugcuuaagauuuuuguugaaaaagauagacuugcaaaggagaaaauagcuacuuuucaagugggauuuccuaaaagcagaggaauaaaaauaagggaaaguucaagacggcuaacuaagcaaaauauccacgucucucuucuuuugccuucuucuuggaauugugcagggguuguacagagaauugcuggaauuccaccccuaugguauagugaguuugaggucucaauuuccacauuaaaaagucaagaauauacaagucaaacauguucaagaauguucauaacagguuuaucuauaucuguuccaaacgggaaauaauccaaauaccagucaacaguagauaaagauuucuugguucuucguauaguggaauacuagacagcaacccaaaagcacuaacugcugaugcaugcuuuggcauggagggcuucuacaaaggugcagaacaaaggaagccagacgcccaguguuuaugacaugauucccuuuagaugaaguccaagaaugcgacaaaguuaucaaugguggaaaauaucagaauggggauuaccuuugaggcauacucguugcccgggaccacagcaacuucacuggugcuggaucauucugucuccugcacuaguugcuuaugcaguuuuccaccuauauagaaauucauggagaugcuuccugucucagugugaccucauuugucugagcaucaucacugugucauugcaauguccacaugcaugcuccccaauaacccuuaccccucagugaaccaguguaucugucagugugauuaaccuguauccucuccagugugcaaggcaggagaagagaaaagugucuccaaacuagcaacugcagaagaggagccuuccaguuuagcuacacagcagaacuuccuucuuuaggagacugccgaugaaacgccugcccucccaacuguccgaugucgcugugacagagcucgcuauggacgugaauuuuucuuucccaugucuuuguuacacaaaagcggucccgauccagaucccaagagaggguucccggaucucacacaagaaagaacacagggcgaguccacugugcaaagugaaaacaaguuuauuaagagaauaaaguagugaaagaacagcuacuccauagacagagugggacauucccaaaaguaagaggaggaaugcguccagccuagguacaauacucauauauauggggagcucugcucugcuacgaggguuugugauaaaggauuaaauuucuuaauuauuauauuuugcaagaaucgauauuaucuguuuucguuuuuguuuuuguuuuuguuuuggagacagaguuucguuuuguugcccaggcuagaguggcgugaugucaguuuacugcaaccuccaucucccauguucaagcaauucucgugccucagccuccugaguaaccuguaaccacgccuggcugauuuuuuguauuuuaguagaaaugagguuucaccauguugcccaggcuggucuccaacuccucagcucaggcaauccacccaucucagccucccaaagugcuaagauuacaggcgugagccacugcgcccgauauuauuaucuuuaaaguaaaauuaggaacgccuuuguucucaggaugucuggauauuaggacacucccaagucugggucuguuuaguaaacaucaccaguguguucccuuaaccuuaaacaucuagaggugaggaaugccuaacuuucuaagaaugcagcccaguaagucucagccucauuucucuaguccucacucaaaauggagucgcugugguucggaugccucugacaucugcauauuccaaagagacucauagaugagcccaaccuaagucugugaugggcagguuacacccgucaguucagaagcugugguagcagaucagccagugcucaacgccuacgagggaaaaguaacucauaucgccuucgaccuguagggucgagaucauucccuuggggacacuuuagccuugucuuucaagaacaagacagacacaauccucaaggugccccaguggggccuccuuuucugccgagaagcccugcaggaaggcuuucugcaucauuccccuugucauauucugcucgagccuucacucuccucuuucugggcuuauuucugguuuaagacucucgcuuuguguaaagccccuugcccguggcucuugcacgguccuggcagccgagccguguuuccuucuggugggaaccagagcuguuucugaggugcugguccauguuccagggccaugccacuccucuggcuuucuuuuccuuucaugguaagaaacuagagaugguuuauuggccugaaauacaaauuuguuuuggaaaaccugagcaucgugaggacucguugagaucccuggcuuucuaugaugcaucauugugaaucugauuuauccacagaaauggaagguuuuccuuuugaaagagagggaaguagcucuagguuuuuguuuuuuucuaaugcucccugcaacugaggcagugauguaugggaauaaggaagagcaggcgugcacucuggcucuccccucuccccucacaaucccucauuuucagggcucugagcaaaccccaaggcuuuccccucccaacugcagccucuccuuucuuuuaggcggacuccuggggaaugaaacagaaacccuuuauuuuguugaccuuuauuuggucagucuugggugcugguuucuauaggguuucuuacuaucccauucucgucacuggggagccaaccucuucagcacagguagauggcucaaugggcuugucuuaauccuugcugguaaggccaccagucucauugagccugcugaagccaccuucucauaaaguggcugacaugcccacagagagugacacuucugaucagaacuagggcaggaaggagccaggcacgguggcuuaugccuguaauccgagcauuuugggaggccaaggcgggcagauugcuugagcucaggaguucgagaccagccuggccacuauggugaaagcuugucucuacuaaaaauaggaaaauuagccaggcauaguggcucaugacuguaaucccagcuagucgguaagcugaggcaguagaaucacuugaaccugggaggugaagguugcagugagccaagaucgcgccauggcauuccagccugggugacagagcgagacucugucuccaaaaaaaaaaaaagaacuaggacaggaagggguaagaauggauuucacacuugaguuuccacccaccagcgcugugugcuggugcuggagcuacuggcugcccuucccaggccuucugccccggugcacaggaggcuuuucuuuagggagcugcugcagggaggccugcagucuucucccagcugggggguguaggaacuuccuuguuugcccuccauccccaccuuagguuccacaggcauggaagagggaugggguaaaggggaaggcaaggaacauggaagccuccuuguuguacuuuuuuccuuccccaagcccugacugaauaugagacuucgaugagaaugaugcuccgcuucgguugugcgccuccaggguggcagguacucgguccauuguggauuauauacuuugguucuuaccagauaacugggcacucaauacuguuaaacugucuccacagauguggaucagagaacguaaaugaucucuccaaggucacacagcuaggaagggguggagccuggauucaaauccaguucugucugaugcaaccagaggacagauucugaccaaaaaugccaacugcucaugccaggcucucaggaagcugaugcugcguccaggcuggcuggagaguagcuuugaccagcauucuuuugucgucauuagccgucccucauuaucucacuguauuaguuacacuuugaaauaaaaacaggcacugaaacagcaauauacucaaaucauuuugcauuucgauagcacucuaagcuuccccaauauaauuucagugauauucucacguuuucuucguugaauaacagcuauuaaaaugauucaucacaauauacguaucccaucuauaccacaagaggccacuucacacccuucuggugccauguauaauggcaucguauuaccauggccuuuugauuaucuugaacaccucuuuggugcugucauuugcugagauucagucauaguggacaggauauguguuuuuauuuuuuuuaaagaugacuaacacacugugcauauaauucuaauuaccuacccuugacauuuuaugcgcuuagugcaauaaauuauuuugcuaguuuggucuaagaauugacgaccugacuuuagauguauuuauuucgcagcguggcucaugggugaugugauaacaagcuaugaaacauuggaaagcaagcauuuuauucuuuaacaccaaguuccaaaugggaaaaguacagaauuaaaaauaaaaaaaucucuaguuauguuugaugaccucugaguuccuggaacugucaguuccauguuuuccguaaacguuuuuuuuuuuuuuuucauauuauugagucuuuggagaauuaaacagucuucgcuuuaauugcacugcacgguagggcugcggaucuccccguguccaauucaccuaauuuguguuuuggcacauucugcagcugugccauacucuaaaugugugugcaccccucacuucgggguucucauauauuaguccacuaacuaaaguuaaaguaaaaaaucaaaaacuuauuuuaagacauuucuuacacaauuuugauuuuuuuuuuuuuugagauucaaagaaaggcagggaauuuggcuuguaaauguugcuuaauguuuuuuucucuuuuuagaaacuccaguguccauaguuuaaagugaauauggcuagaauguuguacaaacgcuccuggcuucauccacaucccuguaucucggcagucacagcucccuggcaccuucucccccuugccuggacggaggcuucugagugaucuccuaggccuuccuagauugagaggggaaagggaagaucuuaagauuccagaauauucauuucauuuaagcgagggaggcaaauccuacagagcuuuuucccauuuguguucauuuauuggcuguuuccguggauucgagaaagaaacuugaaaaucuguuuuguuuuguuugguuugguuuugagauggagucucacucugucacccaggcuggagugcagugaugugauguuggcucacugcaaccucugccugccagguucaagcaauucuccugccucagccuccugaguagcugggauuacaggcaugcaccaccacacccagcuaaucuuuguauuuuuaguggacuuaggguuucaccauguuggccaggcuggucucgaacuccugaccucaagcaauccaccugccucagucucccaaagugcugggaucacuggcgugagccaccgugccugaccguuuuuuuaaaaaaaaauagagaugggcguuuggaaacugagucacucaaaaggugaaguagcuuugucccacagaucuguuacucaguacaaaguugaaaggaaaccuaaauucauuuuauuuguguuuccagugugcaucccagacauuuguuucagaauuuguuaaacauugaagaagaucaccuaggguugaguagguaagaaguaaauguggcuuugagaggccgugauagccgauacccucaauggcugcucuuggccuguuggacaagccauccuugcacaugacuugcuauccuaugacccgccuccagaucagucacccuccccauuugacuguggguggccuggcucuguuugaugaccaugagcaauaaaguuacccuuucauuaccaugccuugggcuaucugagcuggaugccccuaaguucuaauagaaaauaacauuuauugaugguuuuuuuuuucuucucugaacccaaauaugacaaugaggaaauuuauuuuaaagguacugauuuuuuccuuccccacagaguaaauauugucacauggaacugcugaugauacuucugagucccuuaaaauaagacuugugauucauucacaccaugaaaaugguagagaaccaacaucuucaccuucagauucauacguuauuggcucuuuccuuuuugguccguggguguuaaugaacauuuucacucuggagcuuucucugcuuccgacuccagcguggaugaaggagugcagcuucuggccugccugguucauccucugggucucucagcccugggauuuccacguuccaucucuguuguggugggcgaguugcaugaugcauucgauuugauauuuuacagaaccucuacugagaaaauaggguaagcagauuaaagcugaacucagacacguguuuggcaaccacccacucuugauggcguaaguggauggaggcagguggccacagcaaacaccauguggcuuuacgaagaaauguuccucuuccauacguuaggccuguguaaaguuccuuguuggacuuuugcuucuucgaugacaauacauauuuuguuaguauuuaaaggacauuuuuaaacauugcugaagugcaaucagcuuaaauugcgauucauaugacaaguguugaaacagggugauguuugccaugaaauuuaaauaagcuccguuaaagcagaaaugucuauauaccauguaagacacaauggucucccauagccuuccccuguucuuuacuucuugacaagcaugaauagucucucuguuugaauacagaguagagucaguuauuuuaaaagaguuaucaucuauggguauaaugcacuuuaagcaaacucuuuacaugcaaguaugacuuaucaacaaguaaaccuuaccaaauaaaugcucauuuugauuaaggcuaccuucagauaaccacuguuuaucaugcacuuagagggauucaguuuuccaaaauaauuuaaaaggugacuuuuuagaacaucaucuauuacauugucaucuaccauauauucuucuucucuuuuuuuuuuuuuuuuuuuuuuuuugugacagagucucacucuguugcccaggcuauagugcaguggugcaagcucagcucacugcaaccuccaccucccaaacucaagcaauucuggugccucagccucccgaguagcuggaauuacaggcacccgccaccaugcccagcuaauuuuuguauuuuuaguagagacaggguuuugccauguuggccaggcuggucucaaacucgugaccucaagugaucugcccaccucggccucccaaagugcugggauuaaaggcgugagccaccgcgcccggccuacuguauauucuuauauauacauguguauaagaauaugcauuuacuuaauacgcuaucaauguacagaauuguuuguuguggauuucugcacauguuccuuggguaagagagucuugaugugauuugcgcugugagagcagaacuuaggugcucuauguucuccaaagucccccuccaccuccuggauggcauuuauucaguagaauccgagcucaauaaauaaagaaccucguguacuucccaaagagccagacacuguguuagcugcuuuauacauacaucucuuaauuuucauuuuuugacaacauuaugaacuaugaaauauugauaggacaugaaaaaucaagagcuggucuuacggaauagugcaggauuccuucccugcuccauuuuucaaagcuuugcuccauuggaacuuaacaaugugcugucuuucaguacgucugaaggucuuuuucaauuuaaaucaguuuauuccuguuuuuaccauauccagcucccugcuacuccuaauauaaacagacuuaguggccuauuaaguauuuuacuucuaaugcuuuugaguuuuuucuuggcaguggagguguaaucucucccaaaaccugccugcacuucacagagaauaggaccgcaauugccagaagaaacugaaccuuuaugggggaaaaagaaaaauacagccuucccucauucuccagucuuaauugagcuaacucaauuuaugccaaccaguucuugcuggucauaguucuagagcuuuaugagaauuaaauccugaucucaccuuaauccuccuaaaaucuccgugaaacugggcacuguuaucagcaccauugugaaaugaggcagcaaguacagggcggucccuaaaugugacuaagucaggaaucuuauguagaaagcuuacaaggaaguuggggggugauuaggaauugucuccagaaauaccagauaaacaguucaaauuuuagugaagcaaaagauaggcauauuuuggccuuguuuaacuuguaccugaauguaccaauaacacuuuuggaagacuuggacguacucuuccucuuuucccaggaaaaugggagaguauucauuccuguacauauugagaacauggacaauucucacauuuuaggauugucuuaauaggcaacugacuuuauuaucuacguguugauugaaagaauagcucauagcagguguuaaaaguuuuuccuaaagagcuacauuauaaauauuuuggacuuugaaggccauaacaucguaacauuucaaaggucaugaaaacccagcucugcuggugaagcagggaagcagcuguagagaauauguagacaaaugggcaacuacugaguuccaacaaaacuuuauuuacaaaaccaggaggugggccagauuugguccacaggcuauaguuuuaugaccccuggcuuauagcauaaguuguuggacagaauuuugauaccauauguagacccaaauuuuaagaaugaauugaugcguuugauugaucacaggagaauucaguguuuuuccccuuugcuucuuacauacgcuagauuguaggcucacccggccuccucugcgauuugggcagaauuagagcaguauauccuaucaagaauuacuucuggcaggggauauggugaaggggccauucaucuguuaguauuugaguaagaaacaguuccauacaaacaauugggaauaguaaugucuuugucauugugaaacggaagaauuuugcugucuuaguuaugggaaugcuccaguuaugggaacuaaagugcaguaauugcuuuaaauggacggucauauauguuuggcuccuuaguccaauaauuuuauucaccacguuccccugagagaagacuugacaagacaauccuggacagucagcauuggauuuucaucuccagcugauugauuuaguauuucaugcaacccaauggaguaucuuugcuguaggguuuuaauacuggagcuauuaugaugacugauguaauuuaguuuccuguauugaugguuuccaaacaauugagaugaauaguuaaguuucuauaauuguucucuguaaccauaugaaaaaugauuauauauuagcuuaacaugaguuuuuucacuaaaauaaaaaucaauaaucaguugguuauccuuuugaauauuauauuuaaugccucagauuugaauauuaucaggaagccaagauuucaagaccccguuucauuuuuuuaaaaacaugacaaaaugugacauagugaacauugagaucacugagcuucauuguggauuagcaccccacuuucaaauuugucaacacgauaucaucuguuagaugauaucuaacguugagauguucucuaagauaauaacguugagauauucucuaaagaccuaggauaaaguucuaauuuaauuuccuauugcaguauuuuuguguugccugucauuaagacuguggagcuuccuuauuaauuaaauuuaguucacuguguauauugcuaccacuuaccaaguggucguuaauacagccucucuuaggugauggcuuuuuguuuaccuagcgaugaaaagcuuaaccuacacugcauuuuuuucauguguguuuaaccgaaggaaacaucuuugaauuuaucuucucacugcauaacuggaaacacugaaauuuauuugaugauccagaaucaguuccuugguuuuuaacuuuauuuccauccacaacaaguggcagcuuugagaagguuucaguucuuuacacugagauuccaguggaugagucugaauguuuaacucccagaaguuaggagaagauugagcuugcuuuuggaguuuaagaaugaaaaugcaagugcaugugccuauuuuagggccuaaguuggauuuucauaaaauaaagcaaaaucugaggucacccugugugggaaaaccucauccgagacuggagauugaaaauaggagcaagggccagaaguagccgccuggagagcagagcuaaggacuggguggugccuguguguccuuugggcaccuggugacuuucaggacaucauagacgcaagggugagggcccaucucauccuuacugucagaggcaacaguacagcccugggguguauuucacauuauaccacuagagcugggugcuuaaagggcaucaucaaauccauuuuucuuaccuugaguggaggugccuuucauuuguaaaugauggauuugaaaaacggacaaguagugaaaaugcaggaaaaugauucacaucaguaggugcuccagcagauguggaguaaaaaucaacaugucccacaaaugggcaauuaaagguuacacauagaauuuauggaaagaacuuuggagugucccagggauugcaaaggugguuauaaaugcaugugcucaccucuuccuguuagcacacacaccuaaauacgcagaaucucucagcagagacauuccguugagagccuacuuaauaaaccucauuuuaauuuuauucaccuuaguaaggcugcaggaguugguaagucccguggacuuggagacuuagguuaaggaauuccaaacuugacugcuaggcugcugguacaaaucaucuuucucucuuucuagucaccuggauacauuaugaugcgaugccagacuuccccaaaaccccaaucaagaaauaagaaaagauuuuucuccauuuccugguucccucacagugagaaugagauuuuuuaugaagucuuacauuuggugguuauuggcccauuaccuauggaaaccacuguaaagaccucacagugcugccaucagcaugcgcucuggacuucggcggugccacauaagguggccccagugcucaucccaggaagaauggccccugcuugucucggcaaaugacucccacggaagcuguggagagccacgaagguggcaggcggcauuagaggggcuguaaagggaccgaugccugagaauuucuucugcaggauguagaaccgugugcauuuggaugauaaugcagucagaggagggcuuccugugauuacgguggaauaacucucaggcugagcccgggaaaccaggaaaugcacgucuaccaggagccgaagcagagggguuucuuuuucccucuugcucugucucguugaaccuugguucuucuaucugucccugaguccugccucugagccacugccuguucccuggguggcuccagccauggacugcaugggugccaggcacauagcuggugacucugccccucuggugagugcagcauggccucugcucucucccccugccucuuuuuguuuuccuuuucugaggguuccucagccucaugaaguuuaaagccuaaugcagauccucucccuccgcugcauuguucuaggugucacugaauuucuccaaagagaaaaauaaaaacucagaauauucuugugacugauuucugaaugugacacguggcguaaugacuuaaacguauuacagccagcagcucuugguauaggacccaugauauuuuauuauauuuuguuuagcauuuuguuguacuuuauuauuuuauugucuuuguuuuauuuagaacacuuuauauccacccuuuucacagaguuuuaaauguacguuacgguacuguuaacucuggguacgauguugugcagcagaugucuagaacuuacucaucuuguggaagugaaacuguacaauugugucugugauccuucuuaaagccuuagcugggcugcugaguccugcacucuaacugcaggaagggcagcuaaggaaagccaagugcaacuugccagacagaugggauuuucaugucucaucuaucaggcaagacauugucucaguguacucagcagacuccuagacucggguucugggcugaugcugucagacaucauaaaaggagagacacuccucucagccaugcuccuaauaccccugauaagcaugcuccuaauucaucuacugcccuuagcaaagcugccguuugugucuccgauuuggugucuuuauagacaucgccauccccuguuagugaauuuggggucuugagacgucaucugaugaggaccugcuguuucacagaggaaauauaacugucugugugcuuuuuauuauugucauguuugcugcugacauuucacagcuuucauuuauugaauuuugaagacauugauuuuuucuucauagcagaaauuauggaucagauaauuggccaaauaagaaaaauucagacagcauuguuuuucuaaacauacugaaaauaacgcauguaccuggugaaaagugaagacgucaugacagaggguccagcccugcuguccaggccacccccaggaugggagcccugaauccucaugggaugugcgcugagauacaaggaggucccugcacacaccugccuuuccccgcugcuggacucuugcaaaucauuuccugugagugucagccagcccacugcauguuccgaaagcucugcagagugcgccaauauuccagaguuucaaaguagugcccuuugaaaagauuuaaaccugcaaauaaaauuaaauuugcauuugagaauacaauguguuuuccuucuugaaggacuugaugcuuuggugaauaagcauauauuacaaaauuauucaaucacccaucacaagugggugugucauuccagcucugugcauccuuucaaugacuccgaggaugauauccucacggaagcagaguuauuuaaccccaguucacugauuucucagaguuguuuacaaggcggcuuuccgugaugugucugcuuggguaaggcauuaaauuauuucaagaaucauuuuggucuuugcucucaaguaaaagugguuuuagaaggaaacuucuaccuggccaucgugugacaacacuggcugcauaucaagaaaagugagacuuuauuuuuugcacaugauuuuauacucauguaugcuugaaggaauaugcaagcgucgugagaucuaauccauacagaaguugagaauguguuuccauuagaagguaaagagccucuaguauucaaagccuuugauucagcgggcaggugcgaacgguggaggacugugcuucucgcuugcagacaccucgaauuauuuuucuuuagcucccucugugcuuucagggagccugcgugaguuaagccucuccuuguagugauuucccgaugcccagcaaggccgaagcucucauuuccuuuaggaguguuguuuuuuuuuucucaaugaaggaugaauuuucuaaauccauaauuacaccugaccaugauggcagcuucucuguuaagggcuuggaaaguaccuuguuaauuacuugacuuauuuugucaacauuuuuucauguucuccccaccccuugccaaaaaaaaaaaaaaaaggauggagaaucucauuuuugcuucagcgucucuucugugaugauuucuugcuuuucaauucacguuuggaaaaauguuuucauuuaaacaaccucccuauuuaaaaaauuuaacaguaauaccugcuuuuuguaaugagugaagauaauacaauaaggauguaugaagucaaagcuaauuaaucauucuucucccccauccccuuucuauccauccccuuuagauuacucaguaaugucgacagcuugcuguaugucuuuagacaccuuacuucuuguuuguguguacccaugaaagcuuuuauaugcauagauauuucuuuuacauguauuucaaaaagcucagaauauuguugggaagggaagagagagaaaaauguuuucuuugauuuuuaagacaguacuuggaaguuaagugugggcaucaguguaaguaagaaguaggaugcuagagacagaaagaacaagauggguaguuuuucuuuuuauucaaagcaaucagugauauguucuaaugcuuuggaaagguucuaugccuagaauguucccaagaaaggucugauuuauucuucauaaaguacuuuuguguacuucugagcuaggguggaauuuacaugguuuggaaucauuuuuggggguguuuuucaaaauguuugauuggaauagugauaaguucucuuuaaagagauugaucacgugagauuggguaacaccaagaugaacagaaugaaaaauguuucccuauagcagugcuuucagaaacgugaauacauuaauguacaccaagcauuuguagaagagggauuagggcucagcauuacaguguuuuccuaacuuuccuuacucacaggcuccuuauuuauuuauuuuuuguuaggcugccguggccagcguuccaggaaacacacuuugggaaaugacgcuccuuuggcuguguagcgcacaaggggcugugagcuuccccuguagacguuucugccuuauuccagcugaucaguaauauucaucagcaucauuucauucuuuuuuuuaagacggagucuugcucugucgcccaggcuggagugcaguggcgccaucucagcucacugcaagcuccgccucugggguucacgccauucuccugccucagccucucaaguagcugggacuacaggcacccgccaccaugccuggcuaauuuuuuuguauuuuuuuucuuuagcagagacaagguuucacuauguuagccaggauggucucaaucaccugaccuugugauccacucgccucggcgucccaaagugcugggguuacaggugugagccacugcacccgaccuuuuuuucacuuuuaaaucaaaacagaucauucauacaagagaagaaauacauauguagagaugacaaaucauucagugggccucucuguaaugcuucccgcuccagucccugaguagcuccccccgcccagcugugcacgucuucuucuuugugauguggucucuacacagauuugggauucauuuucccucgcuucucuuuuuaguuuuaccacauauuaauguauccuuaaacaauauguucuuaagccuugcuuccuuuugccguuuauagaagcagagucaaacaauauauauuuuuccaugacaugcuuuuagcuuucagcacugugguuuugcagucucuccagguugaugggugcagcugugguccauucguuuucuuagcugaauaauacuccuguuguaggaauagauggcagcaagcguaaccccucuucauggauggguaccugggugaugccaguguuugcuauuaggacagcguguuagauccugcauuuagcgaucuccaggcacaccugcgggagagcgccuccaggaaacacaccccgggguaggauugccaggccaacagguccuuaaggcagaugauuaccuuagggaaacagaggcccccaguguuucuuaggcuucagaaguguggucuacacagcaauaguaauaugaagacucagcuaccgugauuccuucucagccacuccuccucuuguccuaacccagaaucauauuuaugauauugucauuuuaaacauaugcguguaguuucuaugugauggaauaugguagugagaaucuaaguauccagccuggucacccgcuccuuuccgccucacgugcaggaugguugcccucauuuaaucaucguguacagucucccucgggcacccugagcccugcaucuguuucacccagggccucccuuugguucucguuuuguucuuugccucuuccaggacuccugccucccuuccugccucgcuaucagccuucuuuagaauacauccccagccacguuccacacccaauggacagcuuguguaaucauguucucccacaucccuaggaguccugggauccaugaguggcuguuuguaaaucucaggaagcuuucccugucuuccugcccugcccugucuuccuuccccugguccacuggccucggguuuccugcagcauccauggagcacuagggaagacccagccacgcagcuccaugugaucccucugugguccgccuggugcuacuacugaaaggagggucucuguuacuuggcgccaagcauggcagguccaguucccacggauagccggggcaucuaaccaagauaauuuagagcagaagcuguagcuacauucuguaccuguuuaucuugaguuccugcuagcagguaccaauaaugauggauugugaacaaacagcucugccuuguuuuuuuagacccugaaauagacagauuggcuuugauaaugcuuuuugacugaugggcacuuuuuguaacuaaaucccauucaaaggcuuaaaauaugccgcccaagguugauuucaagauauauuaaauugaccuaaagaaaaauaaguaggaaaaaaaguccuaccuacauaugggaugauguauggacauuuucaaaauagucacaacccaacuuuaccauagcaaaaacaagcaaacaacacccccccucaccccccagaaaacaacaaaagcaaaaacaucaaaauaaucccugcagugaaacaagauuuccccuuuauuacuaaguaccuucagccaaaaggaacugcaccacuucauuuaaaugugguucugaauauucguuuguguuugcauugcuggauuaucuaacugcugcuuuccaucugaaacguaagccuucagagauguugcuccccaguaaacuaucuuagcuuugccaggaccgggccuucacugaguguaauagaaucccugauccccaggagguagggaaggggcugacaaugacaugcaugaaugagaauguuuucuagagaggauguagucugccacguccuggagcugcuuuagggagagcaaaaaccuguuuguaucuuucauuauauaugcuuuuaaguacccaaguuaggaaguagcuaucugugagcuuuucuaccagucuucaugccaaagugauaauuuaguaaaaaaaaaaaaaaaagaaaaagaacaaacaagcccucgaaaccaaccugaaagcgcaggauacagauacuuaugggcagagagagacuauugccugucuuuggaagcauugccagcuauugcugggaagaccacuccugcuuagagggguggaauucuuucugagcuagcuuguccuggaagucuccgccccaagaguguucuugaugcgugugccuuacagccauugggcugggcaaccucaccuuuccauuggcuggaaaaugaagaggauaaaccccacucucauauguaggcaaaagguuccuuuugauaaagucgugauuucuccaucucaauaauaauaguaaugcacccaucccaaccgccccagagcuuugcuguucaggaaacauaggcauaucucaaaguacccuuuaccuuaauuuucaaaaucagugccuugucucaugacuuuucaagguuggugaaguucugaaguacuuaaaaaaaauugcugauuuaauaaacuugcuaguugaauaaaagagucagaccaaguagaaagucguuuuaccacagaugugacuuuuucuuuuuguggugaguacaugucgugggcagugcauggggccugucacaacuggcaucauuuccauuugguugaaauccgagccucugcauccugccuugagaucagggcagagcccuugcuuuuuaguuucauggaggcuacauuauaacagagaggaagagagggagagggaaggaaaggaggagaaagaaagagaaaagaagggaaggggcacaggcaggaaaagaauaggaacauuccaaagccaugucucaggacauuagagcuagaaccagugucugugcuaaugggacucuugcaaacacccucuuauuucacuuuaccugggguuaguuuuugguuuccugcuuuaacagaugaaaacagguuuuuuaauuggauucugcacauuaccccugugaaacugcagaacauaagcgguuuaaguaguuucacacugggcuuuauuucauuagugauaugcuguauggauuguaauucucauaaacugauaauaugcugauuuacuggaaaccaaauugacaagaagccuaucauguguauuggcagucuguucagcuugcuggacuuggccaggagaccuugagcuccuaagauuuuuucauccuucucuuaaaaaauagcaaaaacauaucuuuauuuucaguuauuaaauuuugaguucacuuaacaguuucuuaucuguuugcagaaccacauggaaguaaugauaaagucuuguuucagauauauaaggccaacauacuaaaaaucugagcauauucaaauaugcuucugcaucuugaagaauaagguugucuauaugcuaguaacauuuaucugaaaaacaugccacauagaaauaccuuuauggggacuuggccauaaauucuuugccaaagccaaugucaagaaggguauuaacuagguuuucuucuaggauuuuaauaguuugagguguuaacauuuaaaucuuuaauccaacucaaguuaauuuuuuucauaucacggaaguuaaagggccaguuuuauuuuuaugcauauguuaagccaguuaucccagaaccauuuauugaaaaggaguccuuuccccauugcuuuuuucuuuuuuuuuucucagccuuguugaggaucagaugguuguaggagugcagcuuuauuucugaguuuuccauucuauucugcuguucuaaauaucugauaaaauaaaaguugaaauuuuuaaaaaaguaucuuuaugaaaucuaaaaauuguggaaaguaauuaaucucauuaaucuaagagaauccuuguuaauguauuugaauacagauauuuauagaaauacaacuauaauuugaccuaauaugcaguaguauacaugagacuuaacaauugaaauuguuguuuuaucuaaacagaaucugcucauuuccuuuuuacaccagcaaugguagagccagagaacuuugguucacaauggaaucaucaagucauaaaacuuuugaacuucaagggauuuuuccauuuuuuuuugguuggagguggugauagggaaaucuucuucaaugacaauaaguuaaugacuugcauuacuucuuggccaaaguuaagacuagaacagaaguuuuccgacucccagucuguucaguauuuuccccaucauaccugugauuaucaaccuuuucucacucugccaaccaaaaauguucccuuggaaugacuucugacuguuugugcugaaaugaagcagugguuuuucaaagcucacacaugaccguauggacucugcacaguuggugccauauuaaaauacaaugucucuuaccuuuuuuucccuccacuuucuguuguuauuucccaaucaaaguaaaaccaguauuaaggucugucuuaguucacuuugugauguuauaacaaaauuaccugagacuggucauuuauaaagaacaaaaauuuguuucucgugguucugguggcugggaaguccaaaaucaaggcaccagcaaguuuggucgucuggugaggucugcucucuacuuccaagauggcgccuuguugcuucauccucuggaggggagaaagcuguguccccuccuggugggauggaaagggaagccaaccuagggcuaagugaaaccucuuuuuuaagggccuuaaucccaccucuuaaaggaugcacuucuuaauacuaucacacuggcacuggcaauuuuggagggggcacauucaaacuguagcaaggacuaacuucuagcauauuguuuauuuaauuccccaaauuaaguaguggggacugcagauuaguucugaaguuuuccuuucaggagaaaguagaauaaauggguaaagaagaaaccauaaauucaucuuggguggaagugcaguuucugaauauauucuacacaucccaacaauugugaaugugcuuugccaucuuaucaaagcaguauuauauuauagaaggaaaggcuuugguugagcauauggcuauuucugaguuacuuagcuuuauauuaacuuucucaucagcaguuggccuacuugcuuaggccaauuaguccuuggccauuuugucuaugugggcaugcuaggucaugucagggcugauuuuuucuucucaaaaauuuuuaauugugguaaaauauauaucacauagaauuuaucaccuuugccauuuuaaguguacaguucaauauugugaagaacauucacauuugugcaugacuaaauuccagaacucuuuuuauguuauaagacuaaaacucucuacccauuaaauaacaacaccccauuucucccuccucucagcaccuguagaaccaccauucuacuuccugucucuaugaguuugguuacucuagguuauugggccaauuuugacagccuuucuugagguggaauccucuucccaacauacuuauuuccauugccaaccaugacccugcccauggagcucuauccuacacucuaucccauccccgucuucagcccauccuguuuggugacacccaccauggccccagcccacaucuucagcaggugcagaaugucucuuaguguugacuuacacccuggcaguccugugcaccauucacaggauagucuuacuuacagauugagaaucuacaguuuugagaucauuaucuuuacauuucuguauccuccauccuucacagagucuucagcacagagcaugaguucaaaaucaaugcugggagcauuaggagaaaauuacagagaaaaaaauguucaaagauuucauguaguuaaacauucauuccuuccacuuuugcauccuagauugaccccucuugugucuuccuagauaaaugggaaguugucugucucaguugaugugauauuuaaauauaccagaguuuggaguuugcagagaaagaguguggagaagcuaaguagggaaacuugaugagucccuagacugaggauacaggagaaugaagaggaggcaggaguggggaggaaggaacagagaaccaggaggcccagggacguguguguugcagcagcuuugagugugaaugggcaagaaugaacugcacguggggcugccacauuuaacaaauaaaaauauaagauaugcagucaaauuuuaauuucagguaaaaaaaaaacuuaagucuauccaugcaauauuuaggauauacuuacacuagaaaaaauguugcuuaucugaaauuccaauuuuacugaguguccuggauuuugucuugcaacccuagcuguaaagggaagaaggagcuuugugggguagagccaagcauuggacaaaggcauggauggaggagcgaucgguguccccaguccaguucaguaauauggagggcggaggguggagauuacaagaauuacaagcaaagaugggggccguagaauuccaucuucuaccuuuaaagaauuugcccuuuuuuuuuucccuuuaauugauuuuucccucuguuuuuaaguuguucucuuuugaauacucugcuuauagauuuauuuccuaaacaagugcuguuaaauggccuccacuucacaggcuccauggaggagcagagcucuccucucucuaugccgaugcuuucagcauccucagaauagcagcuggaaggcaguagguuuuauggggauaacugugcacucaccaguuuagaugugugguugcuaagagucacgguauuuguuugcaaaccuguugguaccauugguccauguuuagcuuuguuuaauauacauaaacaaaaaaguguaacuggaagcuaugguauuuuauuuuucaauuagcuauggaaaguacaagaaaaucaaguugcuaagcaauuucuguugaauuggauguggguggaaccauuaucaaagguuggaagaaaucguaaaaauggaggagcauuuuauauucacguuguuuuuccuaugucuucaaguucuuuaaaggaacugaaacuggaaauugcagaaaaugcauuaugggugugauuuaugagguaaagaagaguacacagugcaugguguguuguuauggcaacccuaggaaacuaacaucaagaucuuaacucaagauauugauccucauguauguuaacgugagagacaugugugucuuguguggagggccucuccaggugagaggguggcugugcuuucacucauggucagcuccagucugcucagggagcucugggcauccaugugcccaugugucauccuugugacaucccuucagugucagcuacuuuuauccuuugaucaauugcuccagggcucauaauacaugauguaauugguuggaaacguggauguccaaaaagugcaucaacgcucaaggucauguguccuuuguuuugaggugucacucugggcagagcuguccggugcaacucaggggaagugguguccuggugagaaccaagucagaauguggcuugaaaugagcucuuguaugaagcuggcaaauuauggcuuaucuuuccuuuaguagguuuucuucauuuauuuccuuaauuuaauggaaugccuuagugcuauuucaauuaaaaaauauugaugguaaauguuugggaggacauucugcauccuuugaugcucaagauuuucuguucuccaaagcaguagagacauuagccucacucaaaggagaguaaaauuauguucaauguguaaacuugcuugcugcguaacaaaguaauauuauggcaggguguuugacagagacucuuuagcuuaaugaaauucuaucagggagaugcaguuuuaauagcgucguucauugcuuuuugucccuguagucuuuaaaggcucacauguggggaggacaguggcugcaucugagcugccagcagcagugcaggaguucagaugugaaauuucacucaugccagcauuuccagcauuuauuuuuaaucaggaucugcgcuuaccgauggccuguuaaaaaggaauuguguaauuagccuacuaaaucaccuuuucuuccucagucucuucacaucucugaaaaacagcccccauaucacuguggcuuacucucucucucucaauauguuguaggaacuacagaaguuucagcauacccacaaauacuggguugaauaccucuuuucaaacauuaguuuuugaaauuguagucagguuuuuaaaaaacgguugaaucagaguauaucaaauugucauguuaacgugguaacaucauaaacaaguuuccuugggagauaaauuuugugguuucuguacauagagaccaccuuucuuuuuggucgacauuucauuccuccuguguuuuuguuuuguguuguguuguguuguguuguguuguguuguguuguguuguguuguguuguggagacaggaucuugcucugccacccaggcuggagugcagugguaugaucguggcucacugcggccuugaccuccuaggcuaaagugauucucucacuuuagccucccaaguagcugggacuacaagcacuugccacuacgccuggcuaauuuuuuucuuucuuaaaaauuuuuuguggagauuaggucucacuguguugcccagacuggucucaaacaccugggcucaagcgcuccuucugccuuagcuuccccaaauucugagauuauaggugugagccgcugugccgagccaguuucuccuagguuuuaaaagauugacuuuauaguuuggaucugcaaauaaguuuuaaaaaauuguagaaccuguucccauguauccuucauucagucucugcccucauuauugacauuuuguguuaccaugucacaguggucacaacuaauaaaucaauacugaaaaucucuuugaauuuauaacaaugucugauuauuuaguuuuacuaaucucaaaauuuggaacaacauaaaucagcaacuuucaagguuuuuuucugaaagaaaguagcuuagaaauguauacaaaagcaaaucaacucaaaguguguguuuaucauuuagaaagguaaaaaucuauuuuuccuaucaaaauuaucucuuaaugcuuuuuaauuuauuuucuugaguuuaguaauucuaucuugcuaauguaccuucaauuucuacuuacuuaguagaauguuaauauuacagaucgagcaucccuaauuggaaaauucgaaaucggaaaugcuccaaaaccccaaaauuuuugugugcuaacaugaugcucaaaggaaaugcuuauuggagcauuuuggauuucagaugagagauauugaaccgguaaguauaaugcaaauauuccaaacucugaaauaaucugcaaucugaaacauuucuugucccaagcauuuugaauaagggauacuccacuuuuauucuuauucaccaagaaaccaccagagaagacaucaagcaucaagugaaagcuacagaugagcacuuuacuuuuuugggagugcuguuuguucguauaaagaagugaggcuuuuuaagaaguggccuuuuuaggccuuagcaccuuuuuaagcugaucacugucuccuugucuauagaggggacccaggaaaucuuaggugacagugaggcucaggguggagcuugguuacuugucucagcaucaagggacaggaucaggggaaaggaugcugagcugugcuugugggugagaaaugaguuaauuaagcccuuucugccaugauaacucugguguuuguuuucugcuauuuaggcuaucaaaguuaguuagugacucacagcaaaaagaagauacugauauuuucuuggguuuuguuuauaaucauguuuugagcuuauauagacaugcucuuucuuaaaauucauuuauuugcuuuucauccauggaaaaccaguuuuuuuucaaugaguuauaaaguauuuaauaagaagagauucugauuuaauuauauccagagauggcuuuggaucauguuauuuaagauggagaaugacuauuuagaaauauuaauguuuggccgggugcaguggcacacaccuguaauccuaguacuuugggaggcugaggcaggcaggucacuugaggucaggaguucaagaccagcuuggccaaacauguugaaacccugucucuaauaaaaauacaaaaaauagccaggcauggugguacacaccuguaaucccagcuacuugggaggcugagggaggaaaaucacuugaaccugggaggagguugcagugagccaagaucaugccacuguacuccagccuaggugacaaaacaagacucugcuucagaaaaaaaaaaaaaaauuggugugguagugcaugccuguagucccagcugcuugggagccugagguaggaggaucacuugaacccaguagguuaaggccguggugagcucugaucacaccccuauacuuuagccugggagagacagcaagacccugucucaaaaaaaagaaaagaaaagaaauauuaauguucauauguaucuauauauuaucuauaucuguauauuuuuauauuauaauuuaaauuauuucaguagaaauuugaaguaggaguuuuagggagaggcaaaaaggagugcaugcauuaaacauuccuuuagggucaagacgauggagccauugaguacauuuuaaugaaugugaauguuaucugggcugcuagaaaagaaugaaaaagccauacuuaauuguuuaaggaaaccauagaagaaucuacuguuggguaaguugcuacccaaauauacauacauucuuuuucaaaauauauccugaaguucauauuuuccaccauuaaaucuauucucuuccugccaggaaaccugaacuagagagguuuggaggucuuauguuguuacgugccaaaaauauagaaaguaauuuaugagaaggacaagaauugugauacauuacuaaggcgcauguaauuuucuaaguacuaaacugacagguguuuuauauauauauuuauguuuuauugguaaagacagaaaacaaauacaucuuagucaaacaguguuccccgacuuaccccaucaaugccaagggcacaggagggggucugcaguaacuuccugaagcaaagcacggaggagagcagguaacccaugacaugaccuggcuugcgagccuugauguuuuccguggguuucauucuuuccuuugagaucccaggcaaaugacacaacauagguuguaauggaaccccuccuuuuccuuguuuagacucuugaacaucucauauugcuccugacugccagcaaccaaaugaagggcuucauuaguuauagcuaauuaacuacacaccagacugaaggauuucuagccaaggaguuugggguugcuuuggaauaauagcgagaagcuagucuuuugaguuuuaacuguuggaucccuagcuuagaaaguuaccaguacccuuuuuaauuuuuuacucuguaaugggcaggaauagaaauuauguacaacaguggaaaaguagaagaccauaucaaaccugauguacccauaagaaguaguuggacgggcaugguggcucacgccuguaaccccuucacuuugggaggccgaggcaggugaaucacgagaucaggaguuggagaccagccugacuaacauggugaaaaccugucucuacuaaaaauacaaaaaguuagcagggcaugguggcgggugccuguaaucccagcuacuugggaggcugaggcaggagaaucgauugaacuugggaggcagagguugcagucagccaagaucaugccacugcacuccagccggggcgauagugcgagagacucugucucaaaaaaaaaaaaaaaaaagauguaguuaauagcauaugcuucuccuuaagugaucacccaaguuguuggaguuuccuaaucaucaguuuuuuucucugucauuuugagcuuccuggaauaggacugaauuugcaaguugaaugauuaugcauaaggcucaagaaaaacuugaaggcagauaaaauugauuuauacuccuuagcucuacccuacccuaucuacagguauuucuuggcggucagugaaggaucaaacaagaacaggguuggguaaugcugucagcaggcccacuacaucccaugccaggcgcucauggcguccugucucugcuccugccucacuuuccaccucucugcccagcccccauaaauaguaugugggaagcugggcacaguggcucacaccugucaucucagcacuuugggagccgagguggauggaucgcuugaggucaggaguucgagaccagccuggccaaaauggugaaaccccaucucuacuaaaaaauacaacaauuagcugggcaugguggugcgugccuguaaucccaaguacucaggaggcugaggcaggagaauugcuugaacccaggaggcagaggcugcagugagccaagaucgugcuacugcauuccagccucggugacaggggaagacugggucucagaaugaaaacaaacaaacaaacaaacaaaaaaaagaguggguggggcuccugaugccuucgccauugugauuacacaauacuucuaccuggacugccuuucucccgcucccauccccaccuucaccugggaggcaugcuauugcguuccccacagcacccaagucaccccgucauggcucugucaugcugcauacaccacugcuccuuuaaagggucauuucucacuagacacaggggcagagaccauguugcguauuuucuuccaugccccaagccccagcaccggacuuggccuauagcaagugacaaugcuuguuuuuauuaacgaaugaguacacgaucccaggaaucucguugaaguccaguucuccacguggccacccuugacucccacagcugaccugggauugacaccguggccagcccuguuccucaccugaugccugccuguagucuucggccuugcugcuccagaacuuuucaucguggccccuuuagggccauggcagcacaaauacacuuaguaggugaggccaugaggacaccuaccaccauuaaggaugccuguggggaguagggagauggaggauaggcugguaagacccugccagugcgggccugccucagugccuuggaacgagguauucccagugccucugagcugcaucccaguguguccugagcacccaucuggccuggcaagaagcaggcacgaaaggcauaugggccguagccucuagccuccugccaccugcauuccaagccacguuccaguagcacuuuaacugaaacaucuagcuacacaagaugggcugagcacucuacacagaugcugguccaugcagaaacaacccuaccccuucugcaccugaaaggguucccucugauuagaaaagguuugcuucaaguucgguuauaaaggaaggcuugugcauaguuaguggggaagccacagggaugugcaacuuuucccuacagcccugagguuccaggcacuaagaacuuggcacgucuuuccaugcuggcugaaaucaaaaugaaaccuucuuugacuuuugccccuucugcuggggcauugacauugggguuugacacuggcucagacagucaaaucuggaagccaaaccuuagaagccaaaucuuaggguggcauuaggacuaagcugagaauaaauucucagugaucccauucaucugccucccaguguacuaaaguaggacuuugaaccuuccagaaaccugauauguuggcaauuucucaagcuuugacucuuucuuccccauugccucuaaacccuagcuugaauuuuacuggcugccuuauaauugcuauuuguuaaaaaucaaaacgauuuuccauccugguaaaaugguaaaaauaucaguaguuugcagacaguaaauaucugucuuuaauacuucaaaaacaagccauauuugccuccugccuguuuuccuuaugagggaauuaugcuguggggugguagagugagaaggguuaaaucacuggggacccaccuucccucguuccucauggaauuuagaugaaugugcucuugcuaaauucuccagaacguguaugugcgucacccccacgcugcccggcccggagguggcuggaagucucacuuuguuuuucaucugcuggguggugaccagcagagagcacugagcggacuguucuuuccaaugcuauaaaaagccuguuugcaaaaugaggauuucugcuuccaggggcugaauuccacgucugcauuaugcuugcuggguggguaccaggcacagucuguggcuuggucguagccuuugccaugucuuuugaugaugugacaugccugagacacaugguggagcucugcagguggugagcagccacgaggcugugcuugcaugcuggagcagaaccuuguuacugcugauugaauagucucgcagaccccuuuucugucaaacgcaaagccauguguuuuuguuccauguggaaaaucacacacauucucuagcauauuacauugucauuaugucaacauuuuuaaauuuuauuguuuaaauugacgaauaaaaauuauguauauuuaugauguacgacaugauguuuugauguaugcuuacauuguggaacagcuaaauugagcuaacuaacaugcauucucucacauacuuauuuuucacguguggugagaacacuuaaaaacuaccgucuuuggccgggugcaguggcucacaccuguaaucccagcacucugggaggcuuaggcggguggaucaccugaggucaggaguucgugagcagccuggccaacauggugaaacccugucuuuacuaaaaaauacaaaaaauuagccgggcgugguggugcgcaccuguaaucccaggcugaggcaggagaaucgcuugaacccaccaggcagagguugcagugagccgagaucgcaucacugcacuccagccugggugacagagcaagacuccaucucaaaacaaaacaaaaccaaccaaccaaacaaaccucacaaaacuacugucugcaguuuucaagugugcaguauauugcuauuaacugaagucaccgugauguagacuucuugaacuuauucugccugucuaaaugaaauuuuguuuucuuugaccaucgucuccccgguccccccgcucuccaguccuugguaaccacaauucuacuuucugcuucuaugaguucgacuuguagaguccacuuagaagugagaucaugcuguguuugucuuucugugccuuacuuauuucccuuaaaauaaugcccuccagguccaucuauguuguuccaaaugaugguauuuccaccuuuuuuaaggcugaacaguacuccacuguguuuuuagaucacauuuuccguauccauccauugaugcacgcuuaggcuguuucccuauuuugacuauugugaauaacgcuacaguguacaugggagugcaaauaugucuucaacauauugauuucauuuccuuuggguauauucucagaagugggauugcagcaucauuugaugauuuuaguuuuaauuuuucgaggacccuccauugugcuuuccguaauggcuguuuacaaauuuacacucccauccacagcacacaggggcucccguuucuccacauccuaacacuuguucuuauuccuuuuguugauaguagccauucuaacagguguaaggugauaauuuauucugguuuugauuugcauuucccugauuauuagugauguugagcauuuuuucauacauauguuggccacuuuuuauuuugaaaaauaucuauccagugaucaccuuagccacacauguacuaaauaugucuguccauuuccuuugccccuuuuuaaaacaggucauuuauuuucuugcuauuaaguuaucugaguuuuuuauauauuugagauauuaauccccuuucagauauaugaauugcaaauauuuucucccauuuuguagggagucucuucacucuggugauuguuccuuuuacuguacaagagcuuucuaguuugauuuaacaucauuugucuauuuuuagccuuauuuuuuauugugcuuuuuaagguuauauccaaaaacucauugcucagaccaauuucaagagguuuuuuuucuuuauguuuucuucuagcaguuuuacaguuucaggccuuagguuuuuaauacauuuugaguuaauuauuguauaugguaugagaugagguuauaauuucauucuuuuacauguggagauccaguucuuccagcaucauuauugaagauuauccuuuccucauuguguguuuuuggcaucuuuguugaaaaucaauugacuguaaguguguggauuuauuuccaggcucucuauccuguuucauuggucgaugagucuguuuuuauggccagcacuauauuguuuugauuacuauagcuuuauauuagaucuuaaaaaaucugguagucugaugccuccaucuuuguuauuuuugcccaagauugcuuuagcuauucuggguuuuuuguuuuuuuuguuuuuuguuuuuuuguuuuuuuguuuguuuuuggugguuccaaacccaucuuagaauuguucuuuuaauuuuagugaaaaaugucauuggaauuuugaauaggacuugcguuggaucuguagauaacuuuggguaauauggauauuauagcaauguuaauucuucuaauccaugaacauaagguaucuuccauuuauuuuuaucaucuucaguuucaucaauguuuuauaguuuucaguguacagaucucucucuuucuugguuuaauuauuccuaagucuuuuauuuuuugaagcauauuuuaucacacguuugauuacuuuuauuaaugcaacuuucauuaaacaaccagaaauuuuuguuuuaagacucaucugguaauucuuuucuaucagagcaggguuaaaguuugcuuugaaaaugaucacauggagaucaaacucucuuuagcgaauggguagacugaauccaaggcuuuuuuuuuuuuuuaacauuuaaaugcccucuccacaagccccaccacaaaguuauuuugaaaauacgaauucaguacuauucgauacaagaaaauguugguguagucagugucuuacaauguauauuuuaaguguauuguaaaaaagaauauucagugcaugaauuucuuuuucuuauucuuuuuuuuuuauuuugaggugaggucucucucuguugcccagguuggagugcaguggcacaaucauggaucacugcagccuccacuuccuaggcucaagcaauucuucuuccucagccuccccagcagcugggacuucaggcacacaccaccaugccuggcuaaacacauuucuuuggaagagugccauuuagcuagaggcuuggggaucuuuaaaaauacuagaaaugacaucuauaacuuugucagaagcacauucacucauuaauugauagaaucauuguccccuuauuuagacucaaggcuuuuguuggaauaaauguuuucccuuccuucuuguuuguguuaggcuuucuucuuuucuuugccuuuuaauguucuuucaaacaaauagaagacugagugcauucgcucagacaucuucauuuguucaaauaaacuccauuuuuucagacagacuugaacaaauggagagacaguucgugugucaccuagguaaaggcugucugcuagggguccuucaacaagcaaaaccaaggucccugcacacauggaguucauauucuagugaggagagacauaaacaauuuaugcaauuugugucaaccugauuggugcauggagaaggcagaaaaggagggaaggaagugagccagguggucagcuggcagagaagcguuccguagaggguacagguagaguacaauccugaagggugcagaccuuuuaguucugcaucuugguggucauauguauuggaagagcuugagaaaaaugaaaauaccauuuagcuuaagaaguugugaguuaucugcaagucaacucauuucaggaguggaagaauccccggaaugauuuccuaauaucaaaauguaugcagguuucucuuuugaaugucuuguauauuuagagagggugcuguacaaagucucuuguuuuccauacagcaaauuccaggaucccuugcuggauacuguggcuggagcaaugugagcaacagaggcagaguccgggaggugauguggggcuggggcacucaucauggccuuauaggucugcgccuugguccacauucguacugcaguuauuguuuuuauuugugauaaugauuuuauacuaaauaauggugauauuccuaccauauuuaccacguaguagugucugagguuucugauucuuucgaacaaaugccuccuguugacccuguuuccauuuaaccaaucaaccuagauuucugcuuuuugccccuucaugacaccaacacaguggguugaaauucaaaacaaguggacuucauuucaugaucucaugugcuucuuauuuaaacaggaaauaggagcauugcauuugacaacuuuuaacuguguagccagauaauuagcuugugaaaaacauacucaguuuuacaaacaaguugugauucuggaaaguaaaauuagucauuauaguacuacuuugcggauuuaccucccacugcaugcuguuaagaucucaucuaagcaagauuaauaaaaaauaaaaaaucuugacuaaacaucuguugcaaagugacuuucaauuuggcucuucaccaugugacuggugauuagaguuuuugguuuagguuaaggggauuugauuugauuuggcauggucccuuuuuaauuuuauguaugaggcaaauaacugaaaugucccugauugucauaagugaaaaaauaucauuaaaauauuugaauuuuguucaaggagauuaaucucuauaaaccaauguuuuguauucccuaauuagaauuaugguagucaccaguaugaucaaugcuaaguguuuauuugguaauuaggaagugcaagcucuaaauuuugauaagauugaugaaauggccucuucucauauuuucauuauguccguauaaacauaacuuagaaguuggaaauaugaauuuugucuacauaacaguggacaugcuacaacaaacaaauauauagcuacaaacaaagcuauauauuuacauugauauccccuugauuauuuuucucaaugagcagacauucaagagauuuuuuucccccacaaaaugugaugugaaacaucuacaauguauacuugccaagugcauaacuauuaacuuacuccagguaccagauggucuuauuaagauacuaauuaaugucaacucugacaagugaagcuaauguuuaaauucagcugccaguaaguucucugucagagcacucccaauagaaugugaguuauaugcgggcuucuagaacaauguccaaaacacagugugccuucgcaaagguuucagcgaacggauaaauacuguggcuacauucccuuucuaggaaauaagaauuauaaaaaauguugaucuucuaaguuuaauuuuauuauaguuugaccuuacauauaaguuguguuuugaagguaccauucuucccuucuuaguaaaaauguaacagcauccauacgaugugauuucggcugcuccauuuuauuguugaucuacuuguucuucaauaauagaacucuuguuuuauaauaauuuccauaccauguuuguuaaccaauaauauccauaaccauaacuugaggcacuuuguuauagcugauccugagguuaggaauacuuccuugacaugauacauacaguauauuaaaccaacauucaaaauaauaguuaaaaauuagacacuaaaagcgugcccauuaaaaucacuuaagaaaacaggcgcuugcugucauuauuauaauuugacauuaccgugauagugcggccugaggaguaagucuagaagcagaauuaagaccuacagugauuagaaaagacaacacaaaaauauugacagauguuggcuugauguauuuagaaacccucuccaaagugggggaaaaauaguuuggaaguaauaggagaauucuguagguucaauugcaaaauguacacaucaaauucaauaguuuacccuaauauacaaauaaaaauacacaaaauguucaaaggguuauuuaaaaaagcacucccuccaaaagacacaaaaauaaaaggagcuguuaaagauccguaugaugaaaaccacaaaacauuccugaaauggcauaaaaauagacuugaacaaauggagagacaguuugcaugucuaagugggaaggcugauauuguaagccucuucaauuaauuuaaaaauucaauggaauuccaauuugaaucccaauaggaccuuguuucagacucaauaauguguuucuaaaguacaugcaaaagaauaaauuggcaggaauacucaagaaaaaugugaaaaacaaggguaaugugaaguaggccuugcaauacugaauagcaaaaccauuugaaagcuacaauaaaguauuaauuaaauugaaaguacucuguuucuauauaaguguaagagcaagaaggaauccuuucaaauacaacauuaauuacauauggcuuauaggacauggugauuuucagauuuucuucuuuauuuuaaaauauauaaaauauauacuuuauauuuuauacauauaaaguauauggauuuuauacauaaaaaguaaauaauauauguacauuuuauacauauauaauaaauacauauaaguauauauacuguauaaagcauauauacuuauacauaaaucuauauaaaguauacuuuauauacuuuguauguauagaauacuuuauauauguauacuuuaaacauuauauacuuuguauacuuuauaaaguauaaaauacguauauuuuauacauuauaaaugauauacuuuauauuuuauauaguaacauccauucuucuuccuucuaaauuuugacagacaauacaguuguguagccacuaccaaauacaagauuuagaauauuuccauuuccguaaaaauauuucucaugccccuccauagucaguucucucuucuuugucacucuaguacugccuuuucuagaacgacauuaaaaauggauucauacagugucuagccuucuguaucuggcuuauuuugcuuagcaugauguguuggagauucacucauguuuauuuaccaguaguuuguuccucauucuugcugaguacuauucaucaugcagauaugccauaauuuauuuguuuauuuaguagguaguagguguuuggaguguccccuauguguggcaauuaugaagaaagcucuauaaauacuuguauagaagucucugugugggcauaucuuuucauuucucuugggugaauucuuagaagcagcgugguugggucaugaggugaguauauuaucagcuguauaugaagcugccaaacuauuuccuaaaauggcuuuaccauuuugccuucagaccagcaacaugaguuuccauuguucugcaucuuuguggugguuguuuuuuuuuuuaauuuuagccauucuaauagguauauaguuauauuucagugugguuuuaacuugcguguuccuauugacuaguaagauagaccaugcuuucaugugcaucuuggccauuuguguuccuuuuuugauuaaauaucugcucacauuuuuugccaauuuuugguggguuauuuucuucuuauugguuuuugagaguuugucauauacugcggauggaaacccuuugucagauagguguuuuuaaaaauauuuucuccaguucugcagucugucuuuuuacuuucuguauagugucauucaaagaccaaaaauuuuuaauuuugauuuaaguucaauuuaucaauuuuaaaauuuuauguuucaugcuuuuuguauccuaagaaauauauuccuaugccuaggucacaaaaguuuucuauguuuucuuuaaaaaguuuuguuguuuuaaguuuugcauuuaaaucuaugauacauuuugagucaauuuuuguauacgguuuaagguauggcuccuuucuuucucccucccucccccucuccccuccccuccuucccucucuccuucccucccuccuuugcucccucccuacuucccucccucccauccuccuuccuucccuuccuuccuugguauuuggguauccaacuguuucggcaccauuuguugaaaguacaguuugcacauugauccuucuugacacggguuuuuuuuuuuuuuuuuuuuuuuuugaaaucaguuaacccuaugugugcagccaguuuguuuuauuugucugucuguccuuuccaguaccacacugucuugauaucuguaguuuuauaauaagucuuaaccauauugagucuuccauuccaugaauaugguauauuccuccaauuuuuaggucuuauuugacucccgugucaauguuuuguguguuucaguauacaauuuugugacuuuaaaauauucuucuguauaugguuuuguguuuuauucuucaucaccaucaucaucaccaccauucauuuauguagccagccacugugcaaauauccuuaaauacauaucuaauuaaacuuuucaagaauuccagauuuuagaaucaugauccgaguuuuacagaugaggaaaacgaggcucagaaagguuaaauagccuguuaaaauuuauacagcaaacguacccuuggucaagugauuauuccaaauugucugccuuugaaaccuuuacucuugacuccuaaacuaauuuuguaucauuuaucuauauaacuuuugccuuaagaccaaaaaauauuggccgggcgcggugacucucgccuguaaucccagcacuuugggaggccgaggcgggcagaucaccugaggucuggaguuugagaccagccuggccaacauggggaaacccugucucuacuaaaaauaugaaaaauuagccggguauggugacgggugccuguaaucccagcuacuugggaggcugaggcaggagaagcacuugaacucgggaggcagagguugcagugggccgagaccacaccauugcacuccacccuggguaacaagagcaaaacuccaucucaggaaaaaaaaaaaaaaagacaaagaguauuauaaacuaaugaaaagagcgagggugauguugggauccauauuuggcagggaagcaagauauuuguacucuuucuuacaacuuccacuguauuuuguuaagaccugaauacaccucuacaguggacaguccaaauaaauaagccauucccguacuuaagaagcaugcauaugguggagcuuuaugugcaaaagcaacaaagcccucuaguuauauuuuagcuccucagauacuuuucugagugauuauuccugcugcuuaaaucucuguacuacucccuuuugcccaaguuaaaauaccuaaaucauugguuguaguucuauuauuguauucaguaauaguuccuuugauuggaaaagaaauaccuccuuuuuagaauucccuggcagucuguaauaacucccuuuuauaauauuuguaacauugugucuuaauuaauuguugucauauaagucuucucacuagauugugaguagaagcuguuuuccuuuggcuuuuugagauguuucauauguacaaaaauguugaaucaguauuaguguuaaacacacguacccaccuaaauucacuacauauuaacauuuugccaugucugcauuaucccugcauguguaaacuuucuuuucugacauaccaaaaaguuggucacagacacagggacacaucauuccucgcuucaugcaacuccuaugaauaacugcucuguaggcacaggaauauuaugaugccuaugaaaaugaacaaugauucccgaauagaauguaagaucucuucccugugagguuuucccuuugaccuuaaggguccccaccauuugucuugucaaaugcuguauacucugaaucugucuauucauuuccucaugauggaacauuuuuggcaaaaaaaguaacuacuuaagugauccugugugcuuagcauucuaccuaaaggcccauacuauaauuaggaagaaucuauaggguguuguuuucagauugagugagugucuucguccccaaagaccuuuuaccucgagguuucagugcccauugaggagccuccucuggaccaaccauuccuuuaggaguugaaaccuucaguuaucaaguucucuucuucauuccguguuuuuuuggcucauagucuuccguaggucacagcuuuacuuuugcccucaacccugccacgucgccuauaugucuguguagacacauggauuuuuuucucauucaauuugcuacauuuguuuguugucaucguucauuuugauauucagauugucucaagcaucccacacguggccaggggagccuccccacaccaccuccuguguccuuuugacauggccccacuagccuagaagaaagacgugacccagccucccacugaggucauucuggucaggggcuguuuuuaucuccugcugaccuacucuugggaacucaaugaugucaacacacugcacacucauugaauguugguugaguguugcacuuggcagugcucuucaugguuuugaaucuucuugucauuuuagccuuauccccuccauuucucaugacccauucuagaaggacccauuuagggaagcuucaauuuccccugggguguggggaaagugagacaagggguggaaguagaaccucaguggguugugcuuccuguguugaugcuuuccugcacacccugcuggacagguacagggcuacugcagaauuccucguggguucccacaaauugagucucaguccaccacaguaggcgauuuugaaaauaagcauuaggcauuuaugacuaaaaucacuuugguagcuuauguaguuguaaguagauaagcuauuggaugaucacuugucaugugcaguguuugagcauacaaccgcauacaacauauguauguauuaugaguacauacauauuuauaagaaauaccauaaaagauuaucuauguuuuuauuuacuauaaucucauauuucaaaguaucuuuuauucuccuuacgauucauuuauuuaauguuuuaauacuuuauaauacuuaaguaucaucauaaacauuuaauacuuaauauuuaaugaugugugugacauuucuccuuaauacaucauccaaccaauguuaacaauguugaggacaguauccuuuuaugauuuauguaaggcauuccauuuuagcuaagaaagaguuucaacuuucauuuauaacaaugauaauuguaguguccuuuaucuaugaaagucaguuuaaaaacacguauagacauauugaucuucucuucaauaauaagaguuuuuuuaagaccgaguuacgcucguuucuauuauaguguguuuucagauccucuauaucaugcgauaagacuucgaaaauucuaaacucucuaaggcucuauuauuacgugauauauugaguauauaaaaauaacguauaaaauuuucugcuuugcugucuugcuuuaggaucaaaugaauuauauuaagaagcugcaaacaaaguauauaguccucauuacaccauaaacuauaauuuuguauguaauauuugauuauaauuuauuuuuauacuucauaacaaaugugaauauguguuuaaauuauuauacuuuauaaguagcaaauaacuguuauggguaauuuaagauccagauauucccuuuugguauauuuguccaauaaacaucuucugcaauuacugccacuauaaaaaugaaaucgauuuuguuuuuaaauuauauuucuuuccuuauagugccuggaaugguaugagauacuaguacucuauaaauucaacuaagcacucaguuuaaauuuaagauacagguuuaauuuuguuguuaguaguuccaaauagcuaaaagaugacauuaguguaaguuauuuucuguuuuauauaguuuuggcuuuuuuuuuuuuuaacaaacauuccucacucuaaaguucuuuauaaaauaaagaaauuguaauauuugggagauuaaaugaguaaaaauuaauuauauauugaauaaaggcaucaugggaaugaauucaucuuuaaaugaaaaaaggaacaauuucaccauggguuguuuauaugggaaagguuuuaugaguucacugaugagaauggacacccauuuuccggugagcuucaguuuuaacaauaauaccugaaucagccuuuuuauuaugucuuaugcuuaaucaaauauuuaauuaauaaaacgugacauacuuuuugagggcacagcgaugacuccugacauucaauguaugcggcacugcacacuauccucuguccucauuuuacaacaucguucuuucuauauuuuuaauuauucuuucuuucuuauacuccccgcccccuuaaucuuaaaaggauuuugagguagcuuuaaagaaauucuauauaauaugaaaacacaugugugagaaaaucaaagcaacaaggagaagcuaucucauuucuauuucaacaaauauaagugaaagaacaauguuacaaggauuauagaauuuugcaagauuuuuccaaguauguuauuauuuuaaaucugagaaauaugauaguuauaagggcaaaucguuugacuuguccugaaaaucacuaagcugggggaggaauauaaggaagauaugaugaucaugaauauaaucucauaucuaccugaggauaguaauuauaguucuuuggcugggcgcgguggcucacgccuguaaucccaaugcucuggaggccaaggcggguggaucaccugagaucaggaguucgagaucagccuggccaaccuggcaaaacccugucucuacuaaaaauacaaaaaauuagccaggcguggcauaccucuagucccagcuacuccggaggcugaggcaggagaaucacuugaacccaggaagcggagguugcagugagcugagaucgcaccacugcacuccagccugggagacagagcaacccuccaucucaaaaauaauaacaauaauaauuauuauuauuguaguuuuuuuacuucucuuacauuuucuaaauguucuuccuuuccucuggguucuguuuuuguuuguuugggccuccuuuauuaaugcuggaugaauuuuuuucacaaggcccaguacucuugcucagacccucugucuccaaguuugugcacagagcauggaggcgcaugggcuuuccugcauggcaagccuggaugggcugagcugucauacuuuuggaaccuccaugcuuaguauuagugcuuauguucucuuuggcuggucauuuucaccaaagaggauucuucuggucuucuuucuagguuugguuugggacuaagguuaggagggguuaguuuaagccuccuugcugauaugcugggagcugagcagaaaagagagaggggaguauacuguuugguuugacaucaaacuaaacagguguuucuuccaggugguucuugucauuuucuucugcuuuucagguaccucccuuguccagagaguaaacaugugguccucuccccaggagugaguuggagagccccucacuggacaugcugggcauaggcagacuggauauagggucacauuucaaagccaucagcacuguuguuuuucaucucacauguagccuccugaguaccuggcacccuccaguuucugggccuuccuuggguuuugcaccagggauucacagacuuccuguuaaaugucaccacguucuugccuugagggcaguugguacccacucaucacccucuuuccugcuuccagaauucucuugucuuuaguugcaucuccucagaguccccugguccuugugggcuugugcaguuuuaauaugugccuuacugucauuuaaugugaggaacugggaaugcauguuuuaaauaguuucuaauuugugauguaggcaaccccuaaguauauuuugaaaaacuucagcucugugcagacuuugcaggaguuuggggcuaauuuauaacauuuugagguuuuguuuguuuuuuggacucccuguuuuucucuuucauauuuucucacagaaaauaccaccuaugaacauuuugccauuggcuuucccucuacaaaagagaaagccauugugcucuguuggccuucuaucuuaucagcucuaagaacucacucauacuuggauuuauuucaaaucauuuuaaagaaggacuugacucucaguuacauucccuuuuccuauauucucuucuucauaauauugcuuuacaguauugauucuuuggcuugaaugcgccccaaaagaaaaaucauccagaagucaucaccauuauguuuuuuuuguuguuguuguuuaguaauauauuuuaaaauguuacuggauaauucauuuucauugcuuuuuaugaugauuauaagauggguuuauuuucauuaauauauuugaaauuuaagcauuugagugagauuuccucuucaaaguccuugccuuagugaaaacacgguuaaacuuuguaacaagaccucaguugaaaucaugaagcauaaucccggauucagucuucaggguucuccuuuuauugaaaccgggcaccuaccguccacacucgucacuccugugucucuguuuacagcuccaacagcuucugaggcugggaacugcccagagauccuuuggaauuuagagaacuuagaagaacguuaaaauuucugccuguguugugugucccagagagcaaaucugugcuuuguacaaagugugagcuccagggucgauugagacagcucuugucuggcugaugaaauuaccaggagcaauuuuauacccugcuauccaagucacauggcuaaguccauuuuuauuacaccuucacagcuccucaagaauaugaauuaaaacccuuuggauuuuuuucuucuaauucauacuuagaccuuccacuaggcauaguugacaaaggcacuguuuaaaagauaugucucauccugaguuuccauucaccagucugugcuuuuguuagccuuuuguuuuuauauccugcaaugacauccugcauucaacuugccugucacugaaugucccccugcuccaccaccagcaccccauucuaccugugcuguuuuccuucuacugagacucacuuccaccugugcccaguuccaccugccuuuccuucuacccagccucaguucuacuugugcucaauuccaccugcccuuccuucuaccugugcucaguucuaccuguucuccauuuuuccuaucaaccuaccuagugaaaugggggcccaaacacauuuaaaacuggggcacugagguacuuccaggagggcugggggugugcggggacgacuucuguccagggcucccuccaggagcagugccaggcaguagccaaggccacaccaacagggggagcccugcgagagagauuuuuuaagacaggagcuuaagaaauggaacuagaucaggggcaggcagggagaguuugucccuccugccagauggauccuuuucuuucuggaccaccuuuaaaaauauuaacauacuuucucuuuauaaaaacaaucugggcuuagucucccuccacucaugacuaucugguaucuuuucuagucauuuuuuguuuuucuuguacuauauauucuuuauauuggucaaauguguauacauaauuacugcaguuuuccucuucaauuauuuucucaugcuauuaaaauauuccauauuugcauaauguuucuugauuuaaugguugcacaauauuucaucauaacacaaguuaugauugcuugacuugccaaauaaaaauauaggacccccaguucagcuugaacuucagguaaacaacaguuuuuuuuuucuaguauauguaucucucauguaauauuucauugcaacguuugggacauauuuauuuuucuuuguuuaucugagauucaaauggaacugggcauccuguacuuuaucuugcaacccuacaaaauaucauauuauuuacacaguuucuugugguggauguuuagaauuuucagcaaugcuauggacaucuuuggguaugaaauuuucuauuuugaauuacuuccuuugguagauuaucagaaguagaauuacuuaggagaugaguauuuauuuucaagacuuuucaaaccuaucuccaaaucacuuuuuaaaaagguuauagcaauuuauguucccaccaacagcacacaagaguccucguucccugcacccuugcucacauuaucaucauugaaauacuucuuugcuauuuuggcaggcaaauaaugauguaucauuuucaucuuugauuacuaaugagguucacuuuuuuuuguuguuuauuaggcauuuaguguccugguuuuuaaauuuucugcaaguauauccugacuucuguggccccauuuugcauugcuuugaaguuauaaggaauaugucuuauuuuuacuuauugacuuauuuuuacucagcugcuggugcuggagccuagucccuauguucaggcucagggaugguucugcacaguggcuuuugcucccagccuaccugcuagccuacccauugucuagaagauaaaagcuucauuuaggagucaucucccaaaugcauuuaaaauaaaucaguuaaagcacagaauaguaauuuucuucugagcacacagaauuaaaguuuuauuuucacagagcucgcucacuuuuguuccuaauaaaugacugguuucaaaaggcuuccauaaauacccguuuuauccacccuuauaagcccacagauaugcugcaggguucugcuguguucauggaaaccauaaggcuucaugguaucugcaguauuugcccaaaaaaauacugauaacccaaggaugggacuccauucccaaagggcagggaggaaggggaggggcauuucagugaauuuuaauaugcagaucauccguuuccuaauggaguucaugcuucaccuuagagcugaaaaagcaagacuuacuuucgcuaagaaaggaaagacugaacgaugcacaugacuucuggaacauuuccuuaaguuugguaaagagggcacgcacagugcccggcagcaccgccucuaacuuguggagauggcccauccuucuggcccuucugggccuccuguaauuaauccccaucgcaguuaaacaaggggccgcgugguugccuucucugauaugcucuuccagagagacuuccccacggggcauuuacauccucccaggacuuguuuuauggaaauugcuguguucgcuucaguuuuucguuuucuguguuacaacgguuuuggcauuuguugccuugcaugaauuucuccgcaugacgugacagucugcugccugaauucaguauguccacgucaccuguucacgucaucuggccugagucuggcugcacugauguuucucauuaguguuacucugugcucauacccucagcauuuugagacccccucaaggauuaugcuuuucuuucuacuuucagccugaucauuuaagcuaagcacauugauacauugcuucuggugauaaauagcugacuuugugauuucauuuauucuaauguguaagucuccauuguguaacugguuugaccugcagaaaauugauuucagcaccuacuagguucaccuaggcugauauaggccucuucuucagcgggaaaagcuccuccucucaaggggaagaguccgggucagcgacugcaucagggucaauugugggcagaguacuucgaagccucuucuuccucacccucuuccagcuuucucugaugacugcaagcguagaggaaagugaaucucuaccuuguguuggucaucagaaguggcuucagauuccuuagaggaagaguuaaaaugugcaucuggaugagggguaaagaaaugaggucagccaguaaguaccugucuuauaguccuagaguacagccuccacacccagcuuugccauucacuccuucagagagugaaaccucuaagccucaguuucacugccuguaaaguggcacaggaagagaaauuugugugugauugaaagaggucguauucuauuaaagugacaguguuguuauuaagacgauuauccacgggacacaucucauugucauaaggaguagacaagauacaaaggcagccuuucuugagcugaaugguaugccaaauauuuauauguuucaaaaguucacaaauuuugccauuuuacuaaucauugccucaauggaaaacaagcauuauuuagcuguuucccugaacaccaacuuggaaucuaaaucucagcaauuaucaucauucacaaauaauuuauauuucugggcaaauggaagauaucauaucaucauuauuguguuuguucaauuugaguaaugcguccuucgaggacucauuuggaaguagauauguguacuauagguauaaaauggauuggagaaaauauuggauuuuaacauuucacuguaaagccuguauuccaaauuaauauaaaagacauuuaggcauucugauauauugcugguaaaaggagaguuaguaaaagaaugcaauuugagagcucauuuaauagagaaaaaauagggacaugucucaaaguguguuucaugcuauaauuuuaccaaacuuguacuggcuuaaugggaaaaaauauauauccuguguuucuuaaaaugucauuaacuuagggggcaauauuuaaaagcaaggaaggcuuuacaauguuguuagcuacaaagccuagcagugagcaauugcaguuaauggcaacagaacugccuagcucacaacccgccaccaaagcaaacacccuucagggcacgcaaacaaacgugugcacacccacguccacacacauacuggcugccuccauuugcaacagccggagagacguuucagcuuuggcccuuuaccuuccccauucuugauuuucuguguugcuuucuuuuuuccuccuucuuuuccuuuccacccagcuccgucuggucugagaaacucccagcucucccacuugacauucugaugagcccacauuccuccuguccuucuucucggggaggagaauugggccauaacucauuguggaguuguggugauugccuccacaucgggcacagggggauacaggcugauuuugagaaauuagaggccuuucuuugccauggcccaagaggagaggcugcacacacauuuugccggauaauaagggcagcaaguuuccaagagagcacaaaacagaaguucccaugauuuccauccugucuuuaauuuucuuguauuuaaugcaaaaguauuucaagcuuauuuuuccagucuggacaacccuguaucaggaaacacuugagguauuaauaguuagagagaauaaaauacagcccugagugugagugcaccaguguuucucauucauguuacuguguacucauguccucagcauugugagacccccucaaggguuuugcuuuucuuucuacuuucaacuugauauucuaaggacccccuaccaaaaaacauuccugagguuggaagugacccaugccuuaugcugaucuucccugagagaggggcagcagaacccagggcucccugcccaugccccguugcuucucccugacaguuucaagucccagaaucugggaugauuucggcuuuucccaugaguguugcucugucucaucuaauucuaucuuuugauucauuuacagggaaacuucguggcuugcaugacagcuauuuuacgacaaauggaagauuaccauuaugcccacuugaucaagacuuuugggaaaaugaggacugaugugguaguaagugucccuuucacccuguucacauaaccauguuuuagggccagcacuuuagacaaaagccugauaucaauauauucauuuaaaauaggauuuugcaugagaacuugucucugauugauuucaaaugccuccugggaaggucugacugaagccuuguuucuaacaagacaaggguccggacuugcagacuugcuucuagggcugaauggagaaugacucaggggcugagcccagggaaaucucuugucuuucuuggugacaguuucuucuccugugcuuugggauaauuggaaauuuggagauguuauccauggauagucucccauuaacuccuauucauuuauugguugacuuuuuaauagcagaagccagagugacuuuucagcuuuaaguuguacuccauuauuaauuagcuguaaucauggaagcucaucagcauuucuccaaauaauucucuagucauccucaguaaaacuaugauacaacuuaauuaggaaaaguauaacagaggggaauuuauugcuuaugaacuaccucccuaaugaccugaaauuacauugccauauggcaaauauccucugcaaagcugcaaccaaacuuguuggcagacuuugugauuacauguugacuugaacucuaagauuccauuucuaaggaucuguaagguccuguagaacaggguccccaaucccugggccacacagcaggaggugaguggugggcaagggagcauuagugccugagcucugccuccugucauaucaguggcugcauuagauucuaauaagaguacgaacgcuauugugaacugugcaugcgaaggaucuagguugcaugcuccuuaugagaaucuaaugccugaugaucugagguggaacaguuucaucccgaaaccugccccaccacccccugguccauggaaaaauuaucuuccacgaaacugaucccuggugccaaaaaggauggggaccgcuguaaaagaauacucauagauaccugcagaacauggcaguguacuaguguuucuagaacagggguuguugcacuugacauguaccuuauuaagaaaugggaagaagagaaugaucuguaugaguuuuuucaaaggauuauuucuaauacauaauuuucuuauuguugccacuauauauauaaugcauaguuuucuuauauaucuauaguggcagcaauaagcaaauuauguauuagaaaugauccuuugaaaaaauaauauuuuuauacuuauauauacauauauauacacauauguacauauauacacacauauauacauauauauauacauguacauauauauauacacacacacacacacacacacacacacacgcagucguguguugcuuaacaauucugccaaaugcaucguuaggcaauuucaucauugugcaagccucauaguguguacccuuacuuaaaccuggaugguggagccugcuacacaccuaggcuagauggucuagccuguugcuccgaggcuacacaccuguacagcaugugacugcacugaauacuauaggcaguuguaauacaauggcuaugaugucacuaggugauaagaaguuucaguuccauuacaauuuuuggaccacugacauauacacagucugucauugaccaaaauguuauuacgcagcacgugacuguacuucaagauuucuaaggagaacaaaaauggaucuagaccuuaaagcucuagcaguuuccucuaaauaaaaguaagggaacaagaauauguauauguuuguauuucugugucugguuuucccugaauauuaauaaguaguugauaguaggaguauauucaaauguguaaccuguauccuguuuauaucccaugacucuuuggaaaucauggcauagcgaaaucaaauuuuacauuuguaacauuuuauuccauaauugaaucuaaacuacacccgacccccugcuuuggucaguguaaagcauaguuguagcuuaaagcuagaggaacaguuuugcagauaacguuccagguugaauaauaaagucuucagaaauagaagaauuacucaccuggaaaagucaggacuccaauuaguacuuugcccuuuuucagaacaaucacuucauaaaaguccccacgugcaaacauguaaucugaacuauuaagugcuguaauugauaaggauccuucaagguaagugaaaagcgaugaugccgaauggcauuuaaaaauuacuguagcuugcugaauuccaagugugugcccucugucuuugcucacaucccaggaucagauguuuacuguguguuguggucccaauuucccaggggauguuuuuccauagacacaacaguuuagaaaaaucaaugauuuguagacaauuugacuuccauuaagaaaugauguuggccgggcgugguggcucacgccuguaaucccagcacuuugggagguggaggcaggugggucaccugaggucaggaguucgagaacaaccuggccaacauggcaaaaccccgucuccacuaaaaauauaaaaauuagccaggcaugguuggggggcaccuguaaucccagcuacuggggaggcugaagcaggagaauggcuggaacccgggaggcagagguugcagugagccgagaucgggccacugcauucuagcuugggcgacacagugagacuccgucucaaaaaaaaaaaaaaaaaaaaaaaaaaaaaaaugacguuugugguuuuuuauaccacaaauuuagacuggaaaguaugugaacuuuuuuacuguuguuaaucugacagaacuuuuguaaaauguguuucuguuuguuaacuauaccgaguauaugacuguuuuucaacucugacaacgauuuuuuuuuugagacagaguuucacucuuguugcccaggcuggaguacaauggugcaaucucggcucaccacaaccuccuccuccaggguucaagcgauucuccugcuucagccucccgaguagcugggauuacaggcaugcaccaccacacccggcuaauuuuuuuuguauuuuuuaguagagaugggguuucucuauguuggucaggcuggucuccaacucccaaccucaggugauccucccgccucggccucccaaauggccucccaaagugcugggauuacaggcaugagccaccacgcccggcuuacucugacaacuauuaaauaaaagauuauuuuguacagaauuauuugauguuauuucguauuucaauaugaaaguggccaaaacacuuuccauuuuuuuuuaaauuuuauuauuauuauacuuuaaguuuuaguguacaugugcacaaugugcagguuaguuacauauguauacaugugccaugcuggugugcugcacccaauaacucgucauuuagaauuagguauaacuccuaaugcuaucccuccccccuccccccaccccacaagagaccccagagugugauguuccccuuccuguguccauguguucucauuguucaauucccaccuaugagugagaacaugcgguguuugguuuuuuguccuugcaauaguuuacugagaaugaugauuuccaauuucauccaugucccuacaaaggacaugaacucauccuuuuuuauggcugcauaguauuccaugguguauaugugccacauuuucuuaauccagucuaucauuguugggcauuuggguugguuccaagucuuugcuauugugaauagugccacaauaaacauacgugugcaugugucuuuauagcagcaugauuuauaguccuuuggguauauacccaguaaugggauggcugggucaaaugguauuucuaguucuagaucccugaggaucuagaagccacacugacuuccacauugguugaacuaguuuacagucccaccaacaguguaaaaguguuccuauuucuccacauccucuccaacaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuuuaaauuuguuugaguucauuguagauucuggauauuagcccuuugucagaugaguagguugcaaaaauuuucucccauuuuuuagguugccuuuucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaauguuuaagucuuuaauccaucuugaauuaauuuuuguauaagguguaaggaaggguuccaguuucagcuuucuacauauggcuagccaguuuucccagcaccauuuauuaaauagggaauccuuuccccauugcuuguuuuucucagguuugucaaagaucagguaguuguagauaugugguguuauuucugagggcucuguucuguuccauugaucuauaucucuguuuugguaccaguaccaugcuguuuugguuacuguagccuuguaguguaguuugaagucagguagugugaugccuccagcuuuguucuuuuggcuuaggauugauuuggcgaugcgggcucuuuuuugguucuauuuucuugagacuauuuccuuuuaacaaguacuaauucagguucucaaauuuagcccuuuuugguugagugagucauuuucauacaaaaucacacuuacuaucaacaccagugacagugagcauauagagcacaagcggaaugacugauccagaagagaaaaacaauagacauguucagcucagaacucugaggacagagaccaucccaacccuuuuggauucgaaccacaaagaaucuguagaaucuucuacacuggagaugcugaccugcccaaggggcugcuggcugccacguguccacgucucaguaacagaagcagagaaugugccccgauucucuguaguuagcuagaagggaacaaugacggcuuugguacuucuagcggagaauguugucuugccacuugucacaaauucccacucuguggcuuuggaaaacacacuacauuuuccuacacucucacacuucugugaccagaagugugugggucucucccaccgcaucccauucccugacaccagcuggauguccuacaauucaauucaauucugacaccaucuaccuggaguuagcaucagauucugcaaggaaaagggcuuaucugaccuuacucagauuucaccaguguuuuacuuauucucuuuccacuguggaucacaaaaaauuuuacaaauacagaaaagcugaaagaauaauacaauggagccaggcucaguggcucaugccuguaaucccagcacuuugggaggucgaagcagaaagaucuauugagcccagaaauucaagaccagccugugccacauagugagaccccauuucuacaaaaaauauaaaaaaauagccagguaugauagcuuaugccuguagucucagcuacuugggaggcugaggcaggaggaucacuuuagccuaggaguuugaggcugcggugagcuaagauuaugccacugcacuccagccugggugauagcaugagacccugucucaaaaaaaaaaaaaaaaaaaggaaaccaugauuccugccaccucaauucauccguugaaagcacguuggcauauuugcuuccgucaugugucuccaagugucucuaucuauacagccaaccccuuucagucagugagagacagggaugcaccugcccuaagcuguucagcaaacgucucuggggacuaaagacauucucuauuggucauauugcuccaugagaauucagcaacaaccccucaugccauuuguauucagauuuccuccauucuuuccaaauuuuuuuguccuuuucacgcauugcauuugaugauugugucucuuuaaucuuucuuuuucuaaaauaaauccaucaccaucacacuguuuuauuuucuuuucauagcauugcuuuucaguuuuuuugaagagaccaauccauuagcuuuuguagacuaucucccauucuggacuuuuuuugugcugccuuguaauaugccuuucgacugguuucuuuaucccccuguauguucugcaaaccagaagcuuguucugagauucaagcucaacuccuuggcaagaguguuucagcauugcugucgaaagcuuccugcuguguuacuucaggaaguaacacaggaagugggcuugucaugcugacccacuacuggcgaugcugaauuucaccacuggguucaaagcugguaacuuccagaucccuccauugugaaaguauguaccucuuccuaccuuugcaauugucagauaaucuuuggauaaaacuuugaauccacaaaaauguggccauguccuauuucccuaacaauccuucaucggauggguugaaaaucuguggcugguccuuguccauaaugguuacuccuuuggcugagcagaauggaaauuuccuaagucuaagagugaagaugcuuugucuuuagucuaagagcauugggaagccauuggggaaauggguucagugugaugucuggaaagcauugaugccuugaugagauuugucauuugaaaagugaagcauggggacaagaaaggacaaggauggaccuaaguugauggauuuggaguccccuguggcaguccaggugcgagaggauggcuguuuuauucuagugggugggcacagggauggaaaggugcagacagagguaugacacgauuuugccucugaagcagauggauggcugcuauuagagcagccugcuuauuguauaagacauccugugaauagucaaacuaaaacaugcagccgggcacaguggcuuacaccuguaaucccaacacuuugggaggccgaggcaggaggauuccuugagcccaggaguucaagaccagccuggguaauauagcaagaugccauuucuacuaaaaauaaaaaaacuagccaggcauggugaugcacaccuguggucccaggauacucaggauacugaaacgggaggaucacuugggucccaggguugaagcuacagugaacuaagaucgugccacuguacuccagccugggugagggaaugaaauaaauaaauaaaauaaauagaaacuaaaacaaaaaaugcaacaggaauaaauccacauugaaugaugaaauuuucacaaaauaucccuuguugacuuggagacccuaguggaacaguccgguaagccucaucagcugcucaaggcaaacacaguuguuaggggccaccgccauggcuagugaauuaugcagaaaacaaggacgccuugcagaaccucaucucccacuagaugcagcauuuuguuugaucagcaaaguaccaaaauuuaacagcugagccauacuaaugaaguaugggacugugucucuuagaaaagaaagagaauugggaaaauaugcuucucuuccagaauaauaaaaacgagaggcuguagcucaauuauuaggcuuugagaaguaaucaucaagaaagccagcaauuucaugcaaauagagaugugacugaauuacgguacucagccuacaaaauaugcagccuggucguuaaaaugggaaacucuugacaaagugaggaaacucaguagugaaauaugaauuucaauaauuaaacuggaaaagaagccauuuguugugucggaagggaggacugggaugcucccgcuccugagagcagguggacacagugcccacguacagaguuuggaggacaucuggacugacuuuuccaacuugauuuugucugggucacuaaugucuccuagacuggaggcaucugcucuaauagagugaucaggaucacucauuuuauuuauggugggggcacaccaaacuccucacacuacagacuucaccugcuaggaccugacuuugccauuagaguuggagagaaaguaucuuaacuuugaacauuagcuuguuagugucaucaauuuuaacuugugccucuuugcaggagcugcuuauuuagaacuucguacugggaauugcuuucuuggcugcuuaaauucuguucaccaccuuggccuucacagccauugcaccuaauuaugauucaggagauuaaauaaaugagaaauauccacucauuuggcaaucccugaccauggccucauuuuucuaagacaguucucgguugucuuuucauuuccuaccuugaguguugagugagcuuggggcuaccagggaugugugcuuuuugggauagccacuuguuuuguucagguuagcucagagcaccugucaagcucuggaaaguaggaaaccuucuaauucugauagacacauacuggagucccuaggaaccggcuaccccuuccugaugucaggcacauuccauggaagcaggguagagcagcuggguguguacggaacccugcuucuuuucaguugcccugcgaaguacacagcaucaucuaagacaucagaagcauaacucgguagcuuuuggggauguagcugccaucuaggagaguuuggcaacacggcugcacacucaaaugguuuauugcaugccaaaucugugcagauggucaggaguaccuguuggagccuuucguuuugaaauuccguaagagaaaggaacagacaguaguaucccguauucaaucugauguguccuguucaucaugaaaaauugauuuagagcaaacauaagaaaaagcuguaaccugcaagccuuguuuguuaaaaucauguuuuccuagaagcagaaagggcuugaaugccuauuccuaaccuuuggggauuuacucuuuaacuauuagagagacaugcucagggacuguuucagaauauauucuugaagaagccgucucagacaggaggugcucagguaaacagaaagacaggucuaauucacagcuccuaugaaauauaucuucauuacuuuucaggauguguucauucagccuuuaaaaugggguauuuuauaaucuaauugacaggaggguaucauguuuaccuuuuucuuugugggccauuucaguguuuuguuuuuuuauuucaggauuuccuaauggaaacauucaucauguuuaagaaccucauuggaaagaacguuuaccccuucgacugggugaucaugaacauggugcaaaauaaguaaguguggggaaaacggcucucaccuuuucuauggcucccaauucaugucugcugggaacagugguguugccuggagaccaagcuggcuucaauaaaaugcucugcaaacgcuguuccuaauucugugcugcagacaguucuagggagacagggacucugaguuuguggugacuuccuuaugacaacacagggcucuggcucuaagaacuugagcuccguccccuggagaaaaacagccugaagcuggaucuccccuagcugucaucaugggcacagggguucugcucgacgucgcucugcgcucucauguuacccacauauuuguaucagcccuaggcacugucagcuccaugcaagaggcuuuugcaaaguguugacauuucacauauuucaguuuuuuuaaucaugagcauuuucuucauacucauuaaauauugaacuugugccuuguuuauaaucuccagugagggcuguugguuaauuuucuagcacauuggguuuuaucauuucuguaagcacuaacaaugaccauagaauucucaaucacgugggauuuuuaaaaagaacuuucuguucaucucuguuuuucuuucucauugcaauuuuuauggagauaauuguggguucaugugcaguuguaggaagucauagagaucuuguguauaagggagucgaugaugcgauucacugaucuuacucagauuuccucaguuuaauuuguauucauuaguguuuguguugaguuguguaguuucagcacaugcauauacuguggacuccaccaccaccgugaagccacugaguguuuccaucaccacaaauguuccucuuguugcccaauuauacccacauauaccucuccccuccccacuccaccauccguaagcucucucgaccacucauucguucuucauuuguauaauugcuucauuucaaaaauguuacauaaguguaaucauacaguauauaagcuuucagcauggcuguuuucacuuugcuuaauucacuggagauccauuuagguuguugccuguaucaauagcuuauuccuuuuuauugcuggguagugucccaugguacgccuggaccaagugugaugaaccauuuuccuguugaaggacgucugggcuauccccaguuuguggcucuuacgaauaaagcugccaccagccuucgugcaucaguuuuugggugaacaugaguucgguucuguggcauaaaugccuuccuggacaaaugcuggcuuguuggguaauugcacauuucgugacguaggaaacugccaaucuauggcuguaccauuuuacguucccaccagccauguaagugauucgguugcuccgcauccagccuuugccguugacacuguuuuugcuuuuagccaugcugauagguguguaguguaucucccuaggauguuaaauugaauuuccugugauggcuuugccucucuuuaaugccuauuguccuucccuucgacaaauccaaagcagcacgaccuuuccuuuggccuccucuggguuuuucugcuuucuggggcagcagagacagauuggccuuguguaccguggcugcgggaguccuacaaaccuccccgagggguaagcaugagggagggagugauguucaccccgcgucagauguuacugagcuggaagucuccuuccacacaucaaagauggcaucugagaguagauggugaggaagccccggagacccuggcauugcuguagccuuagcucuggcccggggagcagagugggggucuugaccucugcuccuccucacucuuccaccugcugggugacuuuaaauuauuccuguggccuucucucagcuucucagucgucaucuagaaaaugguggacuuaauagaaagcacuggucuuuucccuuuuucucuguuaggaugaacuuuugugauugacagucuagauuuccucugaagagcucuagagcguugugucuuuaauggcuguauuuugcacauagugaaaacaagcaaacacaucagcaacaauaaucaaaaaccccgcuguccuggagccauagaucucaugacaucauuggccaggagcagagguguggcugagcaggcgccugagcacaggguguggaggcggcccguguggaugcugcucuccaccucuugacuccucuacguguagaccugaccuucugggucucccagcagagcagcacguccuggcucucaggcuguggauuccguggcccugggugagcacugcucugacaaaggucaggcgggaugggcucccugaaguugcauucaugucgcuccuacuccgagggucucccguuuaggagggaauagucaaaaucuacuuaguucaugauuuuuuuuuuuuuuuuuuauaauugagagccuguuuucaguuggaacaucauagccgcaucauucucucuuccuacuucacugucuuccuccugccgccaacccugcgcuacguaaggguugcugcagcacuggccgugaugcaaagccacacaguaaguggucuggggcucaacccugggagugcuaugguucugguuuccuucuccagagacccuguccagcuucuccugggauauucuguuguuucuggggugagcagguggcuugauccacauuccuuggaaucaugaauuugcugcaaaccaguggcaaccuucccuggccagcaccccuacucacuagagccccuucacaggguauggcgccugacagagguacccgcgcugcagcagcagguugguacaguggcauuuuggaccaaagccuuugcgucuuagaaaccgggaagagagucuuuuguuuugaggacagggaaacucuggggagaagccacagugcucaguguccucucagcaguugauuggaugagacuucugaggauaaagucuaccuuggugauaauaaaguccaccuuguucucuuguucaucguguacacggacugcagcuggaaagacgucuugacaagggaagcagccugaauguaaaaucccuacaguuuauuuucuguuuuacauaaaauguuauccugaaccuucuaaucaaggauuccaguacugugaggccaggucguugagcaguguuuccuccaugggagcuuccugcagagaagugaugugugccuguguguguacccaugcucaucuguguguguaccugcaugugugugcaugugggugugcguguguguacccgugcucaucugugugugucccugcaugugugugcauguggguguguguguacucgugcucaucuguguguccuugcaugugugugcgugugggugugcauguguguacccgugcucaucugugugugugcauguggguguguguguguacccgugcucaucugugugucccugcaugugugugcaugggugugcguguguguacccgugcucaucugugugugugcauguguguguguguguacccgugcucaucuguguaccugcacgugugugcauguggguguguguguguacccgugcucaucugugugugugcauguggguguguguguguguacccgugcucauguguguguaccugcaugugugugcaugugggugucuguauguguguacccgugcucaugugugugugcauguggguguguguguaccugugcucaucuguguguguaccugcaugugugugcaugugugugugccugcaugugugugcguguguacccgugcucaucugugugugucccugcaugugugugcaugcggguguguguguguaccugcaugugugugcaugugggugugcguguguguaccugcaugugugugcaugugggugugugugugugccugcaugugugugcaugugggugugugugugugugccugcaugugugugcaugugggugugcguguguguacccgugcucaucugugugugugcauguggguguguguguaccugcaugugugugcauguggguguguguguacccaugcucaucuguguguguaccugcaugugugugcgugugugugugccugcauguacccgugcucaucugugugugugcauguggguguguguguaccugcaugugugugcauguggguguguguguacccgugcucaucuguguguguaccugcaugugugugcaugugggugugugccugcauguacccgugcucaucugugugugugcauguguaccugcaugugugugcauguggguguguguguaccugcaugugugugcaugugggugugcguguaccugcaugugugugcaugugggugugcguguguguacccgugcucaucugugugugugcauguggguguguguguguguaccugcaugugugugcauguggguguggguguguaccugcauugugugcaugugggugugcguguguguaccugcaugugggugugcguguguguacccgugcucaucugugugugugcauguguguguguacccgugcucaucugugugcauguggguguguguguguguacccgugcuccucugugugcauguggguguguguguguacccaugcucaucuguuuguguaccugcaugugugugcauguguguguguguguguaccugugcucuucugugugugugcauguggguguguguguguacccgugcuccucugugugcauguggguguguguguguguacccgugcucgucuguguguguaccuguaugugugugcauguggguguguguguguguguacccgugcucaucugugugugugcguguguguguguguguacccgugcucaucuguguguguaccugcaugugugugcauguggcuguguguguguaccugugugcugagguguugguuucaaguaaagacacuuuuauuugcagagauucuuacucucagaagcucaaacaaacccauauuccuaucccaguugacacauucagcagaaacaagcucccaagcccacacagcacaagagucagccaccgaggaggcauuuuagguccugauuggaguuggucacugauaacuguaacuuuuauucccacauccuucugcccccauaugcugcccuuuguguugaauaaacaacaugaauguuuagaagcuggaucagguggguuuuugaagaagguuauugccuucaugugguaagauacuugaaacugucuggagacagcuuguugagagacccuuaaguauucuuugacaccuuugcuucaauaccagcuucaaaaugaaggguuugcaucacuuucccuguacauucccauucuuugugaggcauugcacguuugcguucuggagcugagagugagcuaacauugggcaugccucccagcaccaggcacugcuguggggaugucacgugccaucacguccuucauacccucagcagcccucugggacagcugcuguguuuaggcccacuuuacacaugggaaaauugaggcauggagguugggucacgugccaaaagacagagagcugggcgguguuagugccaaaauuuaaccccagagcauccaccccagagccgugccugagccaccuagcuacccugccucuuggucuuaaguaggucuccuauuucccaagagaguguuaggaguuuuuguuuugucuuuauucgaguguccauaaaacauaacaacuuuuccacaagguuuacugcuuacgugagugaauuuugaguguggaauucauuacauugcuacuuacuuucuucaccuuuagaaguguaugcaccauuuaucaauguguuuuauaagagcgaaucuuacugugcagucuagaaaaaucacgucucccuagcauugucauaaaguaauccucuuauggaaauugcagauaccauauucuaugucuuuaucuaccugccauauauguguauauauagauugccucuuacuagauuggugauauaacuuguaaaucaagaaucaaaauuacaggauuuaaugacuaucccaaaguacgguguucacuugguuauguccaagaugggaacugauaggcgauggccugacauuauagcugugcucuaggauaugagaguaccagauggcaagaugacauuuaagaugagcacagcacagaaacaguagaagugugcuuuugugcuagcacccagaagugcuuuauaaucuucccagaggggagcagcugcuaagguuucacugaagcucucagguucuguuggaagcacagaccuuucccuguuggcaccuacaugcugguauccauccuggaacucuuauuagcugacuugcucggauucacgcuuugugugugcagcauagucuaaauggccagcaaucauaccauggcuaucauagaauucuccuugguuguuaaugagaaugugaccacuugcuugaauuuuugugucucuucuagucuuaggguuugccuucgugcuccaguagggugcuugaguuuauguacuaauaaccccuacuagaauuuuaagugauaggaaugaccugguaggaagugagucugccagguaaaccgaaucccuuugucaccucgaagaaaccguuucuuauuaacugcuuuacuuuugcuugagaaaggcauuucuacaacauguggugggugagagagaggccaguacugaauguaauuuucccuauuuuggaauuagacuuucuuguucguauugacuacauagcguguaacaaaaccuuauccacaguugucagcuacugagacuuguaacggaauuuuuaaaaauucaacuacuccagcucacagcuucccuaguccucccugccuacuguacccucugcucucaggauaauaaagacaugaaaccagcauuugcauuuccucagagcuaguguaguuugcaacugugauuaucaaucgcuuccaggcauuccucucuguuggcauagguuuuguguuugagacuuccuguucuuuuucaggcuaggcugggaccuacgggaaauaaugauuaguguuuugaagcccacacacuuucauagaggacuugguaugucuugcaaguaaagguucauauaacaugaauauaaaauagaauauguaaaauuguagagaaaacgaugcuuucuagaaguugaaauacucaaagcugacugcaggauaaaacauaaaggcaaauaagacgguugccggguucucacugguuggugaaaaugauccuugccauuuaucacgggaagcuggcaguuuacaauguagauuuuuuuuuuuuccaagacagggucucacucuguuguccaggcuggagugcaguggcaggaucauggcucacugcagccuuuaacuacuggguucaagcaauccucccagcugagcuucccagguagcugggacuaccgacacauaccaccgugcccagcuaauuuuuuguggguuuauuuucuuggagagaugggguuucgccauauggcgcaggcuggucucgaacuccugggcucaagugauccacccgccuuguccucccaaagugcugggauuacaggcaugagccaccacacccggccaugauguagaucuuuauauaggagacacugaacaggagaagaucauagggaaggaaucaguugagaauucaaaauucugcccauagaaaacagaagagauuauucucucaguuaggaaaugcguaagauguuaccagucagcauguugguuauaacagugguugguuauaauuggacuugucugaaagacuagcucaucaaaugaaggggauuuagcugaccugauccauucagucuugucuagucguugaccauuucaacaucagagauugucagucaaaaacuauuguuugguuuuguucuaucugcaaucaauuaaucuuauacuuguccuuucaaacuuugaaauuucaucccgauuuggaguuugugagaucauguugcuauuuauuuccagugucuguguguuacacauuaaaaaaaaaaaaucauggccauauggagaccaucccaaacagaucaggaugaugcuugcagucugcaaaggauggaggauuuugaucucuugaccucauuuugacaaccaccuuggcucauuucucuguggccucuccuccucuccccaugauucauccuucuuucaaccaggaaguguuuuccucaauccauugacguagcauauuacauuuucaccagccugccauauaugaugucuauggacaccucauaaucacaugcagcuccuuucaugaggaaaaucguccaugcuuauuucuguaacuuaacaauuucucccuuuuuaaauagaaugcauuuccucacuuauaaguauuaucuaccagauguaucagaguccaggauggcaagcucucugcuauuucugccaaaauuaauuuggcuuauagucaggacaggaaagggccuuaagcccuagaaagggauuccaccuuggagaugccaguuccuuaaggauaagucguguuggugcucagaaggcaaauuugcaggguaggcuguuuguagguacuuugccauuugcuuucguugccgugaaggaauuugagucguugaccacacugagcugagggcuuggaucaggggaaaggcaccgcuugccuuaggaugggagagagggaaaaauuagugcccacgugcagggggccugcccccaggaccauggcaccaguggcaaccuguggauggccaagucaggaggacugcguguuuucuuuccuguucuaccuccguccagagaagcaccucugcaucccaauuaagggugcauaguugaauauucuuugugcagguugaaaucaugguuauaaagcauuuggggcuugagaaacucuuggauuauuacuucuuaacaucuuuuuuccuuucuuugaagccuggauuuuaguugauguugugacuucucauuuaauuuauuuuuaauauuuauuggcuuacuauugagguuuugcacagccaauggcuugaugauuuuaggcacacuuuagaauuauuuuuuuccuuugaaacaguauacagcaguuguugacagcaaaacacaacuagcuaaguaccaaaacacacacacacacacacacacacacauauauauagacuguacugacuauacauuuugcuuugcacugagagauguuucaugcauaaaauagagagggcacuuggcuuugguccucauaacaugaagugccuccucuggcauuaagugccaguggaauguggcauuaacgccagccaggugcucacgaugagaugugcauggucucugagaauuuggggugaaaaaaauagcaauugaaacucaguauagugaaaacauucuggaaugaagauuucccuagaguucuccauaccugcauuuuacuacagcucaugcacuuaauaauauugcucuuugagccuucuuccucuccaagaaaacuggccuaaccugagacauuucacagcccagaguccccaguuugcaggcaccagggccacaguucuccuuccuaggcugguuaacuugggcuguaccugagugcauuucuggcaagucacccagagaaacacaugagacuuuucugggggcuguguuggccauugugaugcaucaggauuucaagacagauacugacuuggauccaguaaugaugcucuggacccuccagcaggaaaaggaccccacuggggcuacauugcuaugucuaucauuuuaguuuuaucuccagagguugcuuuuagaggggacacagggacauuggcaguucucucucagcagcuuuugggccuagauaugguugcagaugguguaucagagcccacugcaccuugggauggaaacugaccuacgaccaaaugcuaccuguucgaguucuguucauucuuaaggccuagucauaaauuauuucagauacuuuccauaacaguuauucuauuucaugucugcuuuugcucuuugcuuaauaacuaaaacaaauaauuuccagaguuuuaccugguuguuuauaaccaauguauugcacauagccuagauauuuuaaacugugucgucuuauucagauugccuguuuuaaauuuuaauucagagaugaaaaaucaaccuacucucaaaggaguggcagugaugaagagcucucagcaggacucuuauuuagggaagcuugcuuuaaaggaaaguuugaaaagggcaaagucuguuuaagaauucucagagaucacgcgcaccucgucgggagugccuggcugguacugaugccgcaucccgcuggcacuuaaugccggaggaggcacuucauguuacgaggaccgaagccaagugcccucucuauuuuaugcaugaaacaucucuccgcacaaagcaaaauggaggagauacacuuuauuaugauccuccucccgguccucucaugcuaaguuuuaaccuccugugcuacugggacuuggaagaaggucugugcaguauaggacccucugguguggugcuuuuacgucuagaacaggaggaagaggcagccaagugaacugaguccucgcaggcuugccaggcugugucuuccgugucuuuuugauaguucucaaugaaggacaguuguuuccccuagaggaaaaucgacaauguccagacacguuguugucacaacuugggaagagagggcugcuggcauuuaguggguagaaaccagggaugcuacuaaacaucuuuucaugcacgagacagcccccugccgcaaagagucauuucauccauaaugucacuagugucuccaugugauagaugaaaaaacagaguccagagucucagugaugcucaguaacuguuagaaauacauagaaauaugugugcaguggcucaugccuguaaucccagcacuuugggaggccgagggaguucgagaccagccugaccaauauggugaaacccugucuguacuaaaaauacaaaaaaaaaucagccaggcaugguggcaugugcauguagccccagcuacucaggaggcugagacaggagaauuccuucaacccaggaggcggagguugcagugagccgagaucgugccacugcacuccauccagccugggugacagaccgagacuccaccucaaaaaaaaaaaaaaaaaaagaagaggaaagaaagaaagaaauauaugugauuuauugcagugacucucuucuccuuguuuccccauuucucagccacccuucucugccaugugaccucagccaaaccagcgcccucuagaacaaauaauagcagcuagcugcugaagauaggacuggucuucacuuauuagggggguguccgagaauuggaggugguuuccccaagucgcucugccaggggcuccagugucuuugcaggagauuuuugugggcuuugauuuggggugguguuugggagcaagauggcauuggaaucacagugacaugaauguacaugccagggcugccuccaguccugccuggcaugugggacacacguugaaaauauuagcaagagccuguucucagggugcuugggcugccagccucuacaccccaauucugccgagccuggggugaaagaguagccacaggccuuuccucucuaccucucccagccagaggccaccuucaguacaaggguuggaagcugagcccuggagucaguuugucaggucaaauccgugcuccaccacuuaugagcuuuguaaauuuaguguugggcagauuuaccccgugcuguaguuucuucacccguaaauuagagacagaagucaagccucgcuggaguguuuugggggaauaaaugagaaagcgcauguggggugcuuuguucagagccugaccuccagugaccuugcaacaagccaugucugugacccccuccauuuuuaugaagaugacaugauagugugucauugucccucugaaucugagaauugagcccacagguaagggugugaagcauagacauugcccuggagauucagagcacuuuguacauguauugagaaauuacauuauaaaaaaauacaauucuuugcuuucauagauucacucucuucuugugaggauauuuguauauauucaaauugcgguuucccuugauuuauagguaauuaagucaacccauuuugcuugcuguuuuccuagaagcagcauuugugaauugcuuuaugugacauggcugacacucugucaagcauaggucuugugcaguugucucuguucagaagccagucaccaaaauggugguccugucugcccuggcaucuuggaaggacagagcugcaguccccagagaggauccuguguugucccucaugugcagaugagguucugagauucagggggguugaaugaguggcuccgggcccccugugugaguagcaggagagacugcagaacugguugcucuuaagccacauccaaggccaggcacauaaaauguggacagugacgcccaccacccaugcaguccuugggaagccccguuggcauaacgagaauagagagcuugacgaggagguccucagugaaugaaugccagcuccugaccacgcucaguuuugguaacaguaaguggcacugucuacagagccucucaggaaccggggacuccaccugccuccucuccuucucccacccucagagccaaucauacacaggacccaguggauaggacuggaguuccggaagccagcuccccagcgccuccuccgagcugccauccuucucuccuguggcaggggugucuuccucugaaaucaguguccaucucaguccuggccgcaccuccacaggcucccgaugucuggcaagaaaagcuaagcagggacuuccaaacguguuugaacaaaacuccaaugaagaaaaacauuuccaaucacugcucgaugcacuucccacccccaucaagguguaacucagcgagaauuccuuacugugcagagcccuccgauguuuuuauucuguucuguucuguucuauuccaucccauccauucuaucccuuuucacuuaauaaguaaauaaauacaauuucacauucuucccauucuauugauuucgugcuccacugaaugaaucacagcugaugccagccugugccacccagcacagaaaaugccacauggcugacuuuccucccucccucccucccucucuuccuuccuuccuuccucuuucccaguguccuugccuguguguggcguggucauuauuuuucauuuuagccauucucauggaugugcagugguguguaggcaggggagcugugugucuucagcuucuguaggagcugccaacuuccuuuccaacaagacuucagagaaggcuucacugcuguccagaguuguucauucuaccuuuuuacacgucccugucccccaagcaguguucauguugcuaugcagccucagucauacuuuguaacaucagacugauuuuucuuuauccagucuggugguguguagugagauuguguuaaacucgccuuuccuuaauaucugauuagguugagcacauuuuuauuuuugagaaauuaucauuauuuucucuuguauucaagacucuugucccuuuuuucuaugcuuaacaaaaguuauauauguguguauguguguguguguguguauguauauauacacacacacacauauauaaauguaucuguguucuagauaagauccuugggucagguaucugugcuguagauaucuuucuccacucagugacugcaggauuuuuuuuuugucacuuaauaguguucuuuguuggaugacauuuaaaaugucuuuugaagacacuugcagaaagaaccugaauggacucaccugcuggugacugucuggguagcaaggcucagcaugcuugcuauguggaagcuucacgaaaugccguuuaaaaaauaaaauuaucuucaaaaccaaacaugcaauuccaccauucuuugucaagcuccugcuauuuuuucaacacgaaauuggaaauaaaguugaauaauauacuuucuccaucuucaagaaagccugacugugauauacuuaaauuuuuaaaaauucacuuauguaauacaucuucaggucuauaaaaaaaugauaauguuuaauuguaauuuuuccauggaaccgaaauguuaacagcauugugacauuuucuauacauuguuuuucaugcaagacccuucuguguggcacuuaauauuugucaugugcgauuuugugcauuugugcaugggucuuuggcacugggggggauaucucuucugaacauuucaguggcugcacuguacacugucccauuacccaacacacaguaggugcucaacaggcagugacuguguaacugcugggcugaaagaagguguaucccuaggaaauguucuaggaacaaagugaaccaauaaaauacaugaaauacuuuuguagcaguucauuuuggagaauaaaaggcaguuacucuuuuuauauuugaguccacaaagaaacaauugcagcuauaaauaugcagugaacaaauaccucuuauucucuuuaagaucuauuagccagagcuaauuccuuaauugaauguuguucuaaauuuaccaccaaaaugcaugagggcgaucuguguuuguacguuucagccaacugcaugacaucaguuccaucacaacugcaggaggauggaggaaggcugcugugcacgauuacuugcuguuuuguggucaaccuuucccauaagacuucagagaagguuuuuacuuaauacuguaccugucaaauucccagagcugcaaguaaauugaagauacaaauuauguuguaaagugaaauauuuuguguuauucgcguuauucugcaguuugguugauuuaggaagaaaaugaacucugacagcuugaucuuuucaguucaguggauucuaauguuucaaaacaaaagaccugcacugaagccucuuuccuccaugcuuuggcagagacaccacugugagcucuucuucaugcucaaaccucggcagcuaccggcuccaugucauggacacacagaguccuaggaagagauagauucugcuaaaugcuaauguuuguaaauauaaauauuaaccauaccccgaaagggaaggaguucuuuugcuggcugacugaauggguagcuuuuagcaccugccacuuuucucaacaugcaaucuauuuuuuauagacagaaaaaaucucuuuuucuagcuuuucugguuugcugcuguugccucagugauauugcuugggaugcagagguuuggcaaagagguuggaggagcaccccugcauuaguccguguucacgcugcugauaaagacauacuugagacugggcaauuuacaaaagaaagaguuuauuggacuuacaguucuauguggcuugggaggccucaccaucauggcagaaggugaagggcaugucucacacgguggcagacaagagaagagagcuugugcauggaaacucuucuuuuuaaaacccucagaucuugugagacauucacuaucaagaggaacagcacgaaagaccugcccccaugauucaauuacuucccaccaggucccucccacaacaugugggaauucaagaugagauuuggguggggacacaggucccucccacaacacgugggaauucaagaugagauuuggguggggacacagccaaaccauaucaaccaccuuuccucuucuguucugugguuaugcuagacggccucaccuucuuuucuuauucuuauucaggggaaaacacuaaagugaaguuuccugcaagagccagaaaauccuaaguuaacaaauugaauucugcaacugagaugcaguggguggauguagggcugggcuccuuggaccgaggcugaaccauaaauaccucccacuuugguauugcuuugaggagcuucccagcauucacccuucacccuuuugcugugugccuuccuuuaccuuagcuaaggaagucuaggcagcugugcaggauuugauagguggcagcuuuagcucagacucuggaaguucccugcucccugcuaacuccaagcuggcuccuugcagcuguccccagugucccuuggacuauggggccaggcaucugauuugauucuucaaacugaauguuacugcuucuacuuuauuuaaguaaauggccaucucauugccaucugaugcuguagcauacugugcgaaagguauuuugaauuagcuguuagcagcugggugcgguggcucacaccuguaaucccagcauuuugggaggcugagguggccagauugccugagcucagaagcuugagacaagccugggcaacacgacgcaaccccaucucuacuaaaaguaaaaaaaguuagccgggugcgauggcaggcaccuguaguccagcuacuugggaggcugagacaggagaauugcuucaaccugggucgcagagguugcagugagcggagauugcgccgcugcacuccagccuggguuacagaggagacugucucaaaaaaaaaaaaaaauagcuauuagccugcagaugauuuggauaugggaccuaaaaagcaagcugauuaauugauagauguauuuauuuaugauauucagccugagaauuaagcuggauuuagaauaaaguguuucuuaugagauacgcuuggggguaaacaugaucugcauguaauucacagguccuggcauuucagagcaguauucaaaugcaugucugccauggacugugagcucccaaaaaaagugcaugaugaagugaguuucgaauacugacagaaacgguagagaaagggcauguccugguccuggcuaccguugauauucugcuuggagcuuggauuugggguuguguuuuagcuuaaagaaaccauauauaccuccaaugagaaagagacuuuugggugaagagggacuggagggaacccauggaacagaacaaaggcugggcuuacggugauagcccgcauucauuuagagauggaaaguugcuggaaacuuuaaaacagagcacugcugucacugccugauguuuuucagggacuguuugggccacugugcagagcacagggaguaggagauuugugugcaaacuggagggccagcgagagcccuggggauaagcuacaccagcgauggccaugucuuuggcuaagguagucauugggaagagggaaacaaugagagauuuggggcauguuuugcaggccacaugaaccuguacaaacuagauguaagaagugaagaaaaaugaacaaucaaggaaaagucuuaauauuuuuggcuugagccaaaagugauugguggaaaguuuaaagauaaagaagcgggcuugcgaggugggaguguucccgagcucuguuuuggccuagcgcaguguuucucaacccuguuuauuuuuuuucccauuaugacccuccuaaggagagaaguaaauucacuuuaauuaagaagagaaauuuaaugcuaaggaauaagaauuugugggguagggugugcuuuggaggaccacaagcagaauaauaucuaaaauguucuuuacccuccucccaagaaucaauuucacccccuuaguggagauguuucccccaguguggauguguggccugguuaauucucaggugcccaggagguggcccaauagagaaguuuagcuagcaacuggaaauucuacacugacguucagaagaaagguaaggcuagaagguacaauuugggauuuagaugaugauauucaggccaccuggggggcagugucucuagggaagagaagccgacccaggcuaaugccucagggcucuuugauaucuagggguuuagcaguggaagauaagucagcaaaggagaccaagagcaggagucaguaauaggaagaaaaaaaaaaacacaggagagagaagacagugcugaauuucugagagagagcauagaaauuaacagagaaguaaccaaaggauuuggccacauaguggucacugcucccauggaccagagcugccucaguggaguggaguggcagaggaggaggccagccugcugugcggcauggaggaaggcauggaaggagguaggcacccuggcugugggcguucauuggguuuucauggcgcucagggucagacagauggugugucgggagcugugauaccaggagaguuuguaggaauuugcuguugauuuagggcauguugggaacacugguggagaugagcggaugaugggugaagguggaaacgcugggauggaggagguucaugagggcaaugaguucuagaugaaagggaugguacaggaggggcuggccuggagaggagcaaggucaggugauuuguugcaacaggagaggacagagggagguacaggugucaaccuguguguagauguagguggugguuggaugauggaaaaaaacccaugugacuucugcuuuccuacugcagaaugaagucagguaauuagugagaaggggugcagagaauagucaaauauuaugaucucuauaucucugugauggccauauuaauauuucaccuuucaccaauuuccccgcuaaugcccacgcauggcguacaggccgcguuggagaucccugcggcucaugcugccuuauuacguaaugcccuggagaggccucacaaguagaagagucuaaaacgauagauugcuuuaaauaacucaugcuaaaucauccuccugugaacauuucucgauggaucuugucuuuuaagcuucaacaaacccuauuagccaucaaaauccuccagucucucaaaauagcccucaucagacuugcucccacaugcuugcgucauggcuggguggccacuggagagguuggguggagaugcuggcuguguacauaggaaccagagccccuagagagaugacuugugucugagcaccauucuuaaagcuuuccaauacaugggcugucaguggcuguaugcaucuucucuguuugacuuggcuuagggauauuugggaggggacaggggggacaggcagcauuaagcauccuuuugcugguccucugucuuugagugcaguucugugauacucagaugucuuccagaacuaucggcuguuugauuguggaaauuccuggaagacaagggcuccuguuccuucucucgccacccgugcuuuuugucuuucucacccucuguuccuuuaagaccacaaagcagggacucggacacuggugacacggacauuucaggcucuagcugugggacgcuucaggcaggcagccugaucuuuuuuccauuuuguuuagagguauagauuguacaccucugcuccgagcuccuuuaucaggccccagaaaucauggaugcagcaaaaauuuugaaaaugaaauuuuuccuauauuaucccaauuacucuuuggucuccaugaagccauuguuuuuccaauuccucuauugcagaaugcaugcagggaauuuagaaaucacaugguaaacguuaugggccauuuccuauugcugacuuuaccuuccuaguuccucagagauguaagaugaaugucccuggugccagugagcagccagucagugugcacagagcuggaaaaacuaauagacuagaugcaucuuacugaucacguugauguggaggggccucaucucucugguccagcuggaaaugugauugcugccugggguggccaugacuaagggauuccugucucagcugccucuauauggagaacugagcugaacugguaaacgcucaguuucccuuucagaaaagaauguuacucucaagagcagcagugauucaaauggccuuuugacuuuaaaaaauucuccauuuaaaaauguagaagcauuuuauccuauacaauuauaaacauuauugguagcuaauaaaaaauuuugaugaggcagcagaucauuaagaaaauacauauagaccuugcacacuucauuuugacuuccaauagauaaauagauccauuucacaaagcaugugcauuugucagguugcuuuuucuugguuuuguuuuuuuauuugacuuaagauaggucuauagaugaguguuugccuucguuuucugugagccaguuuucauaccuuuaaaguugaauaagggcugggcaugguggcucacacuuguaaucccagcacuuugggaggccgaggcagguggaucaccugaggucaggaguucgagaccaggcugaccaauauggugaaaccucgucucuacuaaaaaauacaaaaaauuauuagcugggugugguggcgggcaccuguaaucacugcuacuggggaggcugaggcaggagaaucgcuugaaccugggacgcagagguugcaguaagccagaacuguaccacgguacuccagccugggugacagagcgagacuccaucucaaaaaaagaacugaagacaaucgaugaaacgauuugaacgcuuuuuagauuuagugagucuuuuaaguugucucucacccaucugacuugacagcaguuuuucaagugagucaucuuuuuaaucuuuucaaaucuuuagaauucguuuucauguaaaagucaacuuucuuuucauagcccuauuuuauauaauauuucauuaaaacaguuauaauaacagauuuauuugguauaaagcagguauggagcacgcacacagcuguguccacucacuaauccaugcgcacacgcuucccucuuagcuguagacaccacaugaucacaucacuaggggagcuauucaguggaaccccaugcuguccuuguuagguggauuuuuaaacacucuguuaaacuaaaaaaguauauucucacuggccaguguccaguguaagcaaauuugcacauggcugucccuugagucacuguaguuaccuuuuaaaaggaaagagagggaaacuccauuguguagaucuuuccccagccaagagaccguuagcaugcgguacaguaaggcagccacucauuaacuguuuguuuaccuggcaaagagggcagguuggugagcucccagguccucagaaaaugagacuaaguuuuauuaagaucugaggggaaaaaaauaaaccaagcagaacuagaauucacuggaccagaagguuuuguucucccuuuuccagcuaaucucucucauccaaucugagagaauuaagcaagggugagggaguugcagcuggcugaauucaggaaguuaccaaagaaggcugauuuaacugaaaagacauauauucuucccaaagcccaggcuauugagccagaguaccugaucacccagcaaagcaccacucaggcugugaggcuggccacgcacagggaggcaaagagaggaggagagaggaacuuaacuuuguuuuucuucaaaaagauguguuguuucuuggcaaaauguaaucaccauuguuagcaaacccaugagaugcucucagcaauguuuaucaaauagaaagagcuuccuucugugugacaagcaggggaucagagugacaguguuuagaucuguuacuuacaaggugauaggggcaaaaauuaauaccugcacaggcugacuccugaagucuucaucaccagaaaugccagcaugauguccaggcccuaaggugccuaccauguccccaugagagacacacagugccaugaacagucuggguuuuccagaaauacuugauuugguuaauugacaaauucuguuguuccuccuuuauaguuaauuaauaauuuuccaguguagcguuuccuaucagggggugugaauccacacacguggcuuuuucacaauaaaauagcauucauggugccuuaaaacagcuugaaaugccccaaauuacuagacuuguagguggauuucucacaaauuauuauuaaagguaaugaaaaucaaaaucaaagcauuucauauuuauugugucuuuagggcaggccauacuuuacaaguaccauuuuaagaaauccucucaauagccauaagagggcaggucauaugaucuuuauuuuucaguugaggaagcugaaggcaauacugauuuaguaucucacacaaggucacauggcuaauaaggcagagaagaaucagcuuugcuugacuccagaguccguguucuguauagacaaaggcaugaggucauccaauaagguaaucgcuuggagaaacauuuuucccuacuuguuuugauguagaacuucuguaccaauuguaacccucugccgguugaguaaauauuugggguuaaauauaaagcugaaauucaaauaaagaaacauguuacuguucucuacagggcugguccucaccuuuucacaacgcacuuuggaaaaccagcacagaacaaaggccccucccagccugguguauucagaccucagugcuuugccugggcugcagcucuguugggaaaagguggcaguucaguucccgaggcuggugcccucggcaagaaugggagagccugguaauuuauaaaggauuaucacaugcaaaggcaauguuuguuuuauuccaucaucucucauucuuucaaagcaguggcguuuucuuaguaucgccauguaauagaguucgagaaaagugaccuuaaaauugaggcaagugucacacuuugagaaugcauuaauuuuuuuaaagacauuuuagugguuuuaaaauuuuauuucauauauauauauauauauauauauaauuuuuuuuuuuuuuuuugagacggagucucgcucugucgcccaggcuggagugcagcggcgcgaucucggcucacugcaagcuccgccucccggguucacgccauucuccugccucagccucccgaguagcugggacuacaggcacccgccaccgcacccggcuaauuuuuuguauuuuuaguagagacgggguuucaccguuuuagccgggauggucuccaucuccugaccucgugauccgcccgccucggccucccaaagugcugggauuacaggcgugagccaccgcgcccggccuucauauauuuuuauguuguaaaaaggggaaaccuuuguucuuugaguaaaaugcccugguagugaacauuuuuuaagguuuuuuuuauuuugacagacauacccacauuucacgcagcaucaugcuuacccauucaccucaucuugcauucagagagcucucaggcacuugcaaaauugaaggccagaaugaagggagcucagucauccuugacaacugcuggggacaaaguuggcaauuuguucauuguucuugcaagcacuuagccucuugccgagcacuuuaacaucagagaauucugggcauagaucagaaaucaguggcugcagaggcaagcuacgugcagguaaguuaagggcuuacuauagaaaugcaaaaugccaccauucuucacuguguucugagagguuucauacuguugucgacaccugugcugguguagaauugcagaucucuuucugucuuuuuuuuguuguuuuucuccuuuucauuuuuucauuuuuuacuccacgcuaagaacaucggaauauuuucaacuuuaccauugguaaaauagugcaaaggaagugaagaucacgucagcccaugguccauauuuuauuccuugaguuagcaaaucaccaacacuauuuaguuuagcgaguuacuccuuuggaauuuacaguaaagccauauuuaauauauuuccauuuagcaaguauuuguuuuaaauaacagccuuggcuuccuuguuugguuugugagggagacuuugcuucuguguuuccaacguggcuggaaguggaggcuccagggcuuugccucacucauacaguuuuauuuuuaaauugaaaaguggauuuguuuaacauccuccaagaagcaaacucauaaagcucgggcuuuccuaaaaugcauugccaaaaucauaauugguagaaaguuagcaagaaagaaggauuagcucaucgagccguggccuagcaaauuguaaugggcucaaguaguuuuguggcuuguugagaaaaugauacagaguuuaggaagcagaaggacacagcaaugacacaggagagccucacaaacaacaaacacugccuuugccaggagaauugggaaugggaccauucuugaccuuccuggaagaacucagaaggacguuucacuccaggaggcaucaggagggaagucuuucauuguuuucaaggaaucuguugucccugggagugggucacaagugcugcacacacacuuggugucucugaaggagccucaccacauauuagagaugagguuccuccuugccucaggaccccaugccucauuggcauugcugcagggagaccccaggggcuuguggcagucagaggucagcagaagacacgcaggguugaucugugcucauggacucugaucucacaucaagagccagguuccuuuugaccgggaugauuugagaaauggugggagcagggcaguuaucaauucagaugaguagaugcugacuuagcucuguacagcucccuggcaccacccaugguacagggaggcagggauuaggagaaugcuggccucccuguaggucagugauguugcaucaguacugggauuaggcugggguguccaaucuuuuggcuucauguuggaaguauugucuugggccacacaauaaauaaauacacuaauacuacaauagcugguaaacuaauaaaaagaucugugcauaaaucucauguuuuaagaguuuacgaauuuguguugggcugcauucaaagccauccugggccacaugugaccuguggguugcggguuggacaagcuuggauuagaggacagaagaacuugcagcuuucagcuugguugguugcuuggguaagggugcacucuuguguucucucucucucuuucucucucucucucucugucugucucuuuucucucucucucucucucugucucucaucucucacucugaaagaaguccuguugggggagucccaaaagcuaaaccauuggccugggggagaaacgugugcuggauggaaaagaggacaaaggcauagacuuguugacuugcaucuccgagguccugugauguggccagguggccugcagcucaccugagagacacaggcaggauuuccucucgcuuuagaaauugagcagccugcuuggagcaggcuuguucucagauucauugacacuucugcccaucagggugaucugcaggaaugaaaagugguuagaauucuguugcaaagguuaauuuuaaaaggccagugaacacccacaagggggucaccagggcaaaaccacagcacacacccgccucuccguuuaacucacacuaguccaggugcucugccugcucuuaccugcuuuuccucuugguuggguaacaagcauucaguugacugcauauucuccucccucaguuucuucugacaucuucgugagaccugagagcaagcucugccuuggcgacaaccaguugucauuucuuaguggcagccuuuauuuuucaaaaaaugaagaaggauaggcagucucugcagagugauaguggggagcugccagaggggcagcaggguccugcguguauccuaccaacuguguuuccauucucuuuucucccaccacagaagaacaaguaagcguagagcugacagggaaaggucuccccaccagggcugucuguccugagaguuuagaaugugcugggagagcagagcauucuuuggggccuguuuggcgccaacaaggagcguuacguggucugugaccagcugcugcaccuccugcuuugcucuggaaggaggccuugaaggccaguuggaaguucugcucggcugccuugaauaaugaaccaucaauucuguuucccagcugugcuuccacacccucacucuuggaugggacugcuggguuccuugucugccacaagcagcaauugcuggaaguagcaggucagaaaugggaaaggaggccuggacugcauagccaggcaagccagugagguuggagcaaacccuugaacaggggcugggcccaccuuuguagucuugucaccaaggagguuacugaagccuccagaaggcacacugucugauccaacucacaugccagaggaacacugaauaguuuccuuccgaugcauuacauucauuaguuauagaaggaauaaagccauccuauaucuucucugaaaaaugaaggagugaaaagagcacaauguaauccuauuaugguugcaacucuucccaguuugguuuucugcagaucuauuuacaugcauacuuuauucuuucauaaucaugguguaauaucaucuguguacugcauuauuuuacuuaccauucuaucacaagcauuuuuccauguuacuccagcauuuucauugccaacuuucuuauuggcugcaugagagucuauccaguggguauaccauaacuugucaguacauuguaucauuuucauaaauuuagguugcucucaaguuguaucuguugcagauaacauuguagugagugucuucaugcauaugguuucuauauuuugcauuauuuccuaggacacauucccagaagucggauuacuggggcucgauacacauugucaaauugcuuuccaaaaggauuuuacugauuuuauugcacucucgccagaauucaauauugucuuuuaaaaaaauuguuaauguaauggcaaaauguuguuuuauuuuuacugaauuuucaugucuucagugauuugcaagauaaaacaguucccagccauuuucuuuccaaauguaguuucuguuuuuguaaacuauuuacauccuuugcucauuaaucuauugguuuuaguguuuuuucuugagaacugucuuaacauuguuauacuaugcucauaguaaccuauuucauauuuccaguuauuuuuucuguggugguguuugcccaucucauucgguuagguuuuuaaaaauuuguuuuuauuauuuuacauacaaauauuuaauuuauaucuuuccaucuuuuuuaaugauuucucuguaauagcacccucccucuauaaauuugauagaccauuuuagguuuuauuauuuuauauuaaacuuuuuguuugucuagaauuuaaugcuuuguauuaaaugcauguaaguugauuuuuuaaauugcaacuaguuauuacagcaccauuuauuaaauaauucuucauaguuuaaaagugguucuuccaguuaagguuuuaacauaauguuagggauaauuucugggcaauuuguugcuucaauaauaacauguuuggccaagcacaguggcucaugccuguaaucccaacacuuuggaaagccagagugggaagaucacuugagggcaggauuucgaaguuauggugagguauuaucaugucacugcacuccagccagggugaaaaagucagacccugucucuaaauaacaguaaucaucaucaucaccuuuuauucuuggguuaguaccacauuguuuuaauuaccauuucuuuaugguguguuuuagauauuuggcaucggccaggugcgguggcucacgcuuguaaucccagcacuuuaggaagcugagacagguggauugcuugagcccaaaaguucaaaacuagacugggcaauauagucagaccuugucucuacaaaaaaaaaauuuaaaaauuagcugggugagguggugugcccccuguaaucccagcuacucuggagggugaggcaggaggauugcuugagcccaggaggucgaggcugcagugagucgugaucgugccacugcacuccagccugggcgacagagugagaaccugucaacauaaauaauaaaucaauaucuggcagcccuucucuguuuuacuauucauuuucugauuuuucuucuguaguuuaaccuauuguucuaccaaauguaauuuaaaaucauucugugaaauccagcaaaaauagcuuuuuauuuuaauuuugauuagauuugcauuagagcucaguauuaaaacaugcacaccuuuuggugccagauuucauacucaacauacuuuguuccuuuugugcgaaggaaauuauguuuauuauggaaaacagugaaagaugagaaguaaauggcucauccuccauaaauggccaucgcugacuguuucauguagaacuuucuggccugugcccauaucuucucucuucaggcuuuggcaguggggcugauacuucacaggcuguuccaguaccacugcaccuucacucuggaggugggagugggacuccgugcugaggacccuagaugcacaucuguucccuuagcagggagccauguccagagagugaggcaugcagggaguggucauguggaaggugcggucagaccgccaaggucaugccaucuucugggcacugguagucccuauggagcugcugcuggccagugggaagauuuggaggauuugaggauacucuucagagugugcuuccacagucuaacccuccugcuugacgaccuguuaugugugagaugguggcuuugucacaggaaucaccugaaagaccucuaucugggcuccgugaaacuaccuaagcaggucagucuuucagugaacugaucugauaucauugggcuaucacgagccugaggcuggcuccccacuuucaaaucauccucaaaaggcagggcaaguguuuuccucugguuggugaugguguccuagcaugcccuuuuuccagcuggcuucccacugggcucagcccgaugcgucuacugcaaucccccuuuccuguguugcccucggauaacuccauguguaggccugaaucguguucauuuccaggaaaaguaaaugaugcauaucuuacuuuccaucuguggucauuuuuuuucugcuugagaaacaccugggucugcuuguuuuugaauucucuuuuuguuugucugaaaaagaaaucuauuuuauuucaaaaauucaauauugaaggauaauucagauuuagaauuugaggcuagcaguugauuucuuucagcacuucaaagauaauuauugcaccaucuuuuagcuuucauuguuucuguugaagguaacauaucuuuuucuccaguggagauauaaucucagugcuuuuucgucuuuguuuuuaaacuuuuuauuaucaaaacuuucauacauguacagaaguagaauaguaguuauacuauuacuauuauauuauguaguauauacuacagcucuguuuuaaccaucguucaccuuuaccacugucaaccauagcuaaguuucuuagauuuaucaucccagcuuugucuuucucaccauuauguugaagcaaaucuuaggcauuauaucaugucguucauaaauauuucaguugucauucaaaaauaucucuuaaaaauaagaauuuuuuaacaccucuauauuauuacuccuuagaaaauguuguuuuauacauaguuccuauaguuugcccaacuuaguaucuaaacaagguaaaaauauugccuuugguuguuauaucuaguaaguuuccgauaaucuuuagguugacaccccuacuuuuuuucuuuuuuuuuuucuuuuuguuuuuuuuugagagagagucuugcucugucgcccaggcuggagugcaguggcacaaucucggcucacugcaaguuccaccuccuggguucaugccguucuccugccucagccuccuggguucaugccguucuccugccucagccuccugaguggcugggacuacaagcaccugccaccaagcccagcuaauuuuuuguauuuuuaguagaggcugguuuucacuguguuagccaggauggucuugaucuccugaccucgugaucugccugccuuagccucccaaagugcugggauuacaggcaugagccacugcgccuggccuuuuuuuuuuuugaaguacaugaucucacucuguuguccaagcuggagugcagugaugugaucauagcucacugcagccucgaacucuugggcucaagcaauccuccugaauagcuaggacuauaggugugcaccaccaugcccagcuaauuuuuaguuuuuuuguauagcugcaaucucaccauguuggccaggcugcucuugaacuccuggcuucaagcgauccucccaccucagccucccaaaaugcuaggauuacaggaaugagccacugcaccaggcuccccauuuuuuuuccuuauaauuuauauugcaauguuuguucaaguucuguaggaaauuccacauucuggauuuugcagauugaauccacaugguguuauuuaacguguuccucugucugcuauacuuuuguaaacugauagaucuacagacucagugagauucagguuuuguuuguuuguauguuuguuguuguuuuuuagcaagaauaccugauaaguggugugguguucuucccauugcaucacaccagcaagcacaucauguuuuucugucucuuauaacgugaagauugauuaguggcaucaggugcugccagcauuuauccagauuccuucaauauacaguaguuuuucaccuaauuguuauggcagccaaugaugaucauugacuagacccauuauuccuuuggaguuaaaaaaauccuuacucuaauuauguuauucugucugcuuucauuagccagaauucuuucauaagauggaaacuuuuuucauaaaauagaugguacccugagaguguuuauuaaaggaaaggaaggauaaaugcuugucucuuucauuuuaauuaucuauuugcuaaauagugaauugguucccuggcauccuccaaggaugaccaguaaauuuuuuucuuuaauaccuucaugaauuuucaugugucuaaguccguuguaguuaugauucuuuuugcugaacaaauucuuccaucuuguuccacuaggagucuuuucagguggauuccuggguccuuaccacccugcuuaaguagucuuugauaauggcuuucuuuuugaugugacaaaauaucucagguugaucuuuuacauuuuccaucccaaaccuggaauaagccaagaauauauaguugcuuuuagugggaagugguauuuagaaaucauaaucuggacaacgagggugcucacugcaacugaguuacucauucuuuccaagccuuuuagugggcagagcuaggaaauacauuuucuuuuuuuuaauucucuuuucccugcaccaggauguaaaguaaggaaauacauuuuccauaggaaaaaaaaucaacaugaauucauacuauauuugcauuuccaauuuaggauuauggagauuuuaguuaccuucuuugauuuuauauguguaauuugucucuuacacugaaaauuugggucccuaaugacacaaacaugaugucuuguugcuuuguauguauauauaaaauauauaauaauuuguaauauacagcauaauauagaauacauaguauauacuauacuauguauauauuucacacacacacacacacacacacacacacacacauaaaauaguuucagaauaacaauaccaauuguuacuuuaaaaguuuguuuucuccuuaggauauauccugcagacauacacaaucaagucauguuucucaggcacuugagaugaauccuugcauguagcuaaacucaucaauuugauauuuaggauaauuuuauuuuguuuuugauuuuuagugauugcacuuuuuuauuuagaauaaugugucucagauauacuaagcaaguguuuucauaguauuuucacuucugccccuaccuuucccuacaggaaaccacuuuuauucauuuguuguuuauauauuguaacuuaacuuuuaauaucaguaaauacacaccacacaaacacgcacacacagaugcgugcaaacacauacuuguauucccaucccuuucuuauuaaaugggaacaucaauacugcuuuuuaaaucuaacuuuguauucuggagacuggcguguuguaguauauagagauauuucucaucacuuuuuaccacugugcagauuccauugcaugcauauucauauuuucuugcaccuguccucuaauaaugggcgugugaugguuuuucaucuuuuacuguuauagauggugcuucaucuauagccucaugcacacaacuuuacaugguuuugccagugugucuucaugauagauucuuugcaguggguugauguaauuggaaggcaaaugcauaugacaauuuugguaaauaauacucaauugaaugccauaagguuauugaauuguaacaucucaccagaaauaaacgagccugcuuauuucuccacaaccuuuccaaccuauuauguugccagacuuuuguaccuuugaaaauuuaucacaugagaaauggcaucugagugcaguuuuauagaucucaauguauguuuuuugguuuguuucuauacugcuuagaguuuauaauauuuuggaaaauucucagacaguaucuccguuaucauuacuucuaccucauucccuuucucuucuucuuuuggaacucaauuacagauuuguuagaccuuaggcccacaucacauacaugucuuaugcuuuuuuuuuuuuuacuuuauuuuucauucauuuucucucuguauuuuauucuagcuauauauuucugauauauuuuuuacuuuuguauuucuuucuucuguccuauaaucugcugguaaauucaugcauuuuuguucucuguuucuguuauggaguuuucauuugguuauuuuugcuaauuggaaacuaaaauuuccuauucagucuuuuggucccuuaaagacucuuggugguucuguuuccguggauguguuucuguugaguuuuuugggaagaagucagucuuguuuuaugaucacguccugguuucugguaugccuggauuuuccugaaaugaaugcuguagaucauauguaaaagauauacagacuuaauugaagguacgaugauguuaucuuacuccagauaguguuuauuuuuuuccauaauuuccuguguuuuuauguuguguauauuuguuuaauaccaugaaacuccuuuucugugauauucaaaaugaaggucgugguaguuuugaguggaaggcaguuuuguauuguguuuuuaaaacuuuauuuuccagcaauuaaagauguccacaguuaugagaaauaauacaaagagauccuguagcgccuucucucaguuuccucuagugguaauaucuggcauaacuguaauauaucacaaccaagaacuugugucacucuuuuauaggucaagccucuuuucuccuccucgcccuaccccguuucugacaaccacuaaugccuucuuuaucugcguaacuuuuucaccguaugaauguuacauaaaugggcucauacaguagguaaccuuuugagacuggcuucuuuuccacucagcauaauucccuugagguccauccagguuguuguauauagcaauaguuuguuccuuuuauuacugaguaguaucccauaauauggauauagcauaauuauuuucaaccauacaaggccauuuggguuguuucuaguuuuggguuauuuugcauaaagcugcuuugaacauuugugugcaguuuuuugugugugcacaaaaguuuuuauuucucugaguuaaaugcccaggagugcaguugcuagaucccaugguaauugcauguuuaguuuuguaaacgucugggaggcaggacuuuaagguugcuggggccucagggaugcauaggacagcuggggcuuugcauccucgacugcuucagcugaagacacagucuagagucuguguacucuggcuuagguugagauugggaagacaucccuuguucucacuuccagcccucucacuucagucaagacuuuugcuuacaaagggcagcacagaggcucaccgugcuuaagugucacguggauuuacuggacagaccauuugcacacaugugaggcaagugguaucgaauuuuaccugguagcaggugccagcuuccuuccugcaugcccuguccccuuuauccucaaagcaggcagagaauauggccacuuggcauucucagucucagcccccacaaccccacccccagacagagauguacacuagccccuucauuugaguuccagauguccuaaggcagaacucugaaugucccuuuggguccuaugucuaguucugucccugguggccagugccagagucuuacagcacagccccauguguugggagcgccagcuuugggguaauugucauagacaguagcgcccugucgggucaguuccgugugagaaccugagagggaaggagaguugcucacggucagacaggagcucucaucagcagcugagccugcauccccaggcguuugccuccuuccuuugguuuugcugauuucgcuuccuuguggggagacagagcucggccuuucugcucuccuguugcgcuggcuguguacuguuuauuauagccuacguagagagaauagagggacagacagcauuucuggugacagggcauauccagugaaaugcagacauaaaucaucuuuuaaacaaggguggguuugcgguaggaaggccugugugaggaaauaggcccucucugggcucccuccguccuucacagagugccuccugacccagggucgcaagccagguucugugccaggcaccacuccagagcagguaucuguggcuugacaaggaugcacagggcagccgauccuuggaaagucuguguguccaaagugccucugguuauauuucaaggaccugccugagcugagucacaguuagccucugacaauauuucuaauagaccacucuguuguuggacaguuuuuaccauuugcacuuccaguaugaccacuccaggucucugcauuaauuuuucuuuuuaaauccucuguuuuaauguuuucgggggagggggggcccacuucuaucugaaaaugcccauccagacacuguggguucugugccaaugccagggaaggaagcucaggguucugcccugggcccuaagaccuuagugacucaggcagcccugcuacugguugggagcgcucuccacuggccaccucugcugcaaagcucuuuucucuugcuucaugagaaguggaagagugugaaacaguacacggaggccuuucuggcuguuuacaagggagaugggccaccaguguuugucaccggagcuucaggguagcaugccuaggagaggagcaaacaggggccuuggggcuguggagucaugcugggaagaugaagaaaagacaguugguaacugacaaauugcaggugugaucauuacucucugugacucccuguuucucagaugcacuguugcuuacaucuuuguaugcuuuugcauuccugcugauugauucaaggugcaacgugccugcuugucagguaugcuguugaucacauuauuuaagaagaaauaaagucguucccgcagcuccaccugcagugaugggcuuuaauguuuugugcuucccgaggaaaaccugccgaugaugugaagugacauucaacccgccgagagcugauacuggcagacaaauuucauguccugucuccugaucaccaguuugcugccuccaaguuguuagggauauuaaaaacaggggugggaaguccccacuugacagguucaauuuguaaugugaaaggugcugagaaacaaagcaaggacccaggcagcuuucugccaaggcugcuggccccacacucagcaaggcaaagagaaaggggaucuaucugcuaguagcaugagugugggagaggagggggcuguuguagggugccguggaggacucauacaugauccugggaagagcgcugcugcuagcccagggccacaaagcgucaaggacguugagcuccugugcaugcuccuguagccuugugucaucugaagaagcacagaaguggcaggaauggccuuuucauagggcaugggaugcuguaacugaugugcaaucuguuaucucaaaggagaccuuagcacaagugggaaaggaaaaacugcccgaccauggagagaacacaagugggcugaguguagcugccucuccuuaccuguggcuggugccaugaaggagugcugcugucauuggacacuguggggccagcaccggguuuugugugucacuugcauucucccuugguacacagagcccagacugguuuccuggucccuucccagcgagcacugugauggcuuugccauugagguggauggagguccuugaccaaagcaugcuucccccugaccccaucccacccgcagguuggcagcucauccucuuccaccugcugugaaagggcugggucuggggacaugggaugagggcgacuugccugcccuaugaaccagaagaucaaccccucugaagccaggcagcagauucugcggcuagaucacccuuagauacagcacagggccuaacguguugguggcacccacuguguauuugugggaugcuugaggaaaucaaaaagaaaccaacacaaaagaaaagacucuucauuguaaaaagccugaugagaacagacaggauguggccucugccaaaaccaccauccacuuccccacccaacucucugccuccaguaugcccugagaacccgccuagucaucugaucugccuccaucaugcaggcguacugagcuccuucacuccucaggugaagccacccggagcacaccgcggauaugcagcuugagaaagccagugugugcucgcccacguuacccuccagggcaggugcaggugaccacuugucucagcccaccuggccccucaacucauuuuguguuacugacccucucucuuccauccucaugguacuugggguguccaguuuaaggccugucucagauauacuuauaaugcaauagaacagauuuuauuuaccaguugaacuuccuuuucucccagagaccauuauuugcacuaaaugugguuuuguuuugcuuuuuguugucguuuuuuguuuuguuuuguuuuguuuuuuguuuuuuguuuuagaugaauucucacucuuguugcccagccuggagugcaaugguaccaucuuggcucacugcaaccuccgccucccagguucaagcaauucuucugccucagccuccccacuagcugggauuacaggcacucgucaccacgccaggcugauuuuuguacuuuuaguagagaugggguuucaccaugaugaccaggcuggucuugaacuccugaccucaggugauccacccacccuggccucccaaagugcugagacuacaggcgugagccaccacacccagucaaauguaguguuucaugugaguuguccuauuuuuuuuuuuuuuuuaagauggagucuggcucuaucacccaggcuggagugcaacggcgugaucucggaucacugcaaccuccgccucccugguucaagugauuguccugccucagccucccaaguagcugggacuaaagaugcaugcccagcuaauuuuuguauuuuuuaguagagacgaguuuucgccacauuggccaggcugguuucgaacuccugaccucaguugauccgcccgccucagucucccaaagugucaggauuacaggcgugagccaccacaccuggccaaguuguccuauucuuaaauaaggauagcacauauagaauuauuauggggauucagguguaaccccagggcuuugggaggccuaggugggaggaucacuugaugccaggaauuuaaguuuucagccugggcaacaaagugaaaccccuucugugaguccauuuuguguugcucuagaggaauaccugaggcuggguaacuugauaaacaagagguuuauuuggcccauaguucugcaggcuguacaagcgugguaccagcaucugcucagcucucagaggccuuaggaaacuuuuacuccuggcagaaggcagaaggagagcagguaugacacauggcacgagcaggagcaagagagggagaggaggaggugccagcuuccuuugaacaaccagcuuucgugugaacuaucaaaccagaccucacucauugccacagggaaggcaccaaguuauucauaagguauccacucccaugacccaaacaccucccacuaugccccaucuccagcauugggggucacauuucaacaugagauuuggaggggacaaaacguccaaaccauaucgcccccucccuacaaaaaaaauuuagaaauaccuaggugugguugugugcaccuguacucuuagcuacuugaggggcugaggcgagaagauuguuugagcccaggaauuugagguuacagugagcugugauuauaccacugcaguccagugagacacugcccaccccaccccgauaaaaaaaaaaaaagaacugugauugggaggguuuggggccaagguugcuuaaacaaacacagcccacagcucugugccaauugagguuugggauuccugccucaccccuagauaaccaauaaaguagcuaugauacauuaaguuccuuuuguucuuaagagaaggugauggguguaacuagaguguugacaacaugaaaaaccuaaaaucagguuggagauaaauauuuaaaucuccucuauuggauacugauaaugaugcucuuaaguaaaaauaaauauagcaggggccuauuaggggagacaggcucuggcuuucuuacagcaugcuguugcugugugguuugggucacguuucuuaaccucucugggauuuccuuuccucuggucugaaaugagcaguuguuguacuugccguauaauuucugaggccucuucuuacucagaacuucugacuguuuuuaaaagauggagcauuaccucucuauaccugacugugccgcaugccauucgauuuuguuaucgaagcaggucagcccguuguuuuucacauagauucuuacaaugcaacaaagcaucacaguuacucacaagggaaggcaggggaggagggggaauguggugucagaagccagacccauccucacguaguggagcugcaccugcccaucucccagaaaguccuucaagccccuuucagcgccuccaccugcaggccuguucuuugcaagccuggcuguggucuguuuugcauaaaagaagauuauccagcagugggguuugcucuucucuuuuuacauggcugccauagcaagccaacaagaaaccugccguguggagugacggucaggaaccuugcaagaugccgucgaggcucugucuacaccaggcaaagaaucuuccagauuccugcucucuaacucagaugaaaguaguugcugcagaguguguuugcuucucugucugccucagggcugagcuucuaaacauaccuggucuaguggguugcacagcugauuccaggacaaugggaugagggaaggggaagauagaggcuggcagagguggcuuuuuguggcaugcaugggaaagcgguagggggugcucuucacaguugugggggaggcuuagccugaaucucagggcacagcugaagaaggagagcagccuggaaaugcguccuaaagagccgcucagccacggcagcugugagcuguggcccaucaguggcuggaggugggaccauuugagcuuuucacugagauagagccugugucaaguguucugaacaacuugcuguggccucaugugagcuuggcuguggaaucagggaggccagcacagagcguggggcagcuauucccaguucaucagcaucagccacggugugcagaggaggggugggagugagggauggucgagagggagaaccuguugauuugcccgcaagcuaguuguggaagacaagcacaggccaagaaauguggguggacaccauuaauggagauggaaggagguguuggaauggaggaacacggucauugacuuuuugcacaugcuuagucugagaugccuccagggcaguaggauaagcuaaccugugggaauguggagggacgaauccauagcucagaagcaagcgguaucugcaggaauggauuauacuggcuggaucauagggggucagugagucaugagaaugagcccuaauuguagagaguaggaugugugaugagagaaguggggacgcaucgucauggggaccaucuugauggagggagggagaaaagagaggagagauaggcagugagcacagaaggaggagaggagaaccaggcaggagcuaugccagugacaccaaggaagggugcguuugcugugauguguuuucaucacguuuucauaauuaaccaacagauuaauauuccucagaaauacaaagcaccucucaaucaugcuauaccuucuucccaacuuuacaguaauacauuucuuaacuuucuaguuauguuuuagcaccuuagaauauugaaaacauaaaccaaacccucauggcacgagcaugggaagcccuugugaugaaaaucagcucaaugagaggggaaaugcgggaagcauuuuuagcagaaagugaugacagcuuggagcaucccaaagcuaugcauuauucagacgugucggagcgagagugcccgauuucaccacccauuaccuauugggaugccuucuucucugcuugcuaaucugaauauuacucauuucaagguuuuguuuauauuaucuugaggggaaacaaacaguaccuaauuaaucccaccaaacauaauauuggaaaagcaauuauucccaccacguguaauaaaccaucuguagggaaaauaauccauuaagugugaaucagugugaauuuuaaaacuauuauuaagaucagauugguuccucguuaugagcaccauaauuuuaguauuuguucaugcauacuguguuaugccauguucuguaaccuuaaauccuuaauguccaaacaaauaauaucuauaugcuaauuagugucaaaaaucacaggucagccaaucagguguuucacagaugagccccuuuuuuggggguuagcucgaaucugugauuaauuagaaagugaguccccuauuuugaaauucuagugauaauuguagcagagggcugaauuuauuugcauuuucaguaaaucauccauuaacugaaaugaaaucuuuuuguuaaauuacugcuccugguucaguuaggagggaguuuucccuucauuuuuaaauguacuggaguauccuucaguucuccuugagugagaagcaaucgcuuugaccauugucaaccagaaagaauuuccccacagcauuucucucuuucccagcugggccauaaauugucucgugacugagguugcugucugcuccugagcaagcuggaagcaaugaugagcucagagcugggcuuuauuaaauccuaggaagacacauaaaaauuguuagcaguugauuucgcaggaaacaccuagcaaacuugucgggguuuauauuacaaagcccagggccugcaguuagcagaucaucuuuuuugaaaagcauuuggguaccuuugucagagcuuuucugcauuuugacguaggaggauaccugagggccaugguugugagaaaggagagaacccacccagguguccuggggauuguuuuauucauaaaguaauucggaugaucucgaggugguccagggagaugggauagagucagccaaggugucuauuguaagauagauugugaaccccucaaagauaggcugaaguccuuauuccugucaccugugauuguaaccuuauuuggaaauagggucuuugcagauauaaucagguugaggugggugcauguuggagaaggaugggcucuuuauuuuuuguuugagaccaugucuugcucugucacucaggcuggaguacaauagcaugaucucagcucgcugcaaccuccaccucccagguucaagugauucucgugccucagccucccgaguagcugggauuacaggcaugcgccaccacaccuggcuaauuuuuuugcauguauuuugguagauacaggguuucaccauguuggccaggcugguauugaacuccugaccucagaugauccaccugccucggcccuccaaagugcugggauuacaggcgugagccgccgcgcccggccaagaagggugggcucuuaauccaauggcuggucucuuauaaagaagagaagacacagacacacaggaaaaaugcugugugaccguggagguggaucagagugaaacaucugcaagucaaggagauugccagcaacaccagaaacuaagaggaaggcaugggacagagucuuccagacgggcuucagagggagcaucgccuugccagcaccuggauuugggacuucuggccucuugaacugcaagaauaacuuuauauugcuuuaagccccccagcuuguggucacuugucaugccagccccaggaaacugacaugucaucucuccgugugacugguuaagucuugaugugaucuccuagaccuacguacuuuggagcuagccaggguaugaucagcgagaggcuuaggacuugguuaguucaaccaagcuguuggagcccauucuugccucaaccuagugaaaucaaaccuugcauccuuuucucuugccuuucugaagauguggauuugaaaaaaagaaaaguauuccugcaaaguuccuuaucucaggcuccauggcauuucucagagcauccggccauugagaacugacuccguuucuccaaauucagccuucccaugugaguucuguccugagaugugauuggggauuggaagccaagcagacccagcaaagggaaggugaccaguggacuccaccugcucagcaaacacugaccuggcuuuuccuuucugggaaguuccgcaggccagcuggcauccuccccgauggcauuuccuggaguccucaccugaacucuugggaauugccgccuagagaccaccaugcaaagcaggauguugaagacagauuagaaggcuucuuucgcgcugccucuccugugcggcuucucuccguugucugucuccucucuugugcuuucuggaucucuucuaaagcuucuugggaaaagccaaacaggaaaugagccaccaagagacugggcuuagacaaugauggccaaguagaaaagauucuauguucuagcauuggggacugcagaggagacagcugccccuuuccaggaccugucgaaggacaaagucuaagguccguggggaucacccuucaggaagauggcaucaggccacaaaaauagaaaagagauaucgcccucccuuuuauagcacaaauguuaccagucaugcuaguaucaaaaauuauauuccaguuuacuuucugcuucccuuucaggccugagaugccugguugauccaucuucgaauacuuucagggagcuaguuuuucuugggccuuuuucccucuuaggggccaccacagaauggccuccccagccguuuucucucccuaauucuggagccuggccugccuguccucccgagagccccaccugacuuucuuugcuuugcuuugccucuguggcucagcuuguuucauccguuccuccuugccauuuugaaggcagugccagcacuggagaacccuaucagugcuugcaaccccaccacgaggccggcagccgggagggcugggcgcauccgcucacuguaaucuccagaacagauaccagcuuuuccuaacccccuagccuguucuaacccuugaacugcuugagagaugucaaaaucauaacucucuggggaagaggagucaguguuucuguccuagcagcacgcaucagugcaaucagagcucuguaaaagccaggauccaccaaggggaggauuugugaagcuuuuuccaguuacagugagaacugggcaggcaucgagucucaguuucagugccgcuugaauacagggugucagugucacuugagugcuaggcggaagugcagguuaggccuggaucggaggguuaaugauuagguuucucccgggcugcuuuucacaucagugcugugcaauaagcacuuuuacaagucaggcugcuuccuuuguuugagcugcuaacccuguguauugagccuagcuaaauaacuccgauauuaggauaauauacaaaugaauguguaaaacacacuucagugaguacugugcuaaccgcuucuuuugguggagggaggaaagaaggguguuuacaaaacggcuucgcuuugcuauugucaugaggagaacaggaauuucuccaggcuguguggucaccggugaauauaugcaucuagguuuuaguauuuauuuggaaaucaaauguauuaugggcaaggguauguaaugaaccagccauuuaaagaucccuggacauaaaaugcaagcuuuuggcugcgcgcuguggcucaugccuguaaucccagcacuuugagaggccgaggagggcagaucacuugaggucaggaguucgagaccagccuagccaauauggcaaaaccccaccucuacuaaaaguagaaaaauuagcugggcaugguggcgggugccuguagucccagcuacucgggaggcugaggcaggagaaucacuugaacccaggagguggagguugcagugagcugagaucgcaccacugcacuccagccugggugagagaacgagacuccaucucaaaaaaaaaaaaaaagaaaaaaaaaugcaagcuuucgacaaagccugccugccugcuuugugugugccuucccuuuuucuugcaguggcccuguggguuugcauggcccucuguggccagccucaggaucuaggguccucucugcuuguaguauaagcuuugaaugcuguggcccggagcuuuuccacagccuguguuuccugcuucuggucugcucuagagaaauucaagucagguuuggccuggcuuggccaacccgagcuugccauguaccugagucccaagggugucuguccccuaacucuagccaccuguuggggagguaggaaggucugggagggagaugcugaggagagcagagucgugugcagaccaggugggacuggacuacaggagagaccaggugggacuagacuacaggagagcccuggggggccacuccuggggccaggagcugcucccugagggaauucugaagcugguuugugauucugugucacagccaccugcaucccagugaaagcuaugguugcuuuccauagguaaaggcaauuugaggacagcaaacauauuuucccccacacaauccgucauugucuggugaugggcugucaguccaaaccguagccuagaaaucguagcucaggaaguagagugcugagaggaacaauucaaacaauuuuguuuccuaaauguauucuucaguugaagucuuugugguuaauguugauaguuuguaggcacaaucacuauucuaugcauagggacagcuuuuccuaacucuggaaaagaggggguguguguguguguguguguguguguguguguguguguguguguguauugucaaaaaccaauggaagagaaacacuucaaaaugggugagaacagagaacagcaugaaauauggacagcagacagcccuguaugcaaugaaaaugcaggugcauggucacuagaaaagaugccucauucuuugaauuuuuggcucuuugaaacaccugugugacauuaaauuuuuuacugaaaugugguauuauuaagucuugcguuuaaguuuauaaucagaaacaaaaacaccauguccuguuaaggaaagaguuauucugacaacgguuagcaggauaaagaagauuuuacucaggaguauugcaauaggugucaagauuccacagaagaggagagagaucagucucaacucgaaauacaguacaaaacuugggauuuauagccaacaaccuggguggggcaggugacagucaguggauggaaaauuacuaagaggacaccucaaggauaggaggugucuugcuaaaugaaccuaauaggauucuuccugaaaacaggccaaugacuuagacagcaaagguggaggaugaguaauuugaucucaugucaaggguguggauucacuccaaacucucuuagcaggauagagccaaagucaaugccuaguugagaagagagcucagaggagccuggcuaacauuuagucaaaaagagucucugucagugcucgauuuaguuuuauuacucaacacugauacuuucugagcuaggcacuggguuaaacacuuaaaaaaaagaaaaaaaaagguuggccaggcauggguggcucacaccuguaaucccaacacuuugggaggcccacaccuguaaucccaacacuuugggaggccacaguaagagcaucauuugagcucuggagugcaaggccagcuugggcagcauagugagacccuaucucuacaaaaaauuuuuaaaaauuagccggaucauggugugugcccguagucccagcuacuuggaaggcugaggugggaggauagcuugagcuugagagguugaggcugcagugagcugugaucccaccacuguacuccagccugggcaacagagugagauccugucucagaaagaaauaguuuaguggcaggugagagagcaucauguaaucgcgauguguaaaaacgugcaagaauggaauugugcagaaaacccagugcgggcuuaucaacccgaagaauucccucugggccccagggaacauucagcaaagaagcuaccuuggggauuguucuuagauuuuaacaauuugcugggaugagaguauuugagaguggaaagagcacugggcugagggaacagcacgugccaagcgauggggaacacaagagccggguucuguggcugcucagggggcagagcuccagccaggccuacaaggcacacaggaugggggugggggccggagcugaggcugcggagcagucggggaaccucuuccaucauugacaagugagcccaaaccaugccauuccaggaguguuacccuagccgcuuguuaugaagcccucuguuacuugggaugaucugaguggccuuccacgcacuucagaaaauaaauuccuuuuuuauggugagcgaaauucuaauauauauuuguauuuucacuaaccuuaccaaagagaaaaaugucagcccuuuuccugaaguuucuuuuguccacuugugacuuucaauuaaauuuuaaaaccuccagaguaggaggaaucccccacagagacaauaaguuagcugauuaauugaaaacguggaagcuauuuuuaugauuaccacauaccuuguauuuuauuuuuacugaaaacacauaagugaggucagguguguuggcucaugccuguaaucuuagcauuuugggaggugaggugagaggcuugcuugagcccagguguuugagaccagccugggcaacauagggagaccucaucucuacaaaaaauaaaauuagcuuggugugguggugcaugccuguggucccagcuacucaggaggcugaagugggagagucacuugagcccaagaguucaagauugcagagagccaugaucauaccacugcacuccaaccugggugacagagugagacuuugucugaaaaaaaacaaaacaacaacaacaaaaaaacucacauaaguguaccuuaggcuuuuuuuguuuuuuguuuguuuguuuugcuuaccuuuuauguaaguccaaugcuucuuuuugaacgugguuccacugaugagcuucuauaaugccucaucaacaguucugccuacaauuuuuuaaaguggaguuagucacauuuuucagguuuuccaguugucucaccccagucuaauuuugcauauuuuuuuuagcucuuuaccuuuauuauagccuuuguaaagcauuccauuuaguuuuccaaaacugguucuuuuucauggcacuaauaauucauuuucucaugucacauuuauuugaauuacguaauuauaguagcaaggagaauugguauuaaguaaguuuuaggugaaacccaucgacuuugggauugugcacucugaugagucgggcagaagaguccagguguucuaggggagccugucacuggucaguggucaguguaucccgaggcauugcaaauccucgcuuaucugaaggacuugcuucccuggaaaucuugucugaggauuuuuguguuccucgagugcccaacacacauugcuggaccuuaaggggacacuuggauauacaugaucugguccagccauaagggcacacagugugggagacaaggggccauucugggaacaguaaagaaaugagaugugcccucagggagcucagacaaggagcugcuggagaccagcagggaggaacagugacuguacucaagccucaacacagauccucaggaacaucguguuggguucauuggacucuguauacagucagaaaagaauccagaggaagcacagcuaagagaauugagacagcaauuugcuguggcaucuccgcacagagguagaaguuuauugauuuguuuccucugauuucagaaguaguuuuucguuuuguuuuuucaguuucuguucaugucauagaccagcgaccccugcuccuccaugccccuuagucugcuggguugaccagauggcuggcacccagcacuguggcaucuaugcauuuaaauauuauuauuagaggcugaggguuuuauaugguuagcucaaguacguuuuaugcauuuuuuuuccugguuuuuuuuuuuuuuuuuugagacggagucucgcucugucacccaagcugcagugcaguggugcgaucucagcuuacugcaaccuccgccucccagguucaagcaauucuuuugccucagccucucaaguagcugggauuacgggugcccaacaccaugcccagcuauuuuuuguauuuuuaguagagaugggguuucaccauguuugucaggcuggucucaaacuccugacuucaggugauccgccugccuuggccuuccagagugcugggauuacaggugugagccaccgugaccggcccauuuuaugcauauuugauuuggaguuggugaaucaacucgaaaaccucaaaagggggcugugagaacacugggcuuuuuagggauagguuuccacguucaccgauuucaucugaauggacuguugaugcuuggugcuguggccaugcccuuggcuccugcauuuaggagcagugaauguggcguccaucugcagacguggcucagcaucauacguuacaagcacagcuuuugguacaggagcucucgggucgcugggagauugaggauuaugagaacuuccuucuuucacacagggguuuauccccuauucagcauuacaucagcuuucucugacuuuggcaugguguuaggaauuuaucagggaaauacguucuguuuauacugacuacauuacgggaagcuuggauaacuguaugggggacuuuaaaauuuaucucucugugauaguuuuucagcuauuaugaaacuaaaccaaacgaaggcagugggggccauuauaaaggaaguuugagaaucugaaagucuugauuucuuaaaaggaauuuuaccauaaucucucucucgauaagaauuaagaaaaauacuuacauguauuaugugcaaaguguacccguuaaauucaccauaauugaaagaugcaauacucugucaauaguuugggaauuguuuuaggauuaaaagugagauccauuuguaagaaaauguuuucauuuuaguaauguuaauuugauaacuucauuauauuacuucucaauauauuacuuugagagcagguaaaaagaguuuuccagagccuacuggaacuaugcuaaucagauuuaugguaccucuuauuuuccuggccuuucauuuuguuuuuguauuuaagucuucuguguugacagcugucauuugaugugagacaggugaagcuccuuccugcuuuggcccacaguugggcagcauuguccccggccugggcuggccucaucaagugaaacaucaugcugccauguuucgacauuuuaccuuuucagguucugcacuuuuucugugggaccauccccucuuccccgccugcccucuucucucugggguguuuuagauuuuaacccagccucuaacacuggacacacaaguccucaguggaguucugucguucaguccgcugucuuggcaaacagugcccaaucaagaaacaaacgugcucugcuggcugcaggcugccucauuucuccccgauccgaggaggugucacauagucaugauccuucccgggccuggccuggggcagaacaggauggcaaacaccucugcaaccucuggguuuccaguccugcccugggugggccuggcuucgccucaugaaaccccgaguacuguuugacucccugccauagcugagugccugccccaaccccacucugaguucagcgcacauccuggugugaacgccaccaucucagggacauccugcugcaaagcuccucucugucuccuuggucucuugccaccuacagucuuucucaugggagccccaccccucagaaggcuccccgucucuccuguccgugaguuuuccuggaauugucacaaugcagagaaugaguucuguggggaggguggggaauguagcccuguggcugucccagcaaguggccccugugggcugguggcuggcuccauuugagacugccuugaaccauggggucuccuggggaggggcuggagcugucaggcuucuuucugcuggaugacguugcuguuucuggcagcaccauuggcugcaucucagacugugucccuuccuucaauucuguugaugucucaguuuguggaaauucggaaaccacaugccuuucucucuaggggugacagcauuguuggccuccauccuccugucaguccuuacgagugucuucaugccagguggugccgucauggcauguguugggcagcuaaccagucccuucaguguggggccuggccuccuccuugccaccucguugguggaggugaccugggaugcuggacccacucuuguuuggacucaguguaggauucucuaccucuuucucccaguuacacagccuugaccaagcuucuuuauuccucugaucuuuuuuguuuguuuguuuuuacuuuaaguuccuggauacaaguucagaaggugcagguuuguuacauagguauacauuugccauggagguuugcuguaccuaucaacccaucaucuagguuuuaagccccacaugcauuagcuauuuguccuaaugcucucccuccccuugcugccaacccccugacaggcccugguacgcguuguucuccucccugugcccauguguucucauuguucaacucccacuuaugagugagaacauggaguguuugguuuuuuguuccuguaugaguuugcugaggaugauggcuuccagcuucauccaugucccugcaaaggacaugaacucauucuuuuuuuauggcuacauaguauuccgugguguauaugugccacauuuucuuuauucagucuaucauugaugggcuuuuggguugguuccaugucuuugcuauuguaaauagugucgcaauaaacauacgugugcaugugucuuugcaguagaaucauuuauauuccuuuagguauauacccaguaaugggauggcugggucaaaugguauuucugguucuagauccuugaggaaucaccacagugucuuccaugaugguugaacaaauuuauauucccaccaacaguguaaaagucuuccuauuucuccacagccucgccaguaucuguuguuucuugacuuuuuaauaaucgcccuucugacuggcgugagaugcugucucguugugguuuugauuugcauuucucuaaugaucagugauguugagcuuuuuuuuuucacauuuguuggcaccaugaaugccuucuuuugagaaaugucuguucauauccuuugcccacuuuuugaugggguuguucauuuuuuucuuguaaauuugcuuaacuuccuugcagauucuggauaucagaccuuugucagauggguagauugcaaaaauuuucucccauucuguagguugccuguucacucugaugauaguuucuuuugcugugcagaagcucuuuaguuuaauuaaaucccgguugucaauuuuuugcuuuuguugcaguugcuuuuggcauuuugaucaugaagucuuugcccaugccuguguccugagugguauagccuagguuuucuucuaggguuuuuaucauuuuggguuuuacauguaagucuuuaauccaucuugaguuaauuuuuguauaagguguaaggaagggauccaguuuccguuuucugcauauggcuagccaguucucucagcaccauuuauuaaauagggaaugcuuuccccauugcuuggcuuguugaagaucccucugaucauuuuuaaggcugguugagaccagcccuguggaggacuuccuuaauuuucaguggcaauguuuuuaaucagugagaugacucacaacacuaaacaauuccccauauaucuuguguguuagguuaagggaauaccauguucuuuuuuuuuuuuuuugagacacagucucacucuacuacccaggcuggagugcaguggcacgaccucagcucacugcagccuccaccucccagguucaagcaauucuugugccucagccucccaaguagcugggacuacaagcacgugccaccacacccagcaauuuuuguacuuuuaguagagacaggguuucaccauguuagccaggcuggucucgaacucccaaccucaagugauccgccugccuuagccucccaaaguguugggauuauaagcgugagccacugcgcccggccugcuuuacacuuuuuacauagauccuggugagaaucggaccugggauuuuucuaugaaugagagccuguuguaugccauacccccaccccacccccuuacccccaccccuacagccuuccuaauauaaggaagaaaugaagcagccgagccaucauuaagcagaucaccucugaaaaugaaggaaauuggaugaaagcucugccccggcagcugagugcuaaauuagggagaaucacgggaggccaagggcauggccgggcuuugucgcugccuuauuauggauuugauaagaaacaacuuuuuugacuguuuacauuauggaaaugugauaacccguuuguauuacuuaaacugugcauuuuguaaguguugucaaagggagggaguaauuuguaacagaagcagaguauguagaaacuguucucguaaaagcguucucuaaauugcuuugcuugcagcuguggagguugccauaaagaaugauuucucauauuggauuuucaaagccgcaggaguggccacagagcaggcaacggacagcccaaugauuuaagauuauuuaaugccccaguugucgugaaauagaaggaaauaaacuccagugggcugcuagaacacauuacuacaaucucuuaaugccccaaacuaggagacugauuuaucuccuguuaugucuuauuaagugacauucagaagaagaaaagaaaaaaaaggacagccaaagcugauggcugaaaauuacccugaaaugagugugaugcaggcaggcuuguaucguucuuaaguucaagaacccaaacuugaacucaacacuuuuucaguguguuuuauuuguuaguacagagauauuugaagaugacagauugggcauaagaauaggccaaaaggcugucugccccagugcuucccagacuucauugagcacacgaaucgccuggggcucuuuuaaaauguagauuccaauccagaaggucugggaaggagccugcaacugcauuucuaccaagcuccuccaugcuuccaaggcagcuguuccuggggccaugcuuugaaggagcaaaguucucauucauccugcagaaggaaccugcagaaauucucauucauccuauagaaggaaccugcagaaauucucauucauccuguagaagggaccugcagaaauucuuacucauccugcagaaggaacauccuccaggcagaaccaaaaacagcucauugucuuccuuuaugcaguacacuuagggcaucccuauuccaaacauccgaaauccaaacuguuccagugagcauuuccugugaauguuaugucagugcucaaaaaguuucagguuuuggaguauuuuggaauuuuggauguucagauuagggauguucagccuauaagcauuccaaaauccccgcaaaagaaugaaaucugaaacacuucugguuuuaagcauuucagaucagggauacucagccuguuguucuuuauuucacagucguccuuucguccuuuacauaacuguugucccugucucugcacagcugauugugagugaucggauuugaacucccuacacccucuaucuaacccauuccccucuugccucauccucagugaggacaaagaagguugcucugggcugcuuaaauugacuccuacaugcucaguauauauccugcauguaccuguuuuuuauuuuuuuuauuuuuauuuuuuuugagauggagucucacucugucacccaggcuggagugcaguggggcgaucucaucucauugcaaccuccgucuccugaguucaagugauucuccugccucagccuccugaguagcugggauuacaggcccacgcuaccacaccuggccaauuuuuguauuuuuaguggagacgggguuucaccauguuggccaggcugacaacauauauucucgugguucaaaugguggcuuuuguuuucauggcauucugucaugaacccagagcucuugaugccuaagagcugccuaaggcagacccauuacugccuaagaagaagagaauuggggcuauuaaacuugcagguuugcagguaucccagccagcacucuugagaggcaguguccauagaaauagcggugaugaucaccaggcucuccaguacggauuccuaggacggggcagcagagccaugcacuccccagugcacuggcugguacuggggcccucaaugccccucugggggcugcaaacacaagagaucugggcucccaggcccuaugcacuucugcagggcacaggcugcuucuugcauucuuaaguccccauggauaggaaagcccaaugaauugggauggucuccagugagggcuucacacuuccuuuauaacaugcagcauuuuagguuggugacuggugugcacugggccaaggguccacucugucucuguccuuacccccgggcuugaggacuagccccugccaaaugucuuacgggcucaucccagugggcuuguugagugggcugcugaguuugcaaugccugucccuccucuauuuaccaaaagcaauguuuucucucuucacuugcuaggguuucccauucucccugugccuccacccccauccuccuggcagccagauggucuucccccucacagccaucacucccucccuccuucccuccuucucucccucccuuccacugaacaacucaccugcuggucucuggaccuccugccacauaaaccauuuuccacacugagaccacuucucucuccugcuggaaaccuuucaaggauugccauuuaggagagauguuaaguccacuccccuagccuggccauugaggccuuggcucccuggccccucccaguccugggcugcaaacaaacugaagcucugggcucccuugacccucagccauugcccgugccauccucucugcuagacaucaugacucagccagaccucagcugugugacccacuccaaacaccagcuacucuaugaagucuucccaccuggaugcaagcaccagacccucgucuuccucuauuuccaugaggcaccaugggcaccccucaccuccccucagagugccacccauaugcgaugcaaucacucucaauagcccugacacacacaagcagggacaauguccuaagcaucuuuacaucccaggacaagcucacgaguaggcaugcaaugacggaauggaagaguggguaaauggacaauagauaucacugcuugguaccuuccacuacaagcacuggacuuuuagggaacagcauuuaagccauagcgagaaaauagcuaaugggauuucugaaauccacaaugaaaugucaaguaaaauguuuccuccuugggucaaucaaugagcugauuucuuauucucugauauuguugugggcuugcuuuagaccuaaccguacccuucagggggcuuacugcaggugcacauuuucagaaggauggaguccugagagaaggcccucguuccugguccucacccauccuccaccccucucgacccgcagcagacacccccaggucuccucuuuuccccccgccucccugguuucccuuuggaggugcuuucaggauaugcugccuaaugcugguuccuguuagacagguucgccugagggcugagggauuucaucuagaacuacagccccucgaggggacuccaagaacucuuggcucuuuggcucccaucuggcucccagcuugcucguauuuguuugauccgggccuguguguguuacauuuuuauaggaucucccuccgaugugcacaucgauuuguucuguucagaugcuuuguguggaacguauuuuauguggugguuuuuggaguguugcacccucuagagaaaaugaccuuucaugcccgugaauaaugaggcuggaaauauuucucuuaacucagaagcaucugcacgcacuuguuuucacacuugaguugaugagccugcucauggcaugacuuuccuccaaagaccuggggauccgaauaaugccuauuuuuagugccuccugaaaacaggaaagggcagaccauggaaauguuuccuuugugggaguauuuagcuucaaguuuagcacugggcaggaguguguguguguuuauaaguaugauuugauagaucauuuuucucaacuacacacugaagaaggggaaaaugaaucauaaaggacuaccuggagaccaguaguggcuccagcaguggguucugggcaagcuguggcugcgcagugccugccggccuccagaugagcaucccauucaugcuggggagaagccgggacagcuugagcaacuuccaguguaaaugggcuucauucacugugaguuauuuugaaugcccucuuggcccuguagggaguugcagacgguaauguaugcauguacauagaggcaaaaccucauagauccuguuuuguuuuuguugaaacacuagguuuuuguugaaaauuagaggucacaaugugacaaaaucccucuguucuuaaaguaagaagagccacccaaucccagaagcauauucaugggaagccaguuuucauagucuucccagacuucuucagaaaguagcuguuggaaagaacccugucugucagugucuggaagcucauugccaugugugugcugaccucgcacccuccuaggggaggcagggggcugagaccaucugaagccaccagcauuguaacacacaguagcagugguguguucagaaagcacuuggacuccaagaucaagguuucugccacucacaugggcagacagauaucuagaaacaaccaugacuguaauaacagcagcuggucaccacggagcaggggagugccugcaggggaaggagcagccccugggaaaagcaaauccgcuccuccuggcccagggccugaaaccugggaggcuccucgucauagggugggcuaagccagcucuuucuuccuaaugucagugagguuaugcacuuggcauggcggagagcugcccccuccuccgugagaguggguuagaagaugguggugguguuaacaaggaaaaauaacaccuaauguacacagagcuauauccacgggaaccuguucuguggacuauuaaaaauccaaaauucauguugagguccuaccucucaguaccuuagaaugugacuguauuugcagauaggacccuuaaaaagguaauuaagguuaaagaagaucauuaagauauggccucaucccaucugacuggugucuuuauagcaagaagagacuaggacacagacacacacagaggagaggccauuugaggacacggggggaagaugacccucuaccagccaaggagagaggccucagaaugaaaccaacacaucucacaccuugaucuugaacuucagccuccagaacugugugaaaagaaguuucuguuguuuaagccccacuaccuguggccuuuuguuagggcagccccaacgaacuaauacggaguccuauuaccaaucuuuguuaugagagcugccccugaagucacaucaguugcauuuccggauuccaaauaccuuuuccacauagcuggguuggggucucucucugucgcccaggcugcaguggcgcaaucucggcucacugcaaccuccgcccuccuggguugaagugauucuccugccucagccuaccgaguagcugggauuacaggugccugcccccaugccgggccaauuuuuauauuuuuaguagagacgggguuucaccauguugcccaggcuggucucaaacuccugaccucaagugauccacccaccucagccucccaaaguacugggauuacaggugugagccacugcaccccgcuggggacaggcuuuugaauccuuacucuuuaaaaagaaaaaaaaaagguguauauuuaaggccuacaaugggauguguugauacacguagugaagugauggcuaccuuccaguaaauucacguauccaucaucucacauaguuaccuuucaguuuuuauuuuuuguggucagagcaccuaaaauuuacucacguagcaaauuuccagcauaugauacaauauuauuaacucuggucccgugcuguaccuaagagcucuugacuuguucauggacagacugcaacuuucuaccguuuaacuuauaucugcccauuuuccccacucaccccgccuuuauuuagaaugugggggaaacagagacugaugcacuguaucuaugugacgauaaaacuccaucauauuaguuagaagggaggagaguaacguugcuuuuuuauuucuggaaaucagaaaucauauugagacaaaguuagaaaaagccaucuguguuuuguuuggccuuguauuggauucauucugaaucgacuacuaaaaacaaaaggcuuugcuucauuucuucuuuccuuuuuauauuugaaagcacuguuuggguugugauuuuugugaugccuuuauuuuauuuucugggacugugggugauuuuggcaaagauguaugacccuuaacucaaaagggcgcgguuuacaggcuaacugaggguggguuuaugagcagcauuauucugcaggaacacagaacuguacagacaaggcggaccacagaguggggccugaagcagcaaccugucagccuccccuugcugcaaacaccugcucugccccacuggaucccagguacacucguggccaugugugugggugggcuugaacauugccacucccccuccaagaacaaacacccccucuccaacacuaagaaaaauaucagcauggaacauaaacguuccccucagauaaucaaauaauucaccccaaacuguccacugugccgucacuggcuaaagcgagcugacuuuucuguauacacgccauaucauuuuccuggauuauuucccaaaacuugacagaccuuaggaaagcuauuuuugagacuuugcugacaguuuuucuggacccacaguauguauuucagacauuucaguaauaacucugugaccucauuauaugcguauuuuuguaugauccuguggguauuggugugaggacacaccuuguauucuuauuuaaaaaucccaaguuaaaaacagcccuggccuuuucgagucacguccguacaucugaguuuggacuaggagagugacuuaguucacuacaacauuuuaccaaaagauauugaagcaauguuuuuuccaaaauauggcauaacacagaauucuuggauuugcugaaauccuacagauuuuucuguguucguuuguuugccauauucaugcaggugauuugcaggugugcaaccuggaguccagcugucuugcucuucaugcugggcacuguuuguucucugcucgcccagcacaauuuauauuacagaacucacagcgagguggagagaagacacaguguccggagucaggagcucuggauucgagugcacauucacccauugauaauacugagcaggcaauucaccaaaaccaccuugugcugcacccucuugaauagcaacuuaauacauguccgggagccgccucauauaguuggguuaguugagauaaugaacuuggccagcuuugaaacaggaaguuuuugaaacuugccggugugccugcauguucugugugugccacucucaugcugcuagcagugccuugccuguucuugguguucuuggaagauaccugagcucuuacuuugacuccucaagguguuugguucgcauucauugacaacagugcaguuuguacccagaggcucugacuucacucuguugaagguuaaagaagauaguggccuuaggggagucaucaggccauucuacugaagguggguggcaucuuuaaugcagcuggcagccugucuggggcaugguccuugcucaggacuuauuucccuucuuuuuucucaccuuuaaguagaaauguacauaaggacacaacuagauauugauuugcuaaguucagugauauucaaagugaaaaugauacauauacuucuggauuauuuucguugcaaaauuuguucauucuuucccuauucggugugcauugagugccugcuaagggcugggcagagugcuagaagacgggaacugugugagccagcacagguguggagccuguuuucugggagcugagaaguuggggguggagaggaggcacacuggacauugcuugagcagccaaaugagaugacaggugugaucccagcacacugaaggagaggcacacgguucucuaagagugugugaggagacgaguagggcugggauggcugggagcugugacauuggaaggacuuaaccaugugugcaggaggcaguagccuccuggggagaggcagcagcaugugcaaggaugggggcccagcacuggguucauccuacaagcauguguccgggccucaaggccacucugaugacugcuuucccucccugagccuccugcagugagagugaagcucacgaaugcuuuggguguggcauggcaguguggucucauuguguaagguguuuugauuauguguggacuuuugcgccaggacuauuuuaaaugcuggggaugucgugcugaauaagccugaccaagccucugccuucguggaguuugccuucuacuuaggcaggggcucagauaguaauccagcaaaccuauaacugggcccugcaaugucagagacuaugaguguuaugaauagaaauagauacaguuuaacaaggggccagaggggccugaaaggcugcauugcugugggcagggaggucugggaaaggcuuuggagugugggugcuggggcugucccuugaccagagacuggaaugaugaagccagccuugccaaaggguccccucugugacuugcucugacacccuaauggcagggaucugccuccuugccuccucucuaccacacaaaacugauugccuuccccaaggacaacaaaggagaagaaaagaaaacgaagaaaucagaaaggauaaaaccaagagagaucaccaaaggcgcguggugcaaauacugaucacaucaguaagaaaacuguuuccaucccugauuugcuuuucuuuuaaauaggauauucagucauagcuucacuauaaaauugauuuauuguguugaaauaauuuccguagcaggggaacuaauuggauuguguagcauaaagaaaauguaugugggacaauggggaagaauugagccaaaaugaauccaauauauuuuaaucucugcaauacagauuauauuuucaauuaagaagcuuaacuugcauguguucggcgggcgggagcuucccagagcacuucccgcauguguuuauggguaauaaaucacuuagcauuaagaagguagacgaucauuagcccaugaucacucaguugccuccuguuaauagcaaagucaaugcacaccaucacuguggccauauucgggugguaaaauguggaguuacauggaaaguggaacuguuauauuggugaauacgauuuacuagacggaacaaggaaaaccugaauuccauccccugugggccauggaaagcccauauucacagucaagugugaaaguggcuuuugggccacccgugcccugucugaaagcagagcaucauguggccacgugucugcucggcucugccuuacuaauuguguuuaaccugagcucugcuacagacagacuuuggucuuugcuccaugcgugcuucuggcaugaccuaggaguugcuugccagugaugggcagagggcgagggcaagacgcuggcuagccuuuguccagugguccacuugucugggaucgcauuucaucuuaaagcaacccaugagguggaggaaccaugaucaucauauuauauaggccauggaaucugccucgugggcugucguagcagagcagucaacaaguuagaagccagagcccuugugcacucaucggugcccacaauaacucauuagguuuuuuccuuuucuuccucucagucccaguagccgucuaagagcagaagcuucuggggccuggccuugcagacacugaccuuugacucaccucuuuaugauuaagacaagagcauggaagaaauaaaggggucauuaaaaaaaaagaaaaggaaucuggcaggaaaagcagaggcagauguggagcugguuuaaaaaucuauuucaagucuuuccaguggcuggcuggguaggcaggggccgccaacacgcaggggccaaugcagccaaggagcaguugcguaaguccuugcguaaguagaaugagaugcccagggcucccuugagcgcggccacguggcugggaaccugucagguuuuauagcauccaaucagacaccgugcaccaggauggagagcccggaaagaggucagagcuggggaaggcaggugggggcuguaaacccaacagcagugugaggaaugggcucaaggcggauggagugagcagaggugucccagggacaguggcgagccugaaacuagacauggggagagaagagacagagacaagaauaacaaugguaguaagguggcagauccucaguuuaaaaucuggccacgaugccauucacuuaggcacuugcuuguucuagaaauauuuauuaagcacuagguguggcagguguagaauggauuugcccccaggaaacccuggaucuggggcuccgagucaucugucuacguccucuggagccuuccuugucgauugucccuucaccuccagauucuucuacugcagggaagcucccuugaccucacccucacccucacuguggacaccucuguuuuguccuucacagccagaccacacagagugguccccuagguccccagccuucacucacucuucaucuccccaugaggcuaaugaaaucuguucuacugcaguuaucaaugguguccucaucaauaagcccacauuaccgcccuccccagucucagacacuguugauggcgcccuugcuguuaagugcucuuguccaguagcuuccaugaccccgcgucuugcgcuguuucccucuggcaugucucauuccuucucucccucucgcucuaucucucucccucuccucuccuccccuccccuccccguccucccccucucucuccuccccucuccuccccucggcccuauccuccccuccccucuccucucuucccucccuuccucccuucuuuccuuccucuauccucccuucucucgcucucucucuagcucauuuuuuuuuucuucugcccggaagaaauacuggcauucuccaaggcucuuuucucagccuucuuuuuuagguucuuauucuaaaaucucucuucagugcucucucauugauuuccaaggauuucuuuauaaguggacugagauugaguacaaaauguaccuucaacucuugaccuucaccugaucccagaccccacuuucaccuggguccccaaggcugagcacaggucccuccuauccccaaggaggugcucugaacccacuccccauggcuguggauggcuccccaaccuucugcaugagguagacacccaguuaccucugcagcguccuucccuucagccaaaccccuccccccgccgccccugcuaaauuuacuuugucacccuuucuagaccaggucaguuccagacaugaccuggaugcuccuucuccuuaaagagugaaugagcaagaggcugggcgcaguggcucacaccuguaaucccagcacuuugggaggccaaggcgggccaaucaccugaggucagggguacaagaccauccuggucaacauggugaaacccugucccuacaaaaaauacaaaaaucagccagaugugguggcacacacuuguaaucccaguuacuugggaggcugaggcacgaggaucacuugaacucaggagguggaaguugcagugagccgagaucaugccacugcacucuaguaugggagacagagcgagacucugucucagaaaaagaaaaaaaaagagaaugaauaaugagcaagaaugauaggccauggcagauuggcacacacauaauuuuauaauuucccuuuuuuuuuuuuuuuuccuggagacagagucuuacucugcugcccaggcuagagugcaguggugugaucucggcucacugcaaccucuguuuccaggguucaagugauccucccgccuuagccuccuaaguagcugggauuacaagcaugugccaccaugccuggauaauuuuuguauuuuuaguagugaugggguuuccccauguuagccaggcugaucucaaacuccugaccucaagugaaccacccaucucagccucccaaagugcuggauuacaggaaugagccacugcacccagcuggcacacacauaauuuucuaaaccagggguugacaagcuguaacugaugacccaauccagcccuccaucuguaguguguaugcaugugugugucccacaagcuaggaauagauuuuauguuuuuaaaggauugaaaaaaggcaagaauacuauuuuauaacagaugaaaauuauaugaauuuaaauuuugcugucuauacauaaaguuuuauuggcacauagucauacccauucacuuuuuguauugucaguggcugcuuuugcgcuguuauaauagcagagucuauuagugaaugcagaagagaccauauggccugcaaggccugacuucuuuacugucugaucauuuacagaagaaguguacugaucccuugacuagacugucaagaauggaaagugcacuguuaagaaugggcacaucuuauucacagacugcaaucaauaaucaauaaucaaucacucugauguaaccugagaacauacuguguagaaagcaugcuguagaggauagcgugugcuuccccuugugcuccccagucuguuucacaaguucuggaugauugaucaaugcucgaucaaugcgagcucccuucuccaucaugggaagaaugggaagccugccccuccccuguggugcaucuggcauccgagcugguguucaucgcuucccucucugcugggugaggaccucgugggugaggacuuccacauaaaaaugagggguaaggcgcaaacaucagaccagagucacaggagacauuaucuuccccguggccgcccugccuggugaguuuacugauuugccuaaggguggugcuggugugugucuugcaccaugccucccuccagccucucagauauguccuguccgguggggacgucucuccuguguauauuuuugguggcugagcaaagugcuugugguuccuuucagccaauugugcugaggcaaaggcgggccacuuaaauugcaguuucucugauguaucuucuaaaagccaaaggucguuauccacaaaggguacuuuuguguaacaccaggcacucgaguagaucuguggggucuucccucugugggugaugagucuggguuucagcaucccgcuuccccagaccacauggccacugauccguggggugcacagaaggacaggcagucacaugccugcuucuuugaguucugccaccuacgagcugaguaaccugggcaaguggugaaccucauggauucuuuguugccaccagcaaauuggggagaguaauugagagggcauuucugagcuccuggcucagcagguagcauguuagagcugcuugaucaaugcgagcccccuucuccuucaugggaagaacaggaagccugcuccuccccugugcugcauuuggcaucugagcugguguucagugcuucccucacugcugugugguugccaaagccuccuguggaguaaggcccugcacugcuucauccuccugggagagcaggcaguggagcaggaugcugcauacagagcugguucuugguucuugaggagggggagcgguggcucugccagcucagcugugaguggucccaggaugaaggaacagcaggaaacaaagauacucucaaggccauggagaagaagugugagguagaugcuggcgcaggagcccacggugggggagaauccgcuucugaugucuuccacccuggaccucaagugucaaacagcaagagaugggcugagcaaagaucacccgucucaaauucaguugacaaucagcaccagccacgucuccugggaaacaugaaguggccuuaaccgucaccugccugucaucucaggcuugccauuagucaggcauucguuaaagaauucugucaauaauagaaaucagaaaugccuggaaaguagauuucuugcagggcagauggagaagacagccucugggucuccaaaccccuuuggcucucacuggggcuucugggcaggacuggggacccauguacaugucaucucagggcagcuuucuuucuaaacccauuuugcagauguggcggcugaggucucauccagcacccagucacgccucucuugggggagagccccaccguugggagcugagcaaaggcaauauuucgguuuuuuuuuuaaaagauacugugaguuggucaucacuagacuuggguguaaguuaacuguuaucucaccacuuugcuaccagguuauaaucaaagaaagucuuagaucaaagucagccacacacacagacauuuaugaaaaauaguuuugcacaaucagugcauacugucuguucuuaggcuucauaaaacccccuucccugucauuugaggugcucugccugagccuugauaaaugauucaucagaagcaaaugagaaaguauucuggaggcaagauucaauuugcauggauagucaucuuagggaaccagcauccuccagacccacagcuucuugccacuagaacacaggguccagcguugggcacuguccuucaacacugggcuuccuacacacacacauccaauccacgcacagcccgggagagucccugaaacauuuuagcucauccacauaccuugcaugguguggaauucaacaaggagaacccauuucucuuaaucauuacacucauuaagaaaacacgaagcucacaacagaaaauaauuucuaacuauuauuauucugugguuucugcuuuugaucaagauaagaauagccgaagcacccacccaggucacucucauggaaugggguuuucugauuaaagauuggcaagcaacugacaagcuuguagcacauccuuuaagcuggcacucgcuguuugaguacuugagaguuauuugcagacuuccuaagucuuucguuuugcuaacugugugucaggaacuguucugggcacucuaugcaaugugagcuuauuuaaugguuaccaccuaggaggcugaugugcucuugacacccauuucacagaugcagaaucuaaggaaaucugcucaguguuuacacagccaacuggucagugguacagccuggauuucaucucuggguguuuauuccuggagucccugcuuuaaccaccauauuaaccugcuucugaacaccaaccaaagcuugaauccagccuuccaaaucucaagccugggcuuuuguuaaggaggacgcucaggguuucuugauagccgaacuccuguauguccaggaaagaauaaagaccagauggucuugauaugaaaaggcagcagauuuuaacuacaaaaugggaaaugaguaauucguuuacgaggacaaaguagugaaaacuguucuuaggcuuaggguaggugauuauaucuuaacucuuugaauguucagucaaagcuauauauucaagauauuguggguucccuaccagaccaccacgaaaaagugaaguuugcaauaaagcaagucacacagauuuuuugguuucccagugcauauauguuauguuuacacuauaaaguauuuuauuaagugugaaaaguaugucuuaaaaaaacaguguauauaccuuaauagaaauacuuuauuguuaaacaaugcuaacaauuaucugaggcuucagcaaaucuaaaucuuucugcugauagagagucuugcgucaauguugauggcugcugacugaucaggauggugguugcugagggcugagguggcuaugacaguuuuuuaaaauaaggcaacagugaaauuugccacaucauuugaugcuuccuuucacucaagauuucucuguagccugugaugcuguuugguagcauuuuacacacacuaaaacuucuuuucacaugggagucaaucuucucaaacucggccaacugcuuuggcaacuaacuuuauguaauauucuaaauccuuugucauuucaacaauguuaucagaaucuucaccaggaguagauucaucucaagaaaccacuuucuuugcucacaagcaugagugggaacuccuuauccauccaaguuguaucaugagauugcagcaauucagucacaucuucagaguccacuucuaauucuaguucucugcuauuuccacuacaucugaauuuacuucuuccucugaagucuugaaccggucaaagucaaccaugaagaucagaauccacuucuuccaaacuccaguuaauguugauauuuugaccuccucccaugaaucaugacucuucuaaauggcuuuuagaaugcugaauuuuuuccagaaaguuuucaauuuacuuuggucagauccauuagagaaaucacuaucucuggcagcuauagccuuauaaaauauauuucuuaaauaauaagacuugaaagucaaaauugcucgugauuaauggacuguggaauggauguuguguuagcaggcaugaaaacaacauucaccuccuuguacaucuccaucagagcucuggguugaccaggugcauugucaaugagcaguaauauuuuugaaaggcaucuuguuucugaguaucaggucuuaacagugggcuuaaaacauucaguaaaccaugcuccaaacagaugugcugucauccaggcucucuucuugcauuuauagagcauaugcagaguagauuuagcauaauucuuaagggcgcuaggauguucagaauaacaaauaagcauuggcuucaacuuaaagucgccagcugccuuagcccccggcuauagagucagccuguccuuugaaguuuugaagccaggaauugacuucuucucccuaaauaugaaaguccuagaugacauauuccaauauaaggugguuucauuuacauugaaagucugcuuuuuaguguagccacccucaucaauggucuauccuaggucuucuggagaacuugcugcagcuucuccaucagcacuuucuguucaccuugcacuuuuauguuauggagauggcuucuuuccuuaagaaucaaccucugguagcuucaaacuuuuccccugcagcuuccucaccucucucagccuucccagaauugaacagaguuuagggccuugcucucaguuaggcuuuggcuugagggaauguuguggcugguuggaucuucuauucacaccacugaaacuuucuccguaaaaaaguuucaccacuaaacuuugcccacugcaagcugagaagauccuucggagaccucuuuggaaacacauagcaaagaaaaugacagaagccgccaucucuuguaucuuuaccaugcuuucaacaguagcuaccaauuauugaacagcugguaggacccagccucucuauagacacugaggcuucuaaucuccuucuucucaagaccucaauaaggaaaaugaguucagagcuguuauuaacuugaggaagguugcacagccuauaagugacaggacaugaaucaauaugaccugucacuuauagaucacuuaugaccuugaggcuccugcucuuucuaguucuucauuucuuuguguguuuccuguagcucuucuccaagggcacaccccacauagagagacccaccaggccuggcuugagugaaacuaaaugcguagugaguagaaguugccaagcaccagugagaaugggaaaauguggacaacgucaccaccugccagguagcaagcaccuaggcuccuacaaaugggcaaaaaaaaaaaaaaaaaaaaaaaucggucucaguuuucagccuauggcaaaugagccuucagcaaaugacaugagcaugcuaaaugauugcaguguccauagcaggucuugaaaaugaacccggauaaauuuuaagcaucacugguguaugcugagcgugaaauaccuugaaagcagcauucucuuuuguaaggauccuauuuucucuuaagcauuucugccuugaaccguaugguuugcucaaggccucugacuacuuccuuuuuuucugggcugacuaggauucauuuacacuguuuuuguaaggaugcguugcuggaugcuguggggaauaaagauucugcacagauggacccucacuguauuguuguagaccaggggccauugccugcagggaccucuguccugggugguguuuggugaucagaggcuugccagggauggcagggacgccagggacagcaaggacggcagggacgccagggacggcagggaugcgagggacggcagggacgagagggauggcagggauggcagggaggcgaggucucugguugucgugauugggcgucuggguguguguuuguuuaugcuuguuuauuaaugccccaccuacuuccagagagaucugguucucugggaagugaagguuagagauucuuauucccggguuguuuugauuuauuuuuuaaucaugaaacugagucacaccaaugguacagauaugaacagaaaaauuaugagucccaugccugcaguuucugaaacaugcccucuuuccuucuuguguuuuuucuuuuuuauugugauuuuauauauauaaauaaauauuauauauauguaaccacaauagaaaagaaaaaauacauacauuacaaaguuugccauuuaaccguuuauaaguguaucauucaauggcauaauuacauccacaguguugcucaguuaucacuacuguugauuuccagaauguuuguucaccccaagcagaaacucucaacucccuguucccaucccccauguauauggaacuaggaaaagacuccaguggcagcugaugacacacauuccuacaccccggcaagcagagcauccaggacaaccuguccugugcccgagggguggggcacggucacccugaccuccccugcuuccccugcccauccauggcuguccuucacucacccaauuagugaucauaggacaacaggaggagccugggagaggaaggaggaggccugagggauggacacuggggugcugaggcggaggucucuggggugagcagacacuggggugcuagggcagggucucuggggugcugugguggggaucccuggggugaacggacacuggggugcuggggcagaggucucuggggugagcagacacuggggugcuggggcgagcagacacuggggugcuggggcggggacucuggggcgacccaagacccuucuuuauuugccgggauggagucuuacagucaggcuuugcccucucucgcggccucccccagcaguagagacuucucacuuccugauguucgcugcuggacauuucugauguguuugucuuggagaugguuuuuucauuacccaagcugcugcuaaauccgucaacauuuauuuugugaaguugaaauagguggacgaggcaggauugggaggagguagaggcgaauaagaaggaccaaguaguggagaguagagggagaguggguggccuuaugauauugaaaacacaauccugaaauuagacuguuagugaugacaggcuuggugcucuggaggugaagcugaggguaccugccuaccuugauuuccagacugguuuaucccaacacuugcuaacuccacguuagggcucuuaguggcuaauugucucuaagcuugauuuccagacugguuuauccuaacacuugcuaacuccgcguuggggcuccuaguggcuaaucggcuccaagcuuuggagggagcauuuuaaggucuuuucaaucaacacauuuuauuuucugaugaccuagaaacaggugugaacucuccgacuccccaccaaaagaaaguagaugaagaacucuucaaaauuuguagagaggacauaucagaauugaaucacaacuuuucaggccuuggcaaaauuuucuuuaaagaaccaacacaggcacaccuacucagcacugcuaguguaguggggaaauggcuggcuaaucccuacuaaaagaguuuugcuguguucuaauaaaacuuuauuuaaaccaccucacaccgauuaggauggcuacaucagaaaaaaaaaaaaacagggaaauaacaaguguugaugaggguguggagaaauuggaacccuuguguacuguugcugggaauguaaaauggcacagccacuauggaaaauaguaggaugguuccucuaaaacuuuaaaauagaauuaccagaugaucuggcaauuccacuucuggguaucaucaacugaagaaucauaagguacauaaauuuggaaagcagagcuuuauuucucauaaaggguugcagccugcaggccagccauuccgcagaccaggaagcguagccuccagcuucugccaagagcaagcacuuccagggaggaggaaugagacaggaauuuaugcugaguggguuggcuaaguauacauaaucaauaagcuauagaagaagucaugaauauuaaugaaggagaaacacacacaugugugauugagccaugccucuucgugggucccguguucaaaaaaauaccagcauuaggaugacccaaggguggagguuuuggcccucugaugucaaaaguucaaacagaggccacgaaaacccucacugcacauccuccuucgacuggccagagccacccugcaguugguagccucucagcaggagggcaugcagugucaaacuggcaagcugucacguggaaacugcaaagagggagggggaguccacuuauggcucagacaaguggcuaaaggugauauaggaaugaguugucugcuucuuguuuucuagagccaguuucugcuuccuccuuaggagagaauucugguuaaaggcuauuaaggaaaggguauacugaagcggguccaaccucccaucucuucauggucaugggcugacucaguuuuuguuguuguuguuguuuuuguuuuuuuuuguuguuguuuuuagacagagucuugcucuuguuacccaggcuggagugcagcggcgcgauccagcucucugcaacuucugccucccagguucaagcgauucuccugcuucagccucccgaguaguugggauuacagacgccugccaccaugcccggguaauuuuuguauuuuuaguagagaugggguuucaccauguuggccagauuggucuugaacuccuggccucuggugauccacccaccuuggccucccaaagugcugggauuacaggcgugagccacggcgcccggcccggauucaguuuuuaagucuucucuggggucccuuuggccaagaaggagucuguucaguccauugggaaacuuaggauuuuauuuuuauuucucaauauuuauccaaaauaauugaacauaaggacuugaagagagaucuguacacugauguucauagcaacauuuuucacaguugcgaaaagguagaaguacucaaguguccaucaacagauaaaugggugguauacacgauguggcauaugcaucccaaagccuccauuuccucauuuguaaaauauugugugauucauaccccgcaagacuugugagcaugaaauaacaugaucugugugaaagcaaugacagugucuggaacuuagggggugcucaccaaaugccuagcagcaaagcagcagaaacuagagguggucgugugggagaggauggaggaaccgguggcugggaacugccuacuuucaggauuucuuaccuuuggcccacgacaauuccuuggccaggaaugcuguuuugguggaaacugggaugguaugcauccagcacgucacucuguuuauuaggcaucagacugguagacaagggcccaguaaucucggcucauggagacccaaguggggaugacacggccucaggcuagagcagacgcacccugggaauccucuguauucuuguuggcaucacagcccaagccuguguccagcagggcugaccagaagaaaggucuggggcauuuuagguuuuaguuaagaguuugauggaggcuuaagcuuuuauugauuugaaaaagaaaagaaagggaaucuuggaaaaaaguaacucgcuguagugcagacaggaaauaauagcaaugaaaucuuuuggcuucccugcuccugaccccagaggucccuuccucgcuuuaaaauccucaggcacccccuccaccccuguugcccacaagcaaauaugcagacuccagagccccacauccccgucucucacggucuggcccaguugaucucucucaccucauuccgaaaacuuucuagugacauuggucuucccaccguuucccaaaucccaaagacacgaggcagaucccacccagucccccagcuuugcauuacuuugcccuugugauacugggggacguucuuagaagucacuucuuuccacauauaugguuuuuguuucccagucaaggucccaagguaggaaguuucuggccaugugagucaccaccuggaugaaggagccacccugccaaguguggggaggugccaggagacggagcggcugagaugaagcauucauuaucucuccuucccauggaacugaagugacauucucugcaucucuauuaucacuucaccucaacuugccucuucccagcaucccugaauuaugcagaaaucauuugaaggcaaauucccagcuacuguugcuagacucauuuuucugcagggauggaggaauguguugcuagacucauuuuucugcagggauggaggaaugugucacuuuuaauuuguuuccuuuuuucccacccauuuuggguaaaacauuguguuaaaagauacaucgucuccacccccaaagcagccugucuucaugcccaagggauuuaaaugcccucauauugaaguguacaagcuaauuauguaacuuaaaguaaguuuagggaaggaauuuaaauacccccacagcuucacaaugugagaaauggggcugugcaagccccuggaaguucccugccuuucuccacauucucccucuguaguaaugaggcuccucaucuuucuguuuuauuggcagcaaacacuggguaacaggggugcuagaagggccugagggucugucauaagcaagggccuauaauugugccaggagccuggaauaguuaaauugguuccugauuacuuuucacucgcuaaguuccccucagcucaauuaacauauaauuauuuaggacuaugcuacuuuuguuacuggcacauggcuuuccaaauaggcagcuuugggggaugaucucccucuggagcccacgcacugcauccauccacccgcccuuuuuguucaagaacaaaagcaaggcuggcgggaccuccuccagaaccuucaugcugcagagaggcuuggaccuuggcaggugccuccugcaggcagagccucgccggccacaccagccugucucccaaagacgcgcagaacugcagaauucacagggcuugucuuucucuuuuaccaaaugcgacuuuacauuuuguaaggugucaguggagaucauaucaguguucagauaacuuuguaucauguggugaugccucuuccuuaccuuuaaucucaaaaauaaaaaaacaaaaccuguagguucaaaguuccagggagcuuagaggcacugggguugagugcuuucauuugucaguggagaagaugagggucucgaaaacuugagcaacauuuuuuuuguuuuaacauuuuuaaaauucuauuguaaauugacaaauaauaauuguguauguguaugguaugcagucgauguugugauacaugcauucauuguggaaugauuaaaucaaaugaauuaacaugucuguucccucacauacuucucauuucuuggugguguugaacaacguuccgaaggucagguagcuccacguuuaaauggacaugaagccauugauagauagauagacauacuugaauuaagacuuuaauuguacaaauguguguauguguaggcuacaauuaaacucauauuugacacugucaagaauuaguaguuuuuguugcuaaugggguuaaauguccaggauaggaaagcuuacugguuuguuguugcuuuaauugcauuggcuugggagugaacccaucucccuuucuuauugaccucacauuuuuuuaaguggauaauguuaugacaaguuugauaaaaaugaugcuucugacuuucuggagacaggaaucaauuaccaagaagagauaacauuucucuccauugagccauuaaaaauaaaauucacaggcuucuagaccuuacggcuuuuugaaucuuuuuagguugacauaauuugccugugauucuuucuggauuauuuauuuguauguuugguuuuaucuccugaauuuuagauuacaaauaauccuuccuuagauuuugaccauuuuuaggacagcauuccugaaagcauuuaauucucacagcauuuguuauuguuuuuuagaaauuaauuaauuaauucuccuggcucagaauaagacauaauuugugugguucacaaggugguugaucccuucccccugaguuucuggcauuucugguggaaucccuaaugagaaguuugcauaagaagaaccugaagagagcugaaucccaccgcagaaaaccuacacgguuuucugcaaggacucagggagagccaggggcaaccaaauacucuagccucccugaggccucucauuugggccagagccugaccuucugagccagcucuuucauccauucauucauucacuuacucuuccauccacuuauucauucauuccugugucaguuaccuagugagcauauacuguguaccaaaugcugacuuggcacugaggacacuuaggugaacaagcagguguugccacugccuucgagauaccuaugcuuuacucacaaucuggagggcuucucuuaccuaaacccaacuccagcaguguccagcacagauagaguugucaggaugcagagucaggcgcauucauaccccacacgcccucgaauugccugcugggcaaaggacuaugauccugcacuguguggagccccucauuucauuuggcaaggcauccucccauccaaacacuuggcuuagcuugcaauccuucucauauuccucuguaacagaaagcggauugguaugcaaaagcuucuaauaugauuuucuuauuuucccuacuuucacauuuauuagaaauaacuuaugaauuacaguaacuaauagauuuuuuuuuuuuuugagauggagucuugcucugucacccaggcuggagugcaguggugcagucucggcucacugcaaccucugccucccggguuccagugauucuccugccucagccuccugaguagcugggauuacaggugcacaccaccaggcccagcuaauuuuuuuuuuuuuuucuugagauggagucucacucugucgccuaggcuggagugcaguggugcaaucucggcucauugcaagcuccaccucccagguucaugccauucuccugccucagccucccgaguagcugggacuacgggcaccuaccaccaugcccggcuaauuuuuuuguauuuuuuaguagagacgggguuucaccauguuagccaggaugguuucgaucuccugaccuugugauccgccugccuuggccucccaaagugcugggauuacaggugugagccaccaugcccagccuguaauuuuuuuuuuuuaguacagacgggguuucaccauguuggccaggcuggucuugaacuccugaccucaggugaucugcccgccucagccucccacaccacacucggccgacuaauagauuuucuuaccuaaaaguuagucucugguuauguuucuccuugccucauugggugauuggcccggggcauagcuguguuuccgucccgucaggugugggcuguaggauaucauuuaugcauguccuggaaguuucugugcaagugacgcagcccuugaugcauugagcccaagcaucaucugaucuuuguuuacugcacugauuaugguuuuauuugaucuuuccuucagcuuuccucaugcuacuugaauuuccacguuguuuuugucccggcauuuaaaaaaauuuauagggaaucugaauuacagaaucuaccucucagcccugcacuuucucagucgucaguuucuuaaaagguuuuuguucagccuucacauuauuuuagcaugacauacauaguuuuuuuuuuuuuuuuuuaauuugagacaagucucacucugucacccaggcuggagugcaguggcgcaauccuggcucacugcaagcuccgccucccagguucgcaccauucuccugccucagccucccaaguagcugggacugcaggugcccgccaccacacccagcuaauuuuuuguauuuuuaguagaaacgggguuucacuguguuagccaggauggucucaaucuccugaccucgugauucacccaccuuggccucccaaagugcugggauuacaggcgugagccaccgcgcccagcugacauauuucuuuaagucauuuugagaacugucuuuauuuaacuagcugcaguugucccagagcuuaauucgaagcagcauauugcaacuguuugggugcuaucuugaggcacaauaauuacccuauaauaauaauguguguuuuaguaaacuggucauuauugucauagagggcuggaaagagugucuucuuaaagcucauaaggacccuaggguacucugcaaauagcagaguucuaaaccugaaggaaaaaauuaaggggaaaaaaaauuguguuaguggucagaagccccguguccuuaugcaucacggcacagcccacccuguaaugacaagaagguguuguauuccacugacacuugggggcuuuucugugaucucugggguugcugcauguacauccucagaggcucucucaacacaguuaccaagggucagguggguuacuuagaccaucucucuagcucauacuuuguacuucugggggcugaaggugacaggacagaccccaucccaagacuggggggcugauuagaguugccaggcaucccguauaugcaaagcauguccugaauuuugcaacuuuuguccuggauccuuuauuaauuugucaggaugcucuaaauguccuguauuccgcuuuuuuuuucuaaucaauuacagaauucagcaauaagagcuuuauucaaauuuaacugggcauccuauauuugcaaaaucuggcaacccugcggcugaggaauguugcugcccagccuguguucuugguuaauggacaaggcagcaaugccugcgucccuccauuaauagucacuuagaaacacuaauuccuccuuucugguuauauuuuaauguccccggggaagaagucaaauaacuccaccugcaguuuucuuuagugaccaaaauugcaaacucugucacaggcccuuugucacagcuguuuuggucccagagcuagccgauagguuucuugaugaaauaaugucugcgaaucccuuucucagagcggcacgcagugugagcgugagagaaucugcagugacagcgggugaugggcgggagguggugguggcagguggcgauggagaccuccuuaaaaccccagguggugaauuucuucuucccuccucccuggcucacugccuuuuagcggcugugacauggccagggcguggggagcuucuccaggcacgcuuggcugaagagauaaugcugucagaggacagcaguuacuaguaaguaaccuacauuucccuucuacucuggcugcuccuugcugucuaaauagagaaaguggaauuagguuuaucaucugugaccuaauacuaauuccucuuacauccugccuuugugcaaagggaaaagggccauuuaaaaaguaguggacgaagcuuuaguauuguaagcacuuucaagcguuauaaaacaaaucuguugaaugaacaagcaugugagaguugguauucuagagucacgugugaucgcccaaauuguauauuucauuacaaaaaguauauaaagucaugguauuauagaguguuaaaauuauacuuuaucaaugaaucaagaaauuaaaauuucugagaaaauucuugucaaaucacuuucaugucuacuaaagcuuuuaacuucuucucuaguaaaauaguggucaaaauuagcauguggaaaguaggccaaugauacugaagucguaagccaugcuuccaagccuggagauauugcagcaaccucuuccaagccugacagcuccuugcgaagagugcuuucaacuggguagcuugaaaaagccagcuaagcaaagaucaguggaaucauagaacauuaagacauggcaacuugagaaaacgauuuaauuugcaccuuuuuuuuucuuuuuuuuaauuagauuuuguuuuaagucauacuuuucaaauguuacuuucagaagcuguuauuuuggucuguuucuuucauccugcaugugcuaauuuccuugauuaauuuggagaacaucugcauauaauuccgugaucuuuucguuggcaaaaccucacagcuuugcgcaagacuuggagaguucacauuccagacagucugggauuguaucuaauugaaaugccaaaccuaccgaagugccagagcguaaguguguaauuauguaauuuucucuugaucuuucagagucuuccugcgagcaauuaaucaguaugcagauaugcugaacaaaaaauuucuggaucaagccaacuuugagcuacagguaagagaagagguagacacgaccuuuguggagaaaucauguuaaaacaaauugcugguccgagccaguaucuuacaguauuucuaauccuugaacuuaauuggucucccauccaagaugcggaaacggaauuuguaguauguacuauuggaaccugaggagugaaaauuauacuuuuggaguauucgcuuaauuuagcaaggaaagagauagaguuguuucagagagaagcuauugaaucagagugacaagaagggacucuucaagcagggaggccaccaagucccgguguguguaucugccaagauugucucagcccaucuuacuguggagggaggaucagcagaggaggagacccaggucugcaccucgagcucagcuugcuuuuauaacucuguguucccuccauauccucucucggccuugugcuacuagcaguggcuuuuaccaggccagagacccugccccccagaccccaugguccucagaaaugcuccuuuggugaaugcagugugugagagagagagagaguguguguguuugugugugugugugugugugugugcgcgcgcgcaugcaugcuguaaggauugauuuugccuggccugauuugugugugugugugugugugugugugugugugugugugugcaugcuguaaggauugauuuugccuggccugauuucuuacugugcauccaaaauguguggcucucacuuccauuguacucuggauguguuucugcuaauaaugauuuuaucugucauuauuauuacuuaguuuauuuuaguaaaguauacaaauuuuugaaaagcaugcagauacaaauggcauguuuauuuccugggcaagaugauucacucucucaaaaggaacccgaaggauuuuuguucacccauugggugauccaaccccaaaauaaguuacccaauagcaaauaauaaguuuacccaaugcucuuucauuugcauugcccuuauuuuuauaauuuuuuaauuuuaaguguuuguuguauuggcauuacaggauauaauuagauaauaauauaucaggugccauauaucuaaacauguuacuuguuuauaaaauuuuuuaucauuuucucugcugaaugccuguuuucauaugucauaauaacauacuuucucuuuauacaauauauaugugcugaauaucaguuuagcagguaaaauaggaaacauuccuuccuaacccuuugcugccucucacugccccucugcagggauaacuuuuaacucauuguucugaauucuuugucacgcuuucagcauuuauaugggccuguguguguuuuuuuucagccuuuaacaugaacuggaucauacccuguguuuuucagcucugucauauuccacgauaugaauguaccaacauuuauucagccauuucugcacugauaaccuagaggcuguuuccagguguuuacaaucacaggcugugcuaccgugagggcugugauacaugugucucuuaguacacgcauugcuauggaaaagguugaucucuaggccaaaugauaugacauuuuaaguuugauggaaaaugaucaauuuccuuccuaacaugauuuuagcaauuugccaccccaccaaccuugagagcagccacuuucuaucuagaaucuucuucaacacugauuuaaaaugauugauuuuuguuuuuauugucauuuuucugaugauuauuuaggcuaagaauacuuaguggccauguggguuucugcugugaauucucugaucauuucuucuccuaacauucguauuuggcugucuuuuuuauaaguuggaauucuugauauaggcuaggcauggguuuaggcuuaucauauagaaauauuucauuuuucuguagugaaaucuguuauuucuuuuacagcuaucugguuucauguuuuacuuggcaaaucucuccuugccuuaauauuauauacuucuaaauuuuacuguuuuguguuaguuaggaucugcuaauaccugugugguuuuguguuuuuguuuuuaucuuucagguguuuaauccauuugggauuucuguaguuaguauagggguaaggaucuaacuucacuuuuucccacgucauuucaugaauagaugacucuuuccccaaugauuggaaaugcuacaauuaacauaauuauaaauguauguguguauaaauuccauuuucuguguuauuauccuagaggcuuaauccuuauaccuuuguacccagcuagcagagucgcuacuuuuccacucguuuucuacugcagaauuaucuuggcuguuuuugugcauuuccuguuccauuuggaguuuaaaaucagauagcugaguuucucuuuuaaaaacauacugcuuggauuuuagcuggaaucccauugaauugauaaauaaauuuggaguaaguuuaugguauuugagggaauacuuugcaguauuuuuuuccccaucucauacuagacuauuuaaguauuuguuuugccauuuuucugguuuuuuucuaggucaggucucacacaugacuugcuggguagauucccguguguuuuaguuguggcugcucuggugggggagccuguuucucaacauguugguucucccuggcuuucguccuguuucaugaggauggccccuuggacucucaccgugagcccgcacaccuuacaagccacgugcuucagggcccacaucgagcgucgccccuuggcaggugugacacacauauuuauuguuguuugaggaggguuuagcaggaaucgcugccugcugucggcugcauucugagagucacagucaggggcccaucuagcauacgacccaugucugcauguacccagcacagaucuuaauuuaaacaccaccgucaccaccaugagugcucuggcucaaaggcagcccugguccuauguaggaaaagaaagaauuaggaguuggugaagcugucauuuaaaaagaagcauucguguuuuguuguuguugcugcugcuguugcuguugcuguuguuguugcugcugcugcugcugcuguuguuguuaaagggagcagguagaaaugaagaucuauugugaguccucgcaggcauggguccuauucuggcugagccccugaccaugauucucagaauacagguggcugcagccagugauuccugccggugcuguggcaaggcugaaaucggugggaggugucagucccaaaaacaaaaggaacgacuuguauuuuauugacuggcacuccccuuucuuuauaaagggggcuaaaaaaaagagagccccauugugggcucugagguugggggugccuggcucagacccccauucugcuucauguguuaccuguagcuuugggcuggucucuaaaucucagcucugcaauggggauaacagcaccuacuugguuauucuguggugaucaaaugagcugguguauuacuauagaaagugugcuguucaugggaaguguuggauaaaugcaagcccaacagacuuuucucaaauccuacaaaugcucuuaaauuuccccuuacuucucagguaauuaaaaauagagucaauauaauguucacacuuuauuuuuauagaacucuuugcagcuaucuccuuugauauaauacauauuaucccugguuuguaaaugagaaaacugagaccuacaacuuucuucuucuaaaggccguugucuuuuaaaccgcauauauguaguccauaaacccuugaaauauggguuuauugaaagaagaaauguuugaucucuuuacauuuguuuuccuugucuaguguaugugugauuuggggguaaagaguccuaaauuauggaaaucuauacuauucuuaagugaggagcuucauaauuacauuaauaaaaguuaacauuggccaggcaugguggcucacacuuguaaucccagcacuuugggaggcugagggagguggaucacuugaggucaggaguucaagaccagccuggccaacauggugaaaccccaucucuacuaaaaauacaaaaauuauccaggcaugguggugcacaccuguagucccagcuacucaggaggcugaggcaggagaauugcuugaacccagaaggcagagguugcagugagccaagaucaugccacugcauuccagccugggcaacagagggagacuccaucucaauaaaaaagagcuaacauugaugaagugcuuacacaugcucuguaccgccuuaaauucugugcauauauuuacuucuuugaucuucugagcacuccuauaagauagauacucuugaaauucacauuuuauccaugaggaaacugaggcagagagagguuagagucugaguaaauggcagacccgggauuugaauaugugcaccgugaccucugagcccacacgcuaaggccugaauuacaccguggguggcugguuagcaacauguauagagugaguguggguuuuuuuuuuaacuuuucagaagugugugcugagcaaaugauaaaugucugagagcauuguugagauccuauaucaagcuguucaacaacuuagcaucuccuccuuuuugguuuucagcuguggaacaacuacuuucaccuggcuguugcuuuccuuacucaagagucccugcaacuggagaauuuuucaagugccaagagagccaaaauccuuaacaaguaaguucucaucuagcucugaaacugcaggcaggagccuccaacucuaaucgcauaauuuucaugucauuucuaagccaacuugauacaaauugagauguaaucacgguguaaugaaagggugguuuuaaaucaccaaucagguauugccuuuucuaacccaugaaucaagaucuaaaauugcaggacucauccuggaagguuccaggucaguguaauccaagacuauuagugcaacacagaauuucagcuuccggagauaauuccuuuugcuaugcacuauucugaugucauuucacaugugguugacuuuauugcuuaauucuucaauucgaaaggagcuucugaugaaagcucuuggcucuauugggauuguugaacagcucacuggggaguuagagcuaucgggguuccuucuuggcagcagauaaccccugucuucuuccgggcaggagcuuugaauggacugaagcggcaccuucuaucauuguaaauaaaccucuccaaagcuccaugaaagccgagauccuugccggccccuccagcucuguaaccccaguuugcaucaugcaccgcucaugacucaguaucaagaagcaccauuguugcauggguuuccuuccccuguuuggacacccggagggucuugcuucgucucuuucugccuccguuucacuaauuucucacugcugucgguguuccuuucauaaguccuuuugagaagaguucugaaauugcauugguguugccacgucaucagucucuguuugucauuuuauaaauaccucugcaauaucucgacuguucuaaggcuuggccaacuccaugcugcuagcugagguuagagauuccagaaagaguuucagaagguggcagcugcucuuauauccugugagucuguaucucacuuucaaggcaaauccaaagcacaucaucucuggagaguaagaauuauagucauaagcugggcucuggugcucagccaguagugguaauaccagcuacuuaggaggcugaggcaggaagaucacuugagcccaggaggucaaggcugcagugcaccacgaucauaccugugaauugccaugcacuccagccugggcaacauggcaagacccccuuucaaaaaaaaagagaagaaagaaagaauuauagucacguacugcauaaccacagacuacaugcuguauuuuuacuguaacuuuucuuuguuuagauacacaaauacucaccauuguguuacauuugccugugguauuuauuguagucacaugguacauuacaaacauguuguacggguuuguagacuaguaacaguaggcuauaccguauggccgauguguguaguaggcuguaguaucucaguuuguguaaguucacucagcagcguucacacgacgacaaaaucacccagugacauauuucucagaacauaucccugucauuaagcaaagcaugaguauauuucagcaaaucauuuacucagccuguacuuuaugucagugacuuucuaagcauuucaugugcauuuuucuucuauaaucauuaaaaagcaaaaccauuccuuaggcccucguaucugcccuaguuucuagaugaggaaggucacacacagugaccgagccacuuggccagucccacaccuagaauguggcaaagcagcauucuaaucuaggcgauucagggcccacgauuuucaccugggcugcuuuuagaaccuucgagcuuuuggucugcaccuaucuaaguaaagaucaccuuucaccuggccaucuuuccuucaggccuccucagcugggugauuccugccugacagccaucuguguaaacagugaucauuguucagaaacaagaaaugcacuugcugagccaagcacugagaaugguguaggcagagugggugcucgccugugacuaccgaagcggcacgcagcagcugcagcccaccaccuuggggccugcacaggugucugucgcucguccuggcuuccagcaucaagagacagacuucuccaggcugcaucuucuggagacuggcucagcaggggcgcaggcuccugcuuuguggaaugcacgcucccucagggcccaggggaagggagggauggugcuuuguaauuguugcuguucuuguugauuugccuuugugcugggaauuguagugcagacgguagugaccaacacacacaaagcacagugcggcacaacgcacuucaacgcacuguaauccaccaggugcggacacaccuccuucagcacgcgccccuuguugucccguccagcaaaaggacagcucggccacagcaggugaagccaccugcccaaguguccagcgcccgcuauugggugaagcugggacccgagcccagccacagcuccuggccucggagaugccugcgggagaagagaggugaauuuaaacuggaaaucugccucaaaagagcuggcaucuucuuagugguggggccgagcaccccgcaagccccagcagggcagcugugugcugggcccuuccuucuguuggugugagcguuaagagccuaaggcaacaucaagacaugcacuaacagcggugcgguggcucauaccuguaaucccagcacuuuggaaggccaagaugggaggaucacuugaguccaggaguuugagaccagccuggacaacacaacaacaccccuuucuccacaaaaaauacaaaaauuagccaggugugguggcgcgcaccuguggugccagcuacucaggaggcugaagugggaggauuucuugagcccagggggucggggcugcagugagccaugaucacacgacugcgcuccagccuggcugacagagugagaccgucugucucaaaaaccaaaacgaaaagaaaaaaaaacauuaaccucgaagggccuuggcuacuaaagaaaacguuugcuucccacguaguggcguggauucagaaucuucaaagccacggaaaauuacacacagccagcuggugucgcccccucaggagccacccagggccucugccuagggcuuucguauucucuuugucacaacgauagcaacaggagacucuggauuucccccaggaaaguccccaggcaguucagaaguugucuuugcaagacacuggcaggacagccucagggcuuugugcugucugaggggccucuccaggggcaugaguucugcuccgcuuguggaggugacaggagauccaggacaaagcccccggagccugagauaagacugccuugaccuucaggccacgcggcacacacguguggagggucagcccuauuuguuguagucuucaugccacuugauaagccuucagcccuucauaguccauuugcaaauuuuauuucuaaauagcaaaaccugcauaagaaauacaugacgauguccuaccccaaugcuuaaauuuucucaggcacauacagugccuagaaaugugauuuguuuaaaauuguccgcauaaaagggauucagugcccacucugugcucagucgggccauggucccggugccggggacaaagacacagaccucgugacgaagaaggucauggucuagugggguaaauggagaagcaaaaaucaugaguggaguggggcacgcaugcaguggugacggagggccuuggcagcccggagacggcccguggggcucagccgugggagacagaggccuccuggcagcuugggcuucccggcuggguggugaaggcagcugagagguuugccacgggacaucgagugccaaagggcauggcgccaucuacauaugagcagagacaugaucuggguugucgaaguguaagggagcagcuuggagcuuggggcggggugugggggcucguggucugggagucaaccucacacucugggcaaacgaugggcgcugacuuggagccccguggagcuugaugcaugcaccugucuguuucucgggggaaaggcaugugguauaaagguggagccaugacacacccacuuaguaggcucagcacugccuccaucuggggccugucucuuacucuagggcuugugaauccaaccuaaggcaucugagggagcauccccaaccccucagccuucccuucccuucccuucccuucccuucccuucccuucccuucccuucccaucccuucccuucccccuugcuaagcccuugcagcuccucacaucugcuugguccacagcuuuguggcucaaaacaauagaaauuccagcaucaggaaaccugccugcuccauccuccuaaugacugagguuggggagauaauuaggauuuucauucuaaagacauuccccaaagugcaugggaguaaauaaaagaaugggccauaccacgcagagaacugauuaugucagacccaaauugaguaugagauucgccaguguaccacaaaauaaauaaccccuaggaaucaaguccauaauaugaaaauuuaacuggcucaaccuucagacauccuuggugcuagugacucccaaggaaggacagagaugucaacagaauucuaagccugaccagcagcucuuccucccaucccagcccccuagccuuuuuuacauuauuggggugcaggaaauaugucuaaaauguaaaaggaaugacuuuugauuagcagccagcuugauaauuuuguuauguaagacacgugcauccuggugugggacaguguguugaaugacugcaaaggagcuucuguguucaggaccggaagaggaacaggguucaugaauugggccucccacauaucuaagcauaaaaugcucacuuaaaauuucagcgcaagagguuaaguuugauggcaaaguccagcucagugcagagagaccauccacaaagaccuccccaccuggucccuaggcuguuuucaguuuuggcgggguggguggguuguuuuuguuuuuguuuuuuuguaauuauagaagucugcaguguucuaagaggauagguuucacaaugggaccaaaauauccccaucugaccaaacacuggguucugcagaaucuucuccagaagauuaugucaaacucuagauacuaccuuuaaggaaacuaacaggaaauaaacaugccaugcaugccguuuugcagcgugaccuaaucagaagcugcaauuguauauuccugauuauaacaggagauacgaucaauuuaauuugugucugugcucauuuuuuucaagagacugaaauuauucaaaauuaaauucacuuauuagaaggagacucagggaguuagacuuaacaaguggugaccugugccaacuucaagucagaaaagcucacugugucccacaugcaccggugguguuguuuuugaugucccacccccucucaccucuuuaggaacccaccagucuuucccaugaaguuaaaaaugccucaccccagccaugagcucccuccagcuuccuuuagguccaucucagcccuuuccuugucuccuuuccccaccucccacccacuccgaugcuggcucugggcacugcauugccccagaaccucagccagguccuggcugcccccaagcagauggaggguauucagcucccuagauguucuccccacauccucaacauguuucuucuuucccuccaucucagaacaugcuuuucuucgcucucaggacucuccugagcuuuucuccaagcuuuuuggugucugcucucucuugucagauuccuaccccugcaccccagcaucaaguggcgguggggguuccgcacaccuuggucuuaggccuucacacucuauucucuuuccuuaggaaagcauuuuucaaacugcaggucucaaccuuugauugggucagaauauucacuuaaagggccaucauauccauuuccuaggcuggucugccauaacagugaacacaaaccggguggcuugaauugauugucucacaguuauggagggcagaauucccaaaucaaggugugggcaguguugguuccuucuggagguucugagggagaagcuauucccugccucucuccuggcuuccgguggcugccccggucuuuggcauuccguggcuuguggcuguuuuacuccaaucccugccccaucuuccuguggccuucuucuuugugucuuccuaugugucugugucucucaaucucccucuccuuauaaggacagaggucacuggaucuagaggccacucuacuccaguaugacuucaucuuaccuugaguacaucugcaaagacucuauuuccaaauaaggucacagucauggauaccaggguuuaggacuucaacauagcuuuaaaggggagacaauccaacccacacuagucaugaccaauagacuuuucuuuucuuuuuucagugaaauagaaucuaggaaaaaauaucagcauucauugcaggcaguaagguuaagcaucauuucauaaaacuuuauacacaugcauguauauuaauauaugugcugguuaauacauguauuuuuuaugucagaaaaguuuaugaaacuuaaaaaaaaaguggcggcagcggggacgcuuuaaaaaaaaccugccuccugcagccucugcucacggugcaccccucacccccuggucucucaaacaggagccagcucuguguucuguagccccacccaccaggcacuccccuacucccucccugccauggggccuuggcgccugcugguccuccugcccagaaugcucuucccuacccucuucguccagauuucgucucuccuucaaaucucagagcaaauauuauuguccuagagaacuccugccagagccaagcugagcccacuguuacauuuucucacaguucccauguuuucccuauaaagccaugauccuggcuuuugcagaaacaauuccucuauguaucuauccguguuuaucuugugugauuauuuuauuaauguucgucucuccuaccaugcucauagcccacugugguuugugagucuugucuguucuccauaucauaguaauauuaauauuccaauaugaauauucauauuuccacauuagcuuugugucuggcccaagugcucaauaaauguucacuaaaugaaucgaucuaaaugaccauugcaaccaugagaggaauauugugcccagccugagauuuuaaaggaaggaccuagaguggcuccagugcuugccagauagacagggacaucaucacucucuuguuguucacaaaagccuaggauugagcaccaugcaccauucuggcagcacuacagaugaggagacugagggucagaguggucaaguaaauugcccggugugcuuagauucaggcucaggcuggccuuacccccaagccugagcuaucacucggggguauguuucuuggagugaaggugcaagaaaccaggugcuaagauuaggccacagggaccaaauucacacgauuuuauguccggguuacagccuggaugugggaucccagaucucccuggacgauaggaagugugccuccuaagcguagguucuccugcucacucacaccgugggugggcucagguaagaagcucugggcagagcacggugaccccagcucuaggccauccuggcucgguggagucgggcauguguguuccccacugugaaucucagcucuuauugagaaaaugggcacagaaaugucagcuugcucagcucauagucuuauuccaaaaucaagugaaaggaaagcacuuugaaagaugugacgcugugucgugcuguggaggcauggaaagucccuguccugggggugcgugcugugggugugggagucugaggacuuggauucucuacucuccuucccggugaggauggccaugucauuuugcuucucuccuguaugacuagugcaguccccuuggcuguuuauugcuagagaggaacuuaguuaugguccccaggacugccaccagcccgggguucugcuuccaggcaauaagcuuuauuagcccuacgcucucaauuauccuuuuuuccuccuccaugggaagaacuaagaaauggcuugggaagcccccuugaggucuggugacagcugugacuuuauuuggggauuacucuggggcauguauagauucaucaaagcucccuucuuauuaaaaccaaggaaaagaucccucucacugccagggaccuccagccggcccuuccccucacagcuccccacucuuccucacugcugcugcucccuuguccuauuugacaauuaaaaccgcaucuuuagcaccuugaugcccgcaggcccggcucuccugaggggugggcucuuguauccuugcuaaucccccaguucucaaauacuaccagcaacugucaucuuccaccuacaggacaguaaagucuaucugagaauggaaaucccucaccccucagccuccuucaccacccaagggagaagcacugugcagggaggcggggagggguggggagcaucggggagggguggggaggagcagcauccgggagagguggggagcaucggggagggguggggagggguggggagaaguggggagcaucggggagggguggggaggggugggaagcaucggggaggggugaagaggagcggggagggguggggaggggcaaagaggauggggaggagcggaugcaccuggccucccaaauccagauuguggugccagcucuggaaacacagcaagucacuccugaauuacccaaaccgcaaguggaaaauccacugcagcugaguaucauguacuuuaggaugucugaacuuuaggauuucccugggaucauuaucauucuaaucauucugggaccugagagaaguaacugagucgggggccagcaaggcacagacacugaugaaguucagccuagcaguggccaguuuuuuuuucuugauacagagucuuucucugucgcccaggcuggagugcaguggcgagaucucagcucgcuacaaccuccgccgcccagguucaagcaauucuucugccucagacucccaaguagcugggauuacagacaugugccaccacgcccagcuaauuuuuguauuuuuaguggagacgggguuucaccauguuggccaggcuggucuugacuuccugaccucaggugauccaccugccucggccucccaaagugcugggauuacagacgugagccaccgcaccuggccugggccuuccuauuuugagggaaucaucccagaaugagaagaacucuguguagcugggaugugagaagcaugugcagagcuugagugggucaguacaugcuaggccgaucccacugugagcauuucaccucugcugggggacaugggcgcaggggguguuuguguucaggggggccaccucuuucugaugccacuuuccugggcuuguccaaccccugcuuggcuggaaggggacucacccaccugcacaucgagaaccucaccaaccucagaggaaagauuagaacagggcuucaccacaguuuugcuuucugugugucccaccccugggaaaugcugcaaggacgucagccugccaggucacccugcagccaacugcauccuuucccagcccuggccgcagcagcugcugggaucccuuugucauuagugcaggagcaaaaugggaaugggggagccagcacuacaagccuccaagcaguguucaggucguguguuuccugggcaauuggggggcgugaguuaugcagggcgcuuuccucucucccacccacccaaguccaguagcuuugcugccugcgugcuuuccccaaccauggacgggccucuccuaccauggccucaaugcugggccgucuccccagcugagaugcccccuccuuaaccgagucugccugcaucagugcucaccugguuuagggcugcgcuuagagcuagcguguccugguagggaguggccuaggcuccaguuccuuuucuucaccagcacugugggccaaggcgcauggccucccacgcaccacagcagagcugccaggugagauugaucuucugugguugagaugaucacucuuggcuguagcccacucaugccgugagugacagacaggugcuuagggcaccagagucuucucuaauaagguggcagcuggccgcgguuguugauuuaccggccaggaucuucgccucaagaaccacagugcgcucuucuguaaucagugcuuuccuucucacaucuccugacacgaggaugagcagagcaggcucgaugacacagcugcucaacuguaauccuguaugauaauuuugcaaauuauuauuuuuaauaucagcuuuuuccuuaggcaauaaaagaaaaaguuaaauugcucacaaacuaauaaagguuuaucuucuggagcaucaaauucuguuuacucaugaaacacacaccuccucuaugcacccaucgagaggaaaauuagcauuuauuuucccugauaaacaaaaacaguggaagauuuguuggcaucuuuugguguuaagcccuuccuuacauuuaaaaugacauagaggaaugcaagaacuuuggaagaggucugcccugacucuggauuuaauuuuaacuuuggaaagcaaccuguugugugcaguaggauguuauguggugucugcagugccuagacgcuaacgacaugcauggaaccaagcucccccuugggcccaggagccaagagauugaagaaagggaaaugcuuucaugacucuccacaaguuccuccacguucccaccggggggaagauguuguguaacccucagugaugagaaagugagauuucccccagcuagauuccuccuccuuugauucauuuugguggcaagagaaguugaagcuuugacacucucuuuauuugccucagugcuagaaggcuuuaauugcacuuaaaaauaauuccaguccgauuuucaaaugccuuccggagugauucagcguuuuucuuuucccugauuuccagguacggagauaugaggagacagauuggcuuugaaaucagagacaugugguacaaccuuggugaguagccuggaugugggggcauagugaauaucuugcaucccuggugggucauggcacuggccguguucaucaguguugggaugucuuaagaucuuaauggcuucuguuccuuggacagcaguugcuacucuuuguaguaacuguuuucaggaauuaagagauagaagaccaaaggcaaggaaagaaaaucucacggguggggcaaaaagaaaaauccacagagcacccucuuguguuguguggacacguggcuuggagcuccucccucccugguguugccucccucccucaguugccucaguuccuucugcgucaaauaggaagcucauccugcugugacauuugccaucacuuaccauauucaguuuuacagacucugccuucuaaaggguuaauuccccuccucaaaaccagaucuaccugguggcagccuaacaugcuccugcacucaaagcagugaagggucuguguguguauaugaaauuaauaggaguuuauuuguaaauuaaguaauuuuuuccaacuacuuuuaucaugaacaguaagaauaaauucucuauuaaaauuuuaaccaaugugacauguaauucuuauagauaagccccuucaagaaaucaaugacugacaauaacuugguaucuucccagcaucuuuacacuacccucuaggaaucuggccucacuccucguugagaugaagcucucucuggcuccugccgucagcccucgggcuugcuuugugccgagguguccuaggccauggggugcugguggccuugccucaguccugagcaaagcaucaguugcuuuucugccccaggaucuccaggccucugcuuccuuccuucaaauggacacgagaagccugcauuggccuguugcaagaaacccuccacucuccccucuaccucagagaaucuuuuccuacuagaaggaggcaggggucuguccgcaucacucuguuagccucguagcauuaggguuucacuuguugcaccaggguugggacaacuuagcugcaccccagccugcuuacuucccaagcagcugugacucccugcaguggcuggagagcauggcaagaaagaagcagaacccagcgagccacgcuucacuucuagcucacuguuugcuuuugcaucuuccuugccauucuuugguuugacaugaggcccaguuagguucucaggaauggaaagccacagcagaugcuccuggguggggaugaagagcgggucagaguggcccugucugccugugcccucccaguacaaagagaaccugcaccauugcauccuuucugcgugucaguccuggagucaguggaggacuccucgaggaagcucugugcuaggucucugcacaugauuuugcugcaguagcuccuauguccagaaucugaguacugggucucagcugucaaagggccugcugaucucugcaacaugauaccuaccaggcaccauccuguccuuggccuuccugccaucccagggaggaagguaggggcucuaggcucagagucaagagagaugauaagucccaccuugaaguuuucauccucucccacuccugccuccccgugaggccugauucacauggcucagucuuucugggccguuagauaaagugguuggacugaauuuuucaagagccuuccaauuccaaaacucaauaauucuaugacauauauauacgaugaucucaguaauaacgugcuaaggcuuuuagaacagggaggaggaccauccgugauucauuccaauugaucucucuguguucuuuguuaaaauccugcucugacagaugcaucugucauuugcucuguuaggccagacggcaggccccacaccaggcagggacccaguguggucccaugagagagagagagaggcaggagacgggggagggcuuucacagcaauggcauggaggggggcuguucucuguuggaacucagugaguccaggacuuuuauaggcaccaacguucaugaaggaggugauaugagcuccaccugccacaguugggcucucagggcagaccccagaccucuucucuggacacaggcucucucugaggccaucuuuuacccuggccccuccuaaaagagugaguccauuuucuucuguguuguuccauuucaacucuaaaguauagacagggaauugccuauuucccccaagaggacacuugcacauauacuuucaaaugaagguucucauucuggaauggcucgguaacauuucacaucauuuaugauaauuagagacaccacccuagcggagggucugaugggucauuacauacugaaaugcuuccuucuccccguacacaacugcagccaccauuugacucacccuggccccugagcacccccaggauccuccacugcucuccaugugccaaggucauugccuagcaccaagggagccucuaaaacucagcucgagccacagcuggccagaggucacccugacugaugggugcuccugccuuucuaguuuucugauuugggauuguuuuuguuuuuguuugcaaguauaguuaaugucaccucuguagucccugagauugaucaccacugaaaguggcuccauuucaauuugugcuacgugccaugauaacaaugaaggaaggaaaggcgggcccagaaagggugaguuucuccgcgugcccucuccaagugcuugggcaggccuggccuucugaggauacacuugggucugacacagagcacuugguucucuugacguuaucugucaugcuccagauaggccaagucaagcgacaggagacuuuugauuuggaaaagguugcagugaagugagcaagcuccccccuucccuccuaucaguggcugauuugaauauggugauuaaugcaugagguguguguuuugcagcuuuuuagccaggaacacugacuguggccugagaagcggccaagaggucaaaaguaaaccaaagccaauuagggucagggacuuggaaacaacaagaaguaacagucagccaccagacuuggguuccuugcugguaaaauaaguuaucuuucaaagugagggaggugaucuuaaaagcaccugcagcccacaggauccuccccaagcagccccucaggauggcuaaggauagcaccacgggguggccuccuuccugccauggugccaggugccugagugucuuugccaaggcugucacacuccaaauuuaugacagcacaucucaguuucccaggauguauacaaccuacuuucuacauaguuuuuuuuuuuuuauuuuaauuuuacuuuuuguaaaugggugcagguuugggaacauauuggcaggaugauagcaccgacucugccaagaaaauagaaauggaaaucagaucuauuuaucugcuuacaauuaauaaacugucacuugagcagaccuucagcugaaugcuccaugagucuccuccuucagucuuuccaauaguaugcauggcccauagagaggagcaucucagcucuugccuccuccuugcccagccucagagcaaggaucuggggucuguuuugcucaauuuaaugcaagggcaaacauggcacugccccaugggacagagugauguguuucuuucccucccaaaccugucauauuuugagucugaaaggggaaaucaaaagcaggcucucucucaaaagaaaaaaggggggaaaaugugcuuauuuacccagcuccugaguuauuuaucaaagcgcacucugugcagcagccugccggagcaccugaucuccuugccugugccgccucaauuuacauuuuguuuauuacauccagcacacuggagcgagcacuagaccccagccagccagaacgaaugugcuuggagcaagaucuuuauccaccgcguuggguuugggauauuuuucaugcagggauucccuucauggguguuuuuuggcgacugggcaaauugugugcuuuucauuaaaacccguauacauuguggccuaauggguguggccaggugguggaagcuuuugcucugccugcucuuguguauacagagauuuuucugggauaagucuauguuuaaugucccagauuuuugaacaccagugauugcaaagagauaauuuaaacacccacagggaggcuucugacuagggaggccuuggcuucgugagaaaacaagauguuguucccaggggaaagagcuccacguucuguaacuaaaauagacucuagaugggcuaugagaccggcaaggacuggaaguaaaauauucuccucgucaccuuccuuuggcucaaaaguguguccucuuuuucuuuaagucuacacugcaggagucaccuugguccucauugguuccaaaccugaguucaucauuaaauuugagcaagauaugcuccaggggaaaucuauaaugcaaaugucaaaaaaaaaaaagguggcuaccagagaacauuccccacccacuccugcucaccuuggggaccacugguuuacgaagagucagugcccagggcugucacuauccauagaacccaguaccagcuccaggccagugugucuucuguacuaauaaggagggugauaauaaaagguuaagcuacugucguuuugguagcuucuuuuuccaaucccugcuucuacaaccacuugugacugcuuucuauguuuuucccagcuuggaacaauaaaaccuguuggugacagacagaacuuuaugacgcugaaauugugguugaugaacaacucgcugucaccaucaucuguuuucugaaacauuggcucugacauuuuuuaggcauaauacaaggaaagugucaccugagagauggaauauaauagcauuuucaagagaaugcuuugcagcaguuacaggacuuucagaaacauuaagcauuugggaaaguggugagaaucacacaaugauagccuuagucaaaauauuaauuauuuaguaaaaguugaaaauaagauguuaauuacauuuuguguguauguccacccaauaaaaaguaauucagucuaauuaugaggauuacguauucucuuaaguaucguuauaguagccacauuucuuuaaugauucucuuuacagaaauguauauucacugaguugcaaagaaaacuaaagaauuugguuuccugauuguguagaaauauuaauaagauugguuaauucgggauacauugcugguguuaaaauacugcacauauuuuauucaaacauuuaauuucucaggcauucuucuguuauauguuggaaaugaaaugguuuuaguugcaguggggugaaaugaaaacaaaaucaagauuucugaaagacaagagggucagcuuuuaaaagaucaccuuuuugauaggaccugccucugaguuucauuaugucaccuuaacuaagguucgcagccccauuuuuagaaaggagucuuccaggagcuucauuccagaggugcaguguccaggcagugaaagaagcuuggcaguugcugugguuuccucccucucccaucucucugaacuugccugguucacuucaagcucuuuaggagcucacccugauccucaggaguaccgcagccacgcacccacaggauaugggguccccggcuggggugagcacaauggcggccaacccacaacuagcaggagggggaggggcuggccaccacaucaggcccagcugccagcugcucugcccagucgccagauuuccugauggugauccugcgcuagcaucuuucuaagucagcgacagagacccaggaagguaugauaccaagauuuccaacaaaaaccauugaaauuaaaaacauaaauugagugcuugugagaagccagucucuaccuucugggggcuuauuuagcauugugaugucucaacagugagggauaaaacgauggaaaaugacagaucacugaccucucuguucauuuugcaauuaggggggacaaauaagggaguggacagcucaaacgauuucucuuucagagagucggguaggguccgagugccaugcaaagauccugagacaagcaaacagggaaggaauuuguaaaaugagggucacagcuaagccuucauaaucucagacccagguucaaauccugcuucuccacuucucugaacagcucacagaacagcuuuggguacagcccacuuuccucgucuguuuaacagguuaagaagguaaccaucucguaagguuaccgugaaaauucagugagaugaugcuuuaucuugagcuugucauguaaauuguaaaugcuaacuaauaugaucauauucaguauuauucacauuugaaaaacuuuugagaaacauuuuucugaguucuuuaaaaaucauaucuggaacaagauaggugaaaugagauuaauaaaguaguucuuuuuuuuuuuuuuuuuuuuuuuuugagacagagucuugcucugucgcccaggcuggagugcacuggcgugaucuuggcucacugcgaccucuuccucccagguucacgccauucuccugccucagccucccagguagcugggacuacaggcgcccgcuaccacgcccagcugauuuuuuuguauuuuuaguagagacggugucucaccguguuagccaggauggucucgaucuccugaccucgugaucugcccgccuuggccucccaaagugcugggauuacaggcgugagccaccacacccggccuaaaguaguuauuuaaauaagcauuuuccuaucaaacaauagcucgaaaagguagaaucacugcuguuuuuaggguuucagccucagauuccggcgccuugauuuacuuugauuggagucguuuggcauguugcagaaaucacccugcauuauuuacagaggugucagauagcaaacucaucuucauaagaugugggagauaaagaggacucaagagacuaucugcucucucucauuugucggcuccuguuccugucgcugugcacagaguuagaggcugagacccccgacucgcagccccugcucuauucagaauugggaauuagcugcauguguucugaaucugugugauggaacuggcuacuuauaaaacaguguucaucuucucugacagagaagucaugauuacaggcuuauaccgcgcggaucuuugaagagcuucacuuauaacauguggaauacaggccacuucuuauacuaauggcugggaaaguucaaaaucaucaucugcagacgcgaaauggaugcacauuuucgggauccugcugcucaaagucacagugaucuguguuguguuguuuuauccauuuaagcccauuuuagaauucuauuuuucuuuauuucugaauauuguaccucuuuuuuccaaggucaacacaagauaaaguucauuccagaaauggugggcccaauauuagaaaugacauuaauucccgagacggagcugcgcaaagccaccauccccaucuucuuugauaugaugcagugugaauuccauucgacccgaagcuuccaaaugguaaggacguagaugugcagcgaguggccgggggacaugagggaggcaaaccugaaaaccuucaaagaaaccuguagacaguucuagaguuaaaggugccaacguggaaaacacauuuuccuacagcuugagagagaaaaagccuaugauuuuccuuauugaagaagcuuaucaucccuugcacucaauuuuugggaggauuauucucaauuuuuagcucuuacuuacuucuuuuaaucuggguuuacuuacacauugcacccuggauaaaagucucuugcucccacuucuugguacgugcucuuguagagcguuuaaucaaauguuauguguuacauucucucagaccggcugcuuauugcagaauugugguauuuugaaagcuaaagucuuugcuuuuauucucuuaagugugugucuuguucuuuugccugugcaauggaacugaugaaaauucucuaagaaaguguauauaaagugcucaaaacauacugugacaaacagcaugagggacaaacucugcugcauaacuuaugcucaagaaguaacaaaaucuccuucuggaucccaagaaaauaaguauacuguuuauguauucuuggguuggcacccacacccacacauacacacacacacacacauguacauccccacacacacacauacacauccccacacacacacacauguacaucuccacacacacauauacacaugcacauccccccacacacauacacaugugcauccccacauacacauacacauacacauccccccccacacacacacgcacauccccacacacacacacacaugcaccuccccccacacacacacacguacauccccacauauacacauaugugcacacauacacacacaugcacaugcuaugacuuucuccuuaguguacuaaugguuuggccaugaugcuuugcaggagaccugggagaagcccaaguacuagggaguccucugaauugaaagauaccuuuuaaaaaucauuauacuggaccggaugugguugcccacgccuguaauccuagcacuuugagaggccaaggcaggcagaucacuugagcucaggaguucgagaccagccugggaaacauggugagacuccgucucuacaaaaaauacaaaaauuagugaggcaugguggugcacaccuguggucagggaagucaaggcugcagugagcugugaucacgccacugcacucccgccuaggugacagagccagacccugucucuaaauaaauaaauaaauaaauauuaaaaauuauuauagcaauucaaguaagucaacauacuaagcauuuuacauagauuuuagaggaauuuggagaaaaauuccuauaaugaaaggaaaucaaaacuucaucaaucaagauagcuuaauguuggugagaucuaauauuaaaggguauauuauccuuacccaccucuacaguuuaucauuuaagggagcuuugaguaguuuauagauuuucauuggucaucuucaucauaucacaugaaggcgguauccacgaagaaugauuuugcuguuuccuagaacagaaaagagagauacgaaaccaaaacagucuccacacugugaguugaguuuagauacugagggcagggagacugagauucacaggcuuagccagguauuaucuggguccucagcaaaucacucaacaucuuuuaagucuccaauucaagcuuguaacauuggcaugaaauagaaucuaccagaaaggcguguugugagaaugaaauaaaaucagaccuguacaaucccuagcacggugccuggcacuauaaaagguggcuguggaugcuucucuucucucaaggccggaaccucccuuggucuggguguuuguggagugcagggggcagccugcagggugagcccccagugucugcaggaccauggggcccaacgcugcauacaaaccugggcauggccauuucgucaggguuguuccggaagccggggaggagcacacaggagaugaacagagucugacugcuggagccguuuccuuuaaccucuacacacccacagcugugcuugaaaacccauugcagaggagccuaacaccuggcucggagaucauuauuuguuuuuugcacuuugcuccacuaggcaguuuuuuaauuuuuuuuuuauuuuuuugagacggagucucgcucuguugccaggcaggaaugcagugacgcgaucucagcucacuacagccuccacaucccggguucaagugauucuccugccucagccucugaguagcugggauuacaggugcgugccaccacgccuggcuaauuuuuguauuuuuaguagagacgguguuucaccacguuggccaggaugaucuugaucucuugaccucaugauccacucgccucagccucccaaagugcugugauuacaggcgugagccaccgugcccagcccuaggcaguuuuuuauaaggugacuggugacuguuauuuucacauuauuccaaccguggacaguagagagggcuuuaguuuaacuuccccaguguaaugucaguuggacuggaaugagugguguuaguaccuccucccuucuuccuuccucccucccucccuuucuuccuucuuuccucccuuccuucuuuccucccguucucucucuuuuuuuccaugauagcagaaggucucccuguauuuauuuuuaauaauauuaaagauaauucauuuuugaaagaacagcuguuuuuguuucucuggcucacugucagucuguguauauacaaagucuuuguauaaagacuguacuaauacaacauuguaaauauuauaccuagauuuuuuuuauuaauguucuuucuguuugauaauauaucaaggagcuuucccuuaauuacaacauagcaaccaugauauuaaugauggcauaaaauuaacuaucacuuucuuauccaucgccuauaaaugggcauguaaguuguuugcagauuuucacugcugugaauaacugugcagugaacacauucaugcauauagcuugaauuuauuuugaaaauuuucccaguauacauucuuauaaauguaauuacggauuucaaauauuuuuguaacuuuugaaauuauugccaaaugguuugauguuaauacgauaagauuugccccaucuccauugcugcuggcacuauaucauggccccaguuucacugccaacucauuggaacuacaaauuauaauuuaaaugcuuuuuccuaggcagaaaauucauuugacuuuuugaauuuuauauaaaucuagcccaaagaaggacuuugugaaaaauugcuauuaaagaaucagguuaagggggaaaguguauuuauauagauaaaugucacuggcacagaaaacuaaggucaaaaguguuuaaaacaucauucuauuugucauuuuuuaaucagucuuugggucaaaauaaggucaagggcaguuagaauaaagaagaaugagaguuugguuucugaauuguuccccuuuucccucacauucuuuugucucauggcugccuugugguaguuuaaaaaaucuuacaacaaucuucugaggaagugcuucauuuucuccaguuugcaggggccccagguuugcuaggaaaugguccgaaguuaacgagagccacagaauuugugccaccauuuuaaacaccgccuucccauuggggcuucaacauugacccagcgucaggagacaucuuuccagaaaaccaaauuguuuuugaguaauaucaugaaguaauuggcacauuuaguuccaucucauaaacaacaaacuauuucacuagcaugaaacaugccgugcuuggauguauguaaauccaagcauaagccugaagacacagauucacccacaagaaggacccacugucaggcugagcguggucagcuaccugaacuguugguucagagucaccuguuucucuguguugucaucugcuugaaccucugcagacgagggauagcguacauuaaagaucuuuaaaaugagggcagaaaaacuaacccuuguuuuaaaaaaaucccucuuguauguuaaucugcuucuguaauugggaaaagaucaguuuucuucuguuugaugugcccaccucagcuucccagcuggaaucucccaagccugcagcaucauccccuuuucugccagucuccuugucacuggguuuuccggcugcgggucaugcuggacuggccuuugcuugcuccccuggccuccguggcagucgguugugaagcuucaucaguccucccucugucucaucugcagccuccguccucugcgcaaucaccauugcacuaguccaggauuauuccugggccacaguauuugucucuugacuugcucuaucuauguuuucuaaguccuuucugacuccaguuccaccugucccucucagcuggucuuccuaaagcacaagggauggccccuauugucggugaugugggcgaauguguagaguggacauguguguggcacauuggugcaggguuggccccaccugcuucuccauccacgagcuucugggauggggauggucggcugcugccuaacuccucugccauaagcccaguuaccucaccuuauuagucacgucagcaggggcuuaaguuuuuuuuauagcuuuuauagcagaugugcaaacccuacuggaguagggggaagauauuagggggauuuguuuuuacaacacuuuaguguuuugaacccgugauagagcuuauguuuuaaagguugcugugucuuuuggaguagagcugucaauaugcuacuguuuauggaauaugaaauaauauauauguccagguguauuuuacucuuacaauuggaguagagaggagaccugcuggauucagaagaaaaaccugcuauuuuacucaggauuaaacugcaccaaaccauuacuggaauuuuaaaagcauguguuacaaauuggcuuuucuaacguugcccggaguuucugcucuugugcucgugcucuucagccgcaguggcgggcauuucauuagaacguucuuucccuuacaccuccccaagagccuacuccuuuccugucuccacuugugcaagaaagagcacaaauguuccuucggaauaggcucagccuugcccuuauccugcuucuccaggguccauguguugaaugggcucucuugguggcgggaugggguggcauggaguuauccuuucaugggccauguccuccuuguggccugggacucucuguccagcgcugcagugagugccuuaggucagcuugacagcacucgcucuggggagguggcgaugaagcuccacaaaaggcuccaggcugaaggucccugaugcuaguggaagccugcugugaagugucguguucugcaggagcugggccagacagaagccugugagaugggaggccccagaugugcacagcggccuugaauucuuuuuagaagucccuccuaccuucaaagucauaugcuucacugugggcuggguccauagccauagagcuccgguccguugacaggaaggcguucccagcgacuggacgcugcaugacgcucuugcaaucucacaccucucugccaucccaucccuguuuguguacggccaggaggcugcugccugugggguuucuuuuccuccuagugcuugcaguguggauacuccaagccaggggagguggggauacaugugggaagccccaguggaugcccacugcagccaugccccugggguggcccccagcccuguggccacugucagccacccccuccaucacugggcacucuugugccacuucccugcccuguccauacucaaggccacuguggacaucuggggccuccuaucucauaggcaucugucuggccaagcuccugccagaacauggcccuucacaggggaaguuccauuagcaucagagaccuuccgucuggaggccuuggcagagcuucaucaccaccuccccagagccagcucugucaagcugaccuaaggcacucacugcagcuccucaacaaaaacccauuucuuauuucuucugccucuuuugucucugggugcuccagcugucuguggucauccuggcucuuccagcacuuucuaugaaucuuuuaugauccggaugccccagccauucuccuaaaucauccuccccugcugcuucuuccuguccuggugccuaagggcacauucucugcccccuuuccuuacagcuggccaacuccucgagacaccaccacagcugcguucaucccacccccucgcccugugcccaccccaauccagagaguagcaugcuuaccccuaaacucaggacucuaggaaucuccauuuguuugaaaggagagguccuacuugggaagauuucaggacugauaagcuggcaggggaaauguggagaggcauuggggucuucgcgccccuuaucccauccaccuggaugagccugcccuuggucacaggagaugagcccucuccuggccuuaagcugacucucccugccucaccaagaacccugcccucccguggaccgcacuccaagucucacccucauacuggauuuugcuucauaauaaaaagcauacuuuuaaauucccuccuggcaucuuuuuaaagaauuccauuuguuacgccuuuggaaaauacagaacuaacagcugagaauugcagcaaaugaccauaugggccauagaccauuaauaaaaauggaauggaaaaagcugcccagcaaaaauaauauuuucaaucauggagcuauuuucugucaucuuugugaggcucaguaaaaugcugcacaacuuccagaaauucccauuuaguuguaacaguauuagaacaugaauaaucuuugugucaucaguguugccgagcuccuguuugaauaaucucuucacacugcccaugccaguaaccggaagccaguaauugaauagccgggugaaugucagcggcucugccacuugguggaaaggccaauguauuuuccacuguaauaugaaugugaaugaguuugguagcaauucuaucuuguguauucuuuaauucauuaggauuuuauuuguugguuuguuuauuuuugcuuucaaugucaaaauaauucuugccuaaagaggaaauauggcacaagaggcuucuguuucauugaauccagacccaaagauggucugagaggccauggaaaccaagauccuugacuccaggagcugcgauuauauugaauuucauucuuaaaagcccuccagcaaagagauucuuccauaauccccuuuaaccagauuaaacaggacuaauuuugaggccauguucccagaguccucuggaauugcaugcagcccuaaagucacucuuuaaucugugucauguagacauaaggagccgcugcaccugucucaggcaucagcaaggugucauggccugcgaugcagccaugcauccccagccaggcagcuccaagugaguggcucuggguccuccaggcucaugaguguuucacaggagcuccaaggucagcaagccccuugcuugacggacguaggaggauguggagguuuuugaaugugggaugaagugccaccgauuaauuaguguguaauuaaguuuccagagcaguuaggcaagaggaaugcucuauacauaaagauaugaaugugucugagcacagguacucaaggcugagugauggaucgggagggaccagucacuuguaggaugucagcaugggcgccuagagccccaaggguugugcggugucacacuucucucugcugaaccuugccuguuucaucuucuuaaccauguuuuccacccagauacaguccagcaacuuucucccacccaccucccccugcacaugcucaggggguaaggugugguugcgcaguuucaucagauuggccccgacccagggagagaaggcagagagagucugauuccuuggugcccucugccugcaguaucuucugagcauuucuucuuuaaauacaggagaaacuagagcacucugggcaaagagcagcauuguacuaagguuuauuuuuaaagggucaaauaagcccuucugcuaauguacuuagcagaucauguccauagauuucagaucucacccggcucuugauaaccucggagcccuccaucaaggcggugaguggucugugcaaaccuuuccacccuggcccagccuccugcugcgcucccacagaacccuagagcucuucugguauauaaagcaugguccuggaugucuggcaagugcaggcugauuuuauacauuacagauguauaaaauuauagaugcauuagaguaagaauaguaaaucucacccaaaacaaaaauuaugcguuccaaaccaaauauaauuggcuuuuggauuagcuacuacugggauccuucucuccaugaucuuucaaauaggugccaauagccuaugguuagcuguggcagugagugguaaaagcaguguuuccuuuuuaaguuaauugaauuaacaagacgucaauaucgcuucgagcacagcccccugacuccgucacgucaauuuaacagcaacuuuccgaaaggccuucuauucauaaguguucucuuguuucauguucucagagggcugcugguaucagacacugagagacucucuguucaguauuuucaguuggacacccugugaauauuuuuggagcaauauuagugauucagaaaagagaagaaaauauaaugguuuugcuuauuacgugagugagccucugccaccuuuugagcaacacaguaaacccuugcuaauuuuaucccagccauagagaaccuuguugcaaaucaccagacaaugugcauuuaugaggaagauaauaagcaugauuuugauaaaaccagcucugcucuaucagcaaauguacuaucuccaauuuagugggacaggaucauuuaauucugauuauaguaacaguucauagcacacuagcgaaucaauucgaguguauucuauaaaaaugaacgaggauccuggaauuagaggcuaguuguggaucucugguacugaauccuugcuaauaaacagaucaggguggccagguguuuguguaaauuacuuaguuuggacuaggguuaguaaaauuagaaucagcuguguugugauuuacuuaccacucauccaccuuuguuggaaaucauuaaguucaucagucagaauuugaucagcagcauaccuagguagcuguagcuuccucauugccuguguuugugacagcuagauuuacauggaagcagagaaaacaugccguuuucauaaccuacacucuguguucagaucccuuuggcuugaccauugaugggcauuuuaaaugccuguauguuugcccaugucaggagaaggcacauuucucugcauucucuguaccuuucuuguugucuguacucauuaaacauacaugaaauugaaucauguuuugauuaaauuuaauuuaauuuugugucucuauuauuuguccugaagcaucagcccucaucaaacauuuaaucuuugaagucugucuggaucauggcaccaucugggagauggcacugccuugaaaugccaacuuuugggcuacuaccaagcgaucucccuuguaugugauuccaaaaagaacuaccuuuugcagaauucuuuucuguaaagggcaggauagcagugguuaguaucaaaagguuguuauuuuacaguaaaaaucguuaaugugagauuucaggagaaaaaaaaucuaaagcaauucauuccuccuucuucaauagaaccaucugucugugcugcuaaaauccuugaacuucuuaggccagacagaaucaaaaagaaguguuuauuugggggaggagaccauggagaagaucaagaagaaaauuggagagauucacuaagguccggguucuggggauguugcugaguccuugaugucaggcaagaaucaguacuucucuccagcccugaaagccuuuguuucaucuguagcuguggcuuugggcaguguguacugaucgaggacaggcagggcgucuguguccauuuggaggccccuccuuggguuucaccguuccuugcuaauugcuucucagggguccacagucagcugcuccugcaggggcauccccaagucucuggugcccacagugucugucacaggcacucuggaugagcaguuuucacgacugggcuuggccuggccaagaaugcagguugugauuuaucaacccucuagaccgcuccuuugcugacauauuaagcccucuccagcuuuauccagucuaagcacuuuaauccaaucuaaguuggucuaagaccaacuguauucaguaguuuaugugcacacagcacauucauuccauuagagcaucaaaggcacuguuugagguuuuggggcuggcuagagcaaugaccaaagaaaaauucuuccucucacucagcuuaaauuccacugggauccuaauaacagcaggcggcuugagaauuguugccugagaaaguaggugauugaacauggcuuuagagagauccuggagacccuugcauacaugcccauggcguacuugcuuucugaacccuggauucagcuuucuucaauucuuccuuuguccaucuuccuucaguuuagagugugcaugucucaucuuuaugggaaugaacaaucucacagccccuccuugcuacuggcacaaguugaugguaaccucagggcccccugcagcauggcuagucaccaggccggagucccaguacucagauggcuaugaacucugccagagauggggaacugggcagugaggauggggaaaacauguccauuguuaucgagguuuuuuucagccugaucagacacuugaagacauuuuagagauuuccaccccccagaauuuagaguuuuucuaaaagcauggaucugagacauaauuagcugguacuggcgacccuucugcacccugauucccaggaaauuuaaucagaagcuuuggggauggaggauaggcuggagauggaccuucuugaggugccugcuggucugucuuuagggacauugcuccucuugcucuuuagaacauuuuuucagccagagugagguauuucacuaggaucuaucaaggaauggcagcuaaguggccccuaggauguuuucagauugccgagaacucuucacuggcaggggaaacaccaucuguucauuucaggaaccaacaagcuauuuuagauguuacguguuuguagagaugaaguuugagacuuuuuuucaugcugcgcuuugauuuuuuuuucccccuaugguuuccuugucuuucuuccccugguucuugcuccugcuaucaggacgugcagguucaggcuccauuaaccagaaaaggaaaugagaggucccccuauggcaagggaucaucagaaaccuccagggguucuguguuggcaacucuuaaaugaggcuucaaaggcagaggguagccaucuaugaugaucucucuugccgauuuauguucuauugacacucaagucauaaaaugaaauacucgccaugcugauuauuuacgcuuccucuguuuaauuauaguuugaaaaugagaucaucaccaagcuggaucaugaagucgaaggaggcagaggagacgaacaguacaaaguguuauuugauaaaauguaaguguugauuagcagugggauuuaugucugagagauacagagacagagagaccguaauuagacuacaaugaacuuuguaacccagaaauaauuaaaauguguuaauaauggaaaauaguuaaaauugcaccucuguugaguuucuuuuucugagugugauuaacaagguguguauaauuauuuuucagccuucuggaacacugcaggaagcacaaauaccucgccaaaacaggagaaacuuuuguaaaacucguugugcgcuuaauggaaaggcuuuuggauuauagaaccaucaugcacgacgagaacaaagaaaaccgcaugagcugcaccgucaaugugcuggugagugaaagcuuaaucacguuuuuucaguuuucacagcacaccagaaacugaagcggggauugccccagcccuuaucuaugacagucagccacgaagcuuuccaccgcagaacaaucuccuucgcuuguuuccucaucugcugcagggaaggaaucaugaagucguccacucugaauaagucuguaaaauugucccaucucuggacguuuuaaugucgcucuccuugucguugugaaugaugacucaccguaucuugcagccaggguagugccucauggauuacggccuuaaggcuuugugauuaggagaccauaaacgcgugcuauguaguacauaggcugaaugguggccucaaagguagagcaauaccccaguccuuagaaccugugaaugagaccuuauuuggaaacaagaggcccugcaaauauaauuaaaaagaaucucagaugggauuauccuggauuaccugcaaggggaggggagagguacuaacuccaaugacagguguccucauaagagacaaaagagaagacacagaaacaggcuagaccuugugaagauggaggcagagauuggagggacccagucucaagccaaggaaugccuggagccaccagaagccugcggaggccaggaaggaucccccccuagagcuuucuaggggaacguuguccuacucacaccuugauuucagauucuggccucuggaacugugagaagaaacauaucuguuguuuuagguuuaugguaauuuguuacagcagccacaggaaaccagaucugggcaccauggagaacagacgccugggcgaccuuggcugcugccaucugucugccuuuugcauuccugcuguugcccugauacagcuggguucuguggacacccccuuccugaugucauuguggucccuaauccaggaaauccauuaguaccaaugagcuuuugggaagcuuuaccacaagcucagaucccggccagccucauggcucucagcagcguugugauucccacagccuggcuccagagcucucugcuucucccuuugcugcuucucuuauaaagaaacacaagggcugacucguggccauaguagggcuuuccucaaguuuccuugccugucccauggcaagaaugcaagaaaacacuacuccugcuuugcucuacuuaccucccuucucugcccagccacuggccucaggauuucagagucgccaacaacauguggauacauaguccucacugccacauccaccccuuguguggacuugugggugcuuuaugcucauggaaauggacuuucaugccaggaggaacaugacacaucauucacucuuuaaaaagccagaguuguguggauuaaaaagauaaacgaaaaggaaugcuuucacuuuucaucgacuaugguaucagugcuggaucugugcuuugccaugaggaacuucacagcugaaagcucaugagcagucuucgccccuucauugcauggcuggacagcuuguuuaggcuaaugauaaacauuucuguaacaaguuuucuuuuccuuaaaaaucuaaauauaggggaccaguuuuugguccagcauguaaagagcuugcaaauugucacuccuguccucacaacaagaaaaaagcugaacaaauugaaaacaaucaacaauuauuaguuccgucuucuuagaucuguagauaaacuucugaccccaaagucaaagaaacaggaggauacagagaaccacagaguggaagcccaaacagaaaccaccacuggagccaguacuagauuccuuuuacccaguccaucauauucacuuucaacgcauuaguacaaugcacgcuaaagacaaaaacacagugaaggggcagagcaggcauuagaaccagacucugauacggcagagguuuugaaaucaucagaccugcaauuuaaaacagcugugaugaauauccuaagggcucuaaugggaaaaguagauaaaacauaaaagaagguggguaaacuacguagaaacucacagaaaucaucaagaagaaauucuggaaaucuaaaacacuguaacagugugaagaaugccucugauggucucaucaaucaacuggacacagaaucuguggacuugaaaaaucugaauguuugcagaugcaucaugugucuuaggcuacuguagaaauuacuggucucugaugucuggcccugaggucugggcuguggcuguguuugucuuuauauucaccuggagacugaccaagugguacagcagcaagcucugccccaggucaguuggucugaucuuacagacagaaaagaaccuggcgcuuacuucacugucuucuugcauucugaccaacguucaaaguaauuuguugucauggugccaaugugauugacgugaaauaggaacuauuauuuuucuaugggaaagaaauggagaacuuuacaaaauccuucccuacuauggacauaacuuuauaguguuccuucuaauccuuaaggggaucuaagaggcugauaagugcccagaaggaagaauuaucaauaaguuuauuagucuuccaacuuugaugauugagacuuuuauuuguuuuaagcaagaucucuuaugcucaccaggacaugaaacaguggagaaaugguggugugcucugaauaugggcucuuacuaccugaaucuagggucaggaaacaaacucuuguaauaaaaccuacaaucacgguuucuaaugugaaccuguguuccucuuuaauucagagccagacucagugcccacguacuuuuacuguggucagcacuugcucaguuuuaacuaagaaacacacccuggguucucaagguuaucugacauuauuaacuuucuucaaaugggaacguccugaaucauuugaugaaaaaucaaauguucugcucuuaaccauuuccuggggaugauaaaauggaucccaacugucacaguuuuuucauuuagaaaauaaaucuguggaauaaagggaaacaagaaaccagaguuuuaaagauagguagauagguguccuaaccauagauacucacugcccagcucaauuuccuggucaguuuuucccuuuucuccugguacuuuuauuacagaaacagaguguaauagagauggguauguauaaccaucucuaaaugaauauagauguauacauauuggagauguauaaaauauacucuguuagucacuaagaagaaaugaagccuaaaguuaaaaaauuaaauuaauaaaauaaagaacauagaauuuaccaaugcucuguaagucuguugccaaguuuccuuuagaaccagcuucgugguuucuuacaaaacacaguuaguggaacauuguaaguuguguaggcuccuucauguccuauuuucuugcccuuaaaaaaacaaaaauagguccgggugugguggcucacgccuguugcacuuugggaggccaaggagggaggaucacuugaggucaggaguuugauaccagccuggccaacaugguaaaaccccaucucuacuaaaaauacaaaaauuagcugggcaugguguugggugccuguaaucccagguacucgggaggcugaggcaacagaauagcuugaacucgggaggcggagguugcagugagccuagaucacaccacugcacuccagccugggcaacagagguagacucugucucaaaaaaaaaaaaaaaaaagaagaaagaaaaugaaaaaguaagagacgcagcagucacucugcuuggccaccuaaguccccaggacaucuccugcaaggaugucugcauguauguuggaacuuggauguauauuuguaauucuuuaacuagaauuucacugacagcucauaaucgagcaucuuuaauuauuggucacuaauguugcugagugucacuuagugcuucugugcagucauccacacgucccaucucugugacugguaggcgcaucauuacuuugcacaugccaguuacuucucuucauagccccuuggcaaggcuaauuaaaugcagagugggguccaguauuuuuaaaaucuugguaucuguuuuaguccaaaauggaaauauaaugcagaugucugcguucuaaaagaucaaugccuagcgguggauuggaguuggggggccggucccaaugggguuccucugggagcugagcugcaagcuuggcacagaugucagucagcgcugguguggggggacuugagagacaaggcugcccgcggagcccaggaggagugggagcaccgcgugaaccuuuacguaagaaacacaaagguuuuauauagaaauugggauuggagaugaguguacuucgguuguggagagguuuugaaguccuaggaagggaacaggacucagcacaggcagaaaauagaagacauuucguaucuccgagagaggaaugaaggucgcaugauauucccguugugaaauuguaaagaaaaaugaucaaaaccuuagaaaggauuaaaaauaugaguacaaaaggggauggugugaaaccguagcuuguaaauacuggcaacuuugaguuggaaaugaagggcuuauccucugccuuugaugcagauucucuuuguugcgacagugaguugucagcugaaaauauccucauuacugagccgugucauaugaacuggaggacaguaaagugucagaggcaacagaacuugaaaaucuuggugcauuuuucuaaaugugcccccgcuuauuuucuagacuuaguuaucauuucuuuucagagacaucaauuguagaagcaaugcuggguuuugcucaugaaauuaaagagccuaugccauuucuuggauaauuguaugucucuguaauggugauauucacuaguuacuucaggcuccgauucuagagggcuaacaucauuuuuaggugcuaaauuucacauugaaagugacucugauguuuccuuaccuuaggccuugugaggugacuucugugccucucugguggcuccugugugaaaaagauuuuaaaguguuuauggagauguucaccuuaagaaauauaauuuugauagaaauguuauugcucaaccagacgauauuuuccaguaaauauguagaaauaauccauugguuuuaaucuacuaauuaagcuuucuccaucaguguuuauacacagggggcuuuuucagaggcagcccucuuuuuuuaacugugguuuggaagguuugccugucuggaacagugcuaucuaccagaaaguucugggauaauggaaaugucuuguguagacuguuugauacaguagacuagccgcauguggcuguuaagcgcuccaaguguggcaagugcagcuggggaagugaauuauuuauucaauguuaguuaaauuuacuuuaccuuuuaauauauguggcuacuggcuaguguauugcauaacucaggucuguauuaucauauugucuuuguagcucuugcugaggcugggcccagaaagcuuuaaaucauguugaugaugcuuauuugcuuauucccaaauuugggauauuuauuuauguauucauuuauucugaugagauuacuauggcuaagauaucaugucuucaugucuuuuugggcaauaccuuguuuuaauugaagacaagugacuuucaagugacagaaguugauuuuagucaucacaguguucaguguagaaauguaauuguguuugacuagcaaaaaaaaaagugaagaacuguguaagaugguuuugcaauuuaugugaauuuaugguucugauccaaagagcuggguccauuuggcuguguuugacacaagaugaaguaucuugaauuuuuauugugcaugugauaccuuuuguggaacagauuucuuaaaacaguauuaugguuuaacuuuucagaauuucuacaaagaaauugaaagagaagaaauguauauaagguauguaugcaucacgcuugucugcauguuaauuauaaauaauaauauauguuguauguuuacguaugcuaagaaauguguuauagccgcaaagguuuauuuuguagaaaauugugaaacguauaagguagaguuugguggagcucccagauacauucucagcucuugcauagcuuguccacaccagugcagaguucuugguggucaccauuagccaacucaaaagcaaaacuacaaauaauuguuucacagcguuuuguaccuguugaccaacucauguggcccuuuugcaaaaagauaagcacauaaauuuuaauguuucacaguaaguuauaugauccagugagaaauccaguuauaacuuuaccagacauaggggaguuauaauuuuucagucugcucuuaguuaacugacgccauagucccguguuuuuuaugucuuucuuccaugaagaagagaaacauuuugcauugccugcuggauuuugcuucccuacucgccuugcucccuggagugagggacugugauugagcccuucucucuugguuacuucuaaagucucgugucaaauaauuagcaagauuaccacucuggagacuaggagaaggauguaaccuacacagcaugaguuuuuagugauguguuuauuacacugagggugauugucuaauuuucuauuucuaagauuguuuuuacuucuccuuuuuaagaacauacuaugugaauuuaauaacucaguuaccuuuauuucuuuauggcaaagaaauucuuucgaucacauugacuguaaucauuggagcucuuuauucugauggauuuguauuuuuacggauuuuuuugugcauuuggacucaguagaaaugcagaaaaucacaaucaaguauugugugucucauuaaaaauguuuaagggaaaaugaaaaggaaugaaaaauuugaaggaaaauucuaccuuuguguaucaucuuuauuuuuuuccugaguuuuucuuagugcuuucuguaccaaaaguuuuuaaggcauuuugaauuaugaacauuguaaaaaggaaguguagccaugauuuacuguugaacauagaauuuagcucuugcaauccucaacacaaauuauuuagugacauuuuaagaacauaccucuguuuuauugucucagguauuuguacaagcucugugaccugcacaaggagugugauaacuacaccgaagcggcuuacaccuugcuucuccaugcaaagcuucuuaagguaaugucaauuaccagucaccuugaugauucuauuguuauaaauucuaacaauauucagaauuguauuuuuccauggcaaauuuuaguaggccuauaacuuaagguuuuaugaaauugacuaaauaaaugcaaggauaugaacaaaaauauuuaggaaguacuuugauuagagauuugucccugcugaaugcagauuuaauuagaugucauagcaggugaucacugagcauuauaaacucccaucacuuggcugugagcugacagcaaguuagagauucuacaauuccuuguucaggacuacaggacuccaggaugguggagaacaauaucaagaaggaauuuuccugguagaacagcuaagagauaggaugagacauaccccuaauugucuuaguaaagaguuagggaccagaucaugacuuuucacucuaucaguucacguugagaccuccugcuagugcucucugccugauucuucuaaggaguguugcuccuagcacaagucuggcaugacaacugucuacucuuagugguucuuuuauuacucagauagcuucagacauugacuuucuuuguuuacagugacguauggauggauggauggauggauggauggauggauggauggacaaauugcuauacagccucuaguuuuauauuucacaaccucaguaaguuauuagaugaucuugcucaugacauccuuauaaaaauuugaaaaauuaugaacuggauaaauaagaacaguuacaagaauuagaauuuaguuugguggcauuccacaaagacugcucauucaaggagucauguuuccaaauccaagccagccucccaaaaaccaaaaauguaaugaaagaaaaccagagaaaauuacauuaaaugggcauucaguagugucaauuagguaauaggaguuaaggaagacauuguguuauggaguaaaacucugguaagacucuuuccaucuuuggcccgauccugaaauuucugauaguuucugugacacaaauauacacaggcugcccuagagaccugcgaguauggaaauuugccucugccuggaaacagcagugucuguuacaaauaaaacacacaaagcucagcucagucuggagggaccucaucaguuguccuccugaggcuggcugucugaggacccauuuugccccgugccacgugggcucucccaaggagcauaauuuauaaggauggaaauuucaguugguacaucugauaccagcuaucccacuaugaauucugauggccuucauuuauucaaaacucaaauuucaguagcaagguguuuuuugcaaaugugaagcuauuucuuuuaccccagggaaauuaaaaugggguugacaaacugcucacucaacccuuacuccgucccucauagaacguaaacuuuuauaugcaugugugaauguaaaacauauauaugugcauaaaggcaucauuuguuuaaucauuggauuuauugaguacagauggguuugucacaaacugcaugaugguuuguuucacaacucaaaucgauaggcccaauugcauugcuguuuccccugggcuucugaauuuuccaguuuaauggggaaugcuacauaaucucucuccauaucuuuugccccguuacauuuugcaauuuuuucuaaauauguuuugauauuacuguaaaugugaauucaugcuaaucaccucacuaaagaacaugauuuauguuguugcgaaaauucuucaguaugacagauauauuauuguuuauuaacugaaaauccucaaauagaaucuucuuuuuugguuaggcauaucuuucgucaaaaccaagagcaauaaaaacuuuaguuuuucgccuagcaaucaaauuauuacaucuccauguggaaguggaagguagagaggauuuuugcuucccuaguccauguuuucauuugcaaaagugauuuaaaaaugcaaggaagucauuuggauucugaacuugcuuguucuuaauuuauuuuauugugguuacauuucagaaucuaguuuugcuuuuauucuccauccuccaauaaaaguagaccaauuauguuguacaaacuucaaaguuaaagaguuuguccaauugugauggagauaugcaaguucaauuuuaaggugaaaaaucuugcagaccgcuuaaaggcuucucacucuugccugaccuuucuggaaaggcagagccauacagggcccgugcccugugccugggagcccugauguccagcgggaggugcuccccagcccgugguuucaggaaaguggggcgggaccuuugcuaagacaguaagcagcugacggagccuugccccguugcccggaccccagcuucccacuuagugccuuugcagcacccucccuggccuggcugaaaacagggucaagcucccucuccuagggccagcaauaagcaagcccaugcucaccguguccucccgugagccuccaggcugcccagugggagcacaugccuccugcccguaggugcccauggagucuuuuucacaguguucuuuuucuuguucuguuuuuuuuucuucuucuuccuguagaagggucuugcucuguuguccaggcuagagugcaguagccugguccuagcucacgcaguguuguucugugucauuauucucuaauguagaaucgcaccauccugggagucaggcaucuuccgccuccucuuugaccugguuuguggcacacagcagguccucaucaaauagcugcugaauuuuauugaaccuuauacuuaaugccacugauguguugagcccaaguucaggagcugacacguuguaucuguuaaguggccuugccuucccucuggcaugucuccucgugcaucuucagcucacacgccgacugcaccaaugcuuccaggaauacuggccaaacccugacucugugcccagcaccuugccuauggcugauggugcaaagacaccuccccaucuuuaaggagcuugacagccuuucuagucccuuucugggugacuuguguguuccauguaccaucuuugcuguugauuaaaaugccaacccacgcagcacugagaccagagcccuggggugccgcucuugggauggcccuggaucaccuggcuccugauuugucccggaauguuaggaggugucauuugcaagcugccaguuccgugcuuugcagaaccugcuggguuuuucuuuugucugaaccccacugcagcuaugccuccccugugucuuuuaugccugucgguauguccggacagaggcucugcccuggcaguccccagccuguugacagcagccacacaugucuccagaaccgcggcccacacgcguguccgaugcgaagcucacaccauucugacgucccuggguguuuccgccucggguccgcucaugcuaugcuucucccuuaguggucggaggauguguguguggcccaccucacccagcgggacggguaccaggccaccacgcagggacagcugaaggagcagcucuaccaggaaaucauccacuacuucgacaaaggcaagguaaaacacaaaaagcaauuguccuuguuuuccucuuuccaugcaccuaccugcaguguuguaaacacguuuuuuagcgugugauuuuugcagaaccagaaauuuguuacaaguuguauauugaaauguuuuaugcauguuccuucagcuugcacuuaaaaguagaaaucuucuuuuaaaaaaaaucaauagcccuuuuauagaugcucuaaaaaagcaccaaguauuuuuauaacccuuaccagagggaacuaagucuggaacacugauucggagguguuuccgugcccacagagcuaauguauuccuuugacauccugcauuuuucuguuggcacggaagaauuaaucccaugguaggauggauauugcuccauccugguggcuucuaguuuaauuggcuuaaacaaaauuauagauuccacuugacuuccacuaaaaggaaaccugcugucauuuuaaucagccaguauuauaucugaucacuguaguucuucugauuaagguaugcaguaacuauuuaaaaaaaaaagcuguuucaguuucagaaguuuuuaaaaccugccaccgaagugacauuggaacuccuucuuugguuucaucaagauuccuaacucauuucagaaccuguuuuauuuuucuuuuuuuccuuugagaaaacugacuagcacacuuuaugaagguaccgacguucacauccuagggcugcuguagcacaaacuggguggcuuucaacaacgggaauguauucucauagcuuagugcugggagcugcaagccugaugucacaguguuggcguggccgcccccucugaaggcugcaggggaaaaucugccccgugccuuuuccuuuggguguguugcuggcggucucuggcacuggucaucuguaaccacaucgcuccaagcccuuccuccgucaucacaggccuucuccucaugcgaguuucugucucagucuccuucuccuuaggagguaccagcgguuagacgagggcccacucuccuccaucagguccucaucuucccuugauuacauccaaauacccuguuuccaaauaaggucagauucagaaauaucagggguuaggacuuuaaauauuucuggggacacaguccuacccacaauuguacugaugcccgggagugaugauggcugccccuuuuuguggcuguugacguaaaccaaaccccauugaaaacaaugacucgacagaguccccguggucacgagcuugggauucugcucacauuuggaguaagcgaugcggcauccuuuauuugucccugccauucuugacacagggagaaagucugacguuuucagaauggcaugugggcucccaaaggcugguuggaaauaaggauuggaaauguucugugaauuacacccaguccuguaguuuagggguccccaaaccccagguccucagccucugguacaggucguggccuguuaggaaccaggcugcacagcagcaggugagcaacgggugagcaagcaaagcuucaucuguguuuacagccguuccccaucgcccgcauuaccaccugagcuccaccuccugccagaucagcagcaccauuagauucucacaggagaaugauaccuauugugaacugugcgugugagggaucuaggugccauacuccucaugagaaucuaaugccugaugaucugucacugucucccaucuuccccugaugggaucaucuaguugcaagaaaacaaguucaggcucccacugauucuacaugauggugaguuguauaauuauuucguuauguauuacaauguaauaauaauagaaauaaaguacacgaucaauguaaugcccgugaaucauccugaaaccaucccccaccccgguccauggaaaaauuuuccucccugaaaccagucccuggugccaaaaagguuggggaccgcugcuguaguggaacaggauauauuuuuguucucuggaaugagaagcuuugaggauuagggccaauuacuauaacuguacuagguuagccaggagaauccuguuucucagcaaacugguaaagaaauggagcaaaugcagccaucccuucccggcaguggcuucuuggcuccagggugagcagugcuacagaaugggcagggcagggcagggcaggaggcagggacccugggguggccgggaggcccgagggccagaggucacgggacugaaggaaugugcgcauuuguugauggcuguugccgggcucucuuuguggcagcacauccucugaccagcguuggcucccgcgaccucuccacccucauucccucccuugcccucugcauuccagccacacuggcccuucugcguccugaaaugcaccagcccucucugccacugcccagcggguuucugcugcacugccuugaggacguugcuugagucaguuuuccuuuugcugccuguaccauuuugucacuugaauuagcuuuuucuaagccaggcuuucucaaucugggcaugauuggcauucugggcuaccuguuacuuugugguagaggaccacgcgugcaugguggacucaaggaaugucucccugcagugcccugggcauacuccuuccugucucagcuuaaaugucaccuguucuccagccacggaaacauccucuuuucuccuuuauggcacccacuaucauuugcaaugauagauuugcuuguguguuucuuuaaugaguuccccaguaggcucugagcucugugaagauagaaccucacgcgucaauuccccaccaugcaucuaaugcucggaacagugccuggcacacagcacaugcucauuacauuauggacguguguggaaagaaugaacaaaugaaugaaaagucagcauuuaacagugcuuccugacagaugagaaaugcucauguauggcaggacagguggccuucaauaaaugauaaaucaaaaaacagagucuuuuuuuuuuuuuagcaaagguagccaaauaucuuuuccuacauugugauaguucaucaaaaaaaucauauggaggggcaaaacgaauguguucgguucaguacagugguucucaacugagaucugcaggaggcauuguggguucuccugacugggggaagagaaggugcuguuaacccuccagcagugcacacauggcccccacaccacaaagaaauagcccagaaucccugucguguccagguugagaaagcccuccuuagaaaaaaugaauucaagugaugaaauggaaugggcagcuaaagcaaaacagacucaaggaauguccucagaugucccuguguuuugguggagacagaacaaaggcuauggcaaagugaucauuggcuggccuugaaucagaaugaguuuuaggaggauuuucuucguaguagcugcauugauaaaaccgauggaaaagccacuucugaauauccauaauauuuccacgagaauguuaaaaaggaacaaagccuccuuaucccucuaaaacuaaaguaagaugaagaacaggugcuggaaagaauuugauaaaaugaaauuugaaguaucugagugaucagcugcaaggcaaaaaauucauuuuaacaucaacaagcauuacauuuucugggagaaagagcaguaggaaauaauucaucuuccguaacaaucuggauggccugcacuagaguuugaaccucuccgaaucuccauggcuccaaacagcacagguguguuucucacacaugcuccgaauccuccuuuuggcucggaacccagaugaacagagguuccgccacagaggaacacagccggagaggacagcaaagagucccccgcccuggggcuucugccccaaaaugacaguguucaugucauuggcugaaggagaucacaugaucaccccagacuucaagggguggagaagugcacuuaggggcaggugagugugagcggcacccacgugcaccacacagcuuguuagacaggugagucuaacaaucaagggcaccauccaaucuagauuaacaaaaguucaucuagaaauccccuaaguaugcauguauucugagaaagacgacguccacacuagucucccaaauaacucggcuuccccacaacuagagaugugagaauaacaucucauaaaacuuguugggccucaauccucguuucucugucguggaguuuccuucuuccguuaaagagggggcuuagguaggcagaacccugcaggagaagcagccugagagaaugggcuccugacccccgugacugcgauguggggaaucccaccagguggccagugcaggaggaagggggcacacaguagaagcucgaagugugauguuuugugccggacuuagaaucacuuuuguuuaagaaacaaggcugaggccugaguauccccggcugcuuuggggaugugccaucauuugagaaauaacguccuccugccuuuccuaaaugcaguggaaugacaaaggccacggcugaagguugagaagcuugaaguugggagggcccagggcacaccuuuccacacuccauucccagacuguaauuaucuugggggaaaaauacuuuuuaaaugguccacaggucaucacaggccuuagugggcaggugacacagcccaaggaaacuugaaggagggccuugauugguguggagcccugauaugguuucgaucugggucccugcccaaaucugaagucguuguaaucuccaauguuggagguggggccuggugggaggugauugggucauaaggguggauuuccuccuuggugcugugucgugagagugagugaguucuugugagaucuggguuguucaaaagugugugggaccggccgggcgugguggcucaugccuguaaucccagcacuucgggcugaggcggggcagaucaccugaggucaggaguuugagaccagccuggccaauaugacaaaaccccguuucuacugaaaauacaaaaauuagcccaucgugguggcaggcaccuguaaucccagcuacuugggaggcugaggcaugagaaucgcuugaaccugggaggcggagauugcagugagccgagauugagccacugcacuccagccugggcgacaggaacucugucucaaacaaaaaaaaaaaagaggggcugugagaccucccugccuucugcucucgguccugugccugcuuugccuuccgccgugaguauaagcucccugacgccuccccagaaguggcugcugccaugcuuccuguacagccuauggaacugugagcugauuaaaccucuuuucuuuauacauuacucagucucagauauuucuuuaagcccucugagcagcugagcaccagagaaaccaacucucaauuaauugguaggacucuaacccucacuguuguccaguacugaguccugagccacaugcggccauugggcccacgugaaccaucuuucuaagaccaaguacaaaaaaacaaauguucuuaugggcugaguugcauccccccaaaauuccuauguugaaauccuaaccuucaguauuucaaaauauggcuauauuuggagauagggucuuuaaagagguaauuaagguaaaaugaggucauuagggugggcccuaaucgaaucugacugguguccuuauaagaagggggauuaggauacagacacacacagggaagaccauauugaggauacagcaagaaggcagccaucuacaagccaacgagagaggacucagaggaaaccagcccugcagacacuuugaucgcagaauccuggccuccagaacagugaggaagugaaugaaugugacuugacgcccccagcaccuacucagugcuucauuauggcagcccuggcaaacuaauaccaauaccaggugucucauucauuuguuuguauagauuucauguugaaauaguaauauuuuagauagagucaauauuacuacaauuaauuuuacucuuuaaaagguagcagcuaggaaaugcaacauucacggauguggcuccuauuggacggugguuccuguuggacggugcugcucugagucaaagacuuugcucuuguugagcgccaagaacaucgucagaccagcacugccgcccacaugcggcugggaagcggaagcugcccacuguccuguggggccucacaggcaguagaauugccugccugccuguugguaucuacuccuuagacuacaggaauauuuaaacagcgaaaauauuucugaaagaguuacaaaauggggacucaagucuggaaagaauaaaauguaugucgaaauggcaaggaaaaaagcaugaucacaagcaccaagauaugauguuuuuuuccugugacucaauuucauuucuguaguggugaaacagcugucaagacuacggcaguuaccagcgggaaccuggagggaagggugacuugggaguucucacauggcccuuaaggaaauacagaugaggcaaauaggagagagguagaaacaggcagcugccaagauaagguguaagaaaucaagaaaaagcagcaucuucuuguuggagcaagacagaguuuuccgauaccuauuuuauuauuaaaauuuagaauuaugcgccucggugauguuguuuucauuugugcuuuggauaaaucccauuauaaucucauuuuucauuucccgggcuuagcaaggauaagucacguuugcuccucaggaucugucuaugcacgugccuuagggaauagcgagccuuccccgcugacagacuggcucuaagaucugcaccaucuugacccacuucuaccugggccacuucugaacaacucgggccucugggcagaagcccugcugcuagauccaguucacuuugugucuccuuguaagcucucggucccucucaccugggucugucugagaucccuacccacucuccuccccaaggccccaugccugucuccacccuuccgcuccugcagauagauagcagucugguuucuaauaaaguggccucuggaucacagcgugaacugcuucaaagaugcccaaaccucagggauucucccaucuccucugcaggcgauccaggccucucaccuggcaugaggccccuuagaguaggaaucgagccuccagauguacccucucaucacccacagcaucuggccuucugaacaugcccucuguuccccaagcccuugcaccuucccauggucugccccggcguggaccggcugcuucuugcugcugucucgugugacggcugccaugacagcugccuuccugccuucugggcauauuucacugcucucaaacuuucguggcuuuuggaguucaccggcgaaucuuguuaaaauccagauuuugauucagcuggucuggggugggccucgaggcucugcauuucugagaagcucccaggugaugucccagcugcuccagggaccaucccugaguccccagggccugugcugacuuaagcuccugagagcagaggcaguggcuguggcugccaccucuggaucucccucugagggagcugugccguggccugggcuccacuccauuuuuuuaaauagcuuuuuaagagugguuuuaggcucacagcaacauggaacagugaguacagccaggucccagacacccccugcccacacacauacacaggcacggggcuuucaggguggucauuuguuagugaguugagcacauucuggccagcacuugagcaaacagcacacaaucaagaagguggccgucacccagacuuuccacaaaguuccuuauuuggggcauauuuuguuuguuaacggaucuugcauccugacucagacugagccccugggagagcgaaaggccaugccucccaccuccccacccccagcgccgggucgggggcagaucccaccccacucugccacgugccgcaucacaguuggguuuugucagugugcuccuuucccaaggcuaacacuaacuugacuuuagcacgacauucacugcaaagguuauggaucagacggagacaaauucuugcaagagcagggcuggauuuuccugucuagaaucuuguauguuaaaaauaacaaucuuccguccaaaugacuacagcaguuuauuaagugaccgaacgggcagacaagcaugcagggagggccgucagcauccacagaacuuaccgaccugacugagagcgccacgugcaccaggcucacguccugagcgugugcccacagcccuuggaguguuuacaagaauuuccuugguucgaucuuacauguauuucauuuuaggggaaacaacgcaauuccaguuuuacaaauguauugggguaaggagacuuaagaccucaguuaagcuuggagaccagugauuaccggggcuugcaagaugauaaaauggaagccaggugggacgucagucuggcaaaaccaugacccggcuacagcuccacugauccagccugucuccucguggcccauuuccauaugcaauuaaggaaaucuucauuacguacuuacucugugggaaggauauacacccuagagcucauucacuguuugaaaugucuacagcuuccuacgggaaauaggggcuuccagaauccaggacaagcuugccucuggacaaggcugagcaggcuguuaagggagcagggguccccaucccaggcccccugcgauggcaucucucugugcuccccgggagagugggcgggggcagggagagacgggaaucgggugauauuaaaguuucucugccuuugugcuuggaaaccagcaaggcaaaauggauuugcugcuguuuuauauuggacacgggcuuuugaaugauguucuguuaucuuucuguauuucuuccccacggaaucauucuucuguuuuugccuuuccaccguuuuuuaaaguuuugaaugucuuucagccuagcucuugguuucuuaaucuuuuucuuucucucugcaaaaugucauuuccaucuguuuccauuuucauucuuuuacguuuccuccuucccgagcuaauaaugacuccuugcucuuuuuccauuccauucuugccgcccgccugagugugccccaaaagccuucuguuugguuuuaucauggcagaccaguguucuuuucugaagaugcucugaauugucugucuuauuguguuugguugaggccuaguaauuuucgauaaagcccuuaauccaaguacuugacugaaaauuaccaggcuucucuguggaggaugagggucaaaaauagaaguccuucuaugaggaagaugcagucagagugagacagucaguauuagccaacaccagccaccucugaaaucaagaaacagccuggcagguugacaaaugcgauacauaauuuguagcccaagugauauaugaagcccugugacuauuuucagcuggagcucuguuguauuuucccuuaaaauaaccuucccuugacaaaguucacacuuugccuugcaccaauguaaaaaaaaaaaaaaaaaagcguuuuacaucauuguguaaacuaaaaauaggaguuuggagcaaauuuccauuuuuggucaaauguuugcaucucuuuuccaaguauuuggggugaaauuuucacaucuucuaaguuucccuuuggaaacacaguuguuauuaagagggacugcaggucaacauaaugaagcccucauauggguuucuuguuggcauuucuagaauuuuugaaaaugugauauuagcagaaccuauucagccagaauuuggccugaauauucaaagagaucauauguucauuaugauuugcuccuaugcaguaauugaucaucaaagcaugagaaaguccauuuucgagucaguaacaacaaugcucccuuagcuuaugugggaucacuaacaagcuuuuccacccaaagcccacagugugcccagugccguccugcgccgugaaauaccgagauggagccaggcccaccucgaggcgauucuagcaucagggcucucauaugagcagauaaauaacaaaacccaccuuccgcccaucacacaggugggcgcugggucucccuaucccacaggugcaggagugaugccuucuuuuggagagcuagagaagacuucacagaggugguuacauuucgugcuucuugaagaguaaaauuaaguuugccagaugauggcugggaggaacaggaauuucagagugugagaauagcgccagaaggggaagagcuccugaugacaucucgcuuuuccggggaaguagagccauucugggagauagcagugcaggggacugucuucgucccuucaugcuccuauaacaaaaugccacagacugggugguuuauaaaccacagauucauuucucaccauucuggaccugggaauuccuagaucaaggcacucacagauuuggugucuggagagggcccucugccugcuccacauaaguagugccuucucugaguagucauguccuggcagguguggcggcgcucuuccgggccucuguuuugaggccacucaucccauucaugagggcuccaccgucaugaccuaaucaccuucgaaggccucaucuccuaaugccaacaccuugaaggugaggauuucaacccgugaauuugagggagacacaaauauucagagcauagcaaagacauuggagcuaguuugucaguggcccuguauugucuccugaagauuuggcuuacaaggacccaauggaaauuucgugaaaguagaaaauaaugauuucauuuuccucuuuucaggggguaauucuggcaacaugguggcagcagacuuagaggagggagggugggagccagagacgagacgagggguggggcauugggccaggccugagccccauaaagccaguggcagauggaagugaugucaugagacuucaaguuagcagauuccacagugucaaagacccuugaacaggguuaaagccagaaaagcaagugccagggguggcuggggcacccacuggccuagaagccaagaguucuugccgggaggaagauguaggaagggaaugcuucacuugcugcagagagcagauggagguccuuucauccuuucagcauugagcaaggcagcgagggugcacacugagcaguccugugcagggcauuuaauggagggugucaaggaaagggagaaaugagcagggucacagcugcagugaugcugggugcauagagagcccugggccaguucacagcugcagugaugcuggguguauagagaguccugggcuaggucacagcugcagugaugcuggcugcauucaagaaucccgggccagguuacggcugcagugaugcuggcugcauucaagaauccugggccaguucacagcugcagugaugcugggugcauagagaguccugggccaggucacagcugcagugauguuuguugacuccccagccugugcccuggaucccccuaucccaggacaucucaccagcaagucugcacucucccuuugcagcacccauguguuguucucugucagcucccacccucccaccugcaaccaugccauuauugcucucaccuuuaagaagaguucuuucuuguuccaacuccccuguccagccacugcccauuucuccuccucuuucuacaacacuccguaaaggauggucugcacuugcuguuccucuccuccuguugucucuggaguccacucccucaccaguggccaguagcugccuguggaaggcaggagugagcagcacggugucucuuucuguccaguuaaagcaccgagcaagaggcaacuguaucucuugcugccugcuuuagucuuuucaaggucuuucuuugcaaaacuacaaauguccuggccuaaagaaaaaaugucauaucucuguuacaaaaaaaaaaaaaaaaaaaucuucauuuuuuuaucuagggcauuacaagcucagugaguaguuuucuguuuugacuaauaaggacuugccguggaauaaaggagacauguugaugaacauaagugacccgggcagugacuccuaugugaucugagcaugaguuacacgggcagcgacuccuaugugaucugagcaugaguuacacgggcagcgucuccugugaucugagcaucaguuacacgggcagcgacuccuaugugaucugagcaugaguuacacgggcggcgacuccuaugugaucugagcaugaguuacacgggcagcgacuccuaugugaucugagcaucaguuacacgggcggugucuccuaugugaucugagcaucaguuacacgggcagcgacuccuaugugaucugagcaugaguuacacgggcagcgucuccugugaucugagcaucaguuacacgggcagcgacuccuaugugaucugagcaugaguuacacgggcggcgacuccuaugugaucugagcaugaguuacacgggcggcaacuccuaugugaucugagcaugaguuacacgggcggugucuccuaugugaucugagcaugaguuacacgggcagugucuccuaugugaucugagcaugaguuacaugggcagcgacuccuaugugaucugagcaugaguuacaagggcagugucuccuaugugaucugagcaugaguuacacgggcagcaacuccuaugugaucugagcaugaguuacacgggcggugucuccuaugugaucugagcaugaguuacaugggcaguguguccuuugugaucugagcaugaguuacacgggcagcgucuccuaugugaucugagcaugaguuacacgggcagcgacuccuaugugaucucagcagcgucuccugcaugacacagguaguagcuccucuaugacccgggcagcgacuccugugugacccgggcagcgacuccuguaugacacgggcagcgacuccuguaugacacgggcagugacuccuguaugacacgggcagugacuccuguaugacccgggcagcgacuccugugugaccugugcauguccuggguagugggugcugcauguccugggcagugacuccucuaugacaugggucauggcuccuggaugacacaaauaguggcuccuggaugacacaggaagcgacuccuguauuacacaacagugacuccgauuuggcaaggcagagguucccgugugauggggcuccugugugacaugcaguggcuccaguaugacauugaaguggcugauccaucuugugcacacuuggggugacuuuggcaucauuacugcaagaucagucagcuuugagcugcagaccgucuuugcuggugcagggaaucaggccugagucugugucagaaaggucuuugcaaaaagucaauccugcacccacaucagucagugccgguugagcacuccaggaggaccaaggaugaggcuuggcucaaggaaaaagcgaggggccuggagagaguggugaugcuugcaaagggucuccauuccuugcagcguaguugcaggcaacaccaagacuagcugggcccuuggaaucauccaggcccaccucaccagggccgccagccccacaccuggaagggaugcugucacucagcacgcauugagcaaagaacggacugaacgcagccuccugcuaguccugggccucccuggcuccugugcugcugagggaccucccccagaguuccagauucuuccgcaccagugauuuuaauccauuuugaugucagagaccugugugggacucuggaaauucagaagguaauugaguaugacucuuuucccaauaacugcugugaaaaaacagaacagaugaauuuuagaagaaugucugaaauucaagcauccugugagguaucuccacuggugaguuacuuacagcuagucagcaaaugaaaccagagucgcccaccaguauccuggugagucaucgccagccugaauuauuagaaagggauggcugucccggcuggcaucuuuccuuucaucugcugcuguucccuuguccugugacauccguguugucauccuaucagaauugucaacaucaccucauggguaagaaaucaauuccugcuguguucucuacagcugcuucugucugggaacuaaggaaggagcuuuauuauaaaagaaaauuuuuauucaaguuucuauucauggaacuugaagaaauggaacuuccugaaaccaagagguucagaagaauagagagaagauuaucaucucaagagaacacgucucguaucaucugggggaaagcaggguggggagaccgugcuccgugcugcaagucaaccggcaauuucaagaaugccguaaauuggauuaaggauuucgcaucagaaaauaaagcuuucugcugauauggggcuuuuucauuuggggcuguggcaaaccucauaagccuguagcacuucugagaacggagccaaaccaggguguucaaucgcagagguuaaagugauucuuucacugagauaaucuaaaucuagaucauauugaaucugccuucucucuggcacggaaacauuuuccaagguauucacguuggaaguaugaauuacccacacucucuuuaaagccccauccaauuaaaaguagaugaaaaucuccuuaaugcagaguccuuuagaacaugccagggguagcagggagggaugagagauauauauuuauaggaaaucugauagaagauaccaccaugcaaccugagggugagucugagaagauauuuacucaugacuuguauuucuuuuaaaaacaauuacuuuugauauguaucuaaaguaucuucucugucauuuaggauaaaaacagauuaggcuuuuacucaggaaugaauuagaagcccuggcauucuaggcagcuacagaguuuguauccgcuugcagaaaauuuaaaaaaaaauaagaagaagaauccaguguaagagaccuacaaggaaagguaauguucucuuugaaauggaaaucugcucagagaggaaguggucacuggagcuuuaaaaaaacguuaaaaguagggaaguucucccuuccuagaaaaugugagccggggcucuggcagaggacauacgaaagacuuagagcagcagacugagauauuccaggaaugggaggcaacuuuaaaccuucagcaggaugggggagacagacagauggggacucugggaagggaccagguagcagagcagggaccguaggcaggaugucuugggccaccuccuacccucccuggacacuggucccagcucugaaaccuuugucuucuuugggcuuacuuuuauuuuguuauucaaaguauuaaaaugcagcucugauuguagaauaacuuuuacucucaucaaaaaaaaaaaaaagcagaugguuucuuuacgucguggcuaugacaagaguacuuugggagcauuuaaguaaaacaguguucuuaaguuuauuggguggcucugaagugagugaggacuucaguggggucauccuggaaaggaaaggcaaaggccagugagcgggugggggcucagugccaugggugacccaggucuggggcuuggcagucugccuccccugugggaaccugcaguucaaggccagccuggacucuuuucaaauccauccuggcaggagguggggaagcagcuuggaagugcugcuauguggccaucaggagcaaggacuuucaaaaaggccacgcugggucaagcccaccgcuuaucugcuguguguccuuggcaagcuacuuaccagucugaucccuagauuccuuaucugcaaaauggguauaaugcagaugcccaccugacaaggugauuggaggccuuaaaccggagagcacagguggcuggacauagaguaagcugggaaaagccaaaaucaccuuugcaaaaaaaauuaacagugaggaaaugauggcaguaaaagagaucugaucuaaauccucacccaccucccacccccagucaugccucuccuguaaucauuccugggcuuuggcuaagccaacuuugggagaccucuaguuuaagguuuaaaugauaauaggccuucccuaaaacucagcugccuugauaaagcuaaugaaaggccaucaggcuaggaagaggggagaaaccugaauucugcuaagguguagacugcucacaaaauauacaacuucacuaucguagaugagccuuuugagaucuuuucagguuuuuugcaugucugacaccuggcucuacccagaccaccagccccacuccuauggcccaccuagaagcaacucagcucaagaggacagcucugacccccugugauuucaucagcagcaagcauccauuaccuggccgccaccaccccuucucccaaacugccuuugaaaagccccuccccuaggaaccuuuggggagauugauuugaguaaugacaccgucucccacguggcgguguuacuggccgcaaaucuguauagcucugcagcaaccucaguucucaccuugucagaagaaggaauucgauugaggggcauaacgcagaagaagagaccgaggcaaguuucagagcaggagugaaaguuuauuaaaaaguuuuagagcaggaaugaaaagaaaguacacuuggaagagggccaagcagacaucuuggaggucaagugccccauuugaccuuggacuuaggguuugauaugcuggccuacuuccagcgucgugcaccccuuuuccgguggaaugccccuggaagguuaccaguuaaacuccgccauuuugccucucaauucacaugcuugggcccacucacccagcuccugagaucuuaucaggaagcugcugaucaccagcuuguguuucuagcucuugggaaacugccuuucccuggcacugucugugaccaauuauuauuuuagagagacaguguacaccugccugaccaucaucugacggucaccugacuuuccugguagggugucaggacagcccucuccugccccgcucaugccugacuagcuaccugcuguaacagcauggcuggccuuaugucaauuaaacucuuucuuuacugcaaugccuugaucuuuuuuugugcagcaggcgggugggggcucagugccaaggguagucuagauucgcggccuagaaagccuggccuguugggugguuccaaagcugcgugguuccccucaggacuggcgcuaccgucuugugggaaugauggaaguugaaugcagcauauaggaagcuuuccugauuguaacucagcauccugcaguucuguucacuaaaccuuguuaagcaggcccuggauuaagguccagagguuuuacagguugauaaagcugagccccuguccucaagggcuuauauucucugaggaggaaugacaaagggucaugcuaguuucaguaccuuaccaaaaguuuugaggcagcaggauccugggucuuugugggagcacagaggaggagagugggcggcagcuaggaaggcuuccuggaagaggugguuccucuuacuuuuccaugguuuucuccaguaauccgcuuuguuuuucccaagaaaaauaagggaaauucaggccaacuaucuaucaaaaaauuauuccacaugugucaaaagcuuaucaacauuuuaaucacuuauuuggaaaguuacuuaccuuacaaaguucccccuuuucaaaaugauaacaggcuuuauauccauagcauagucacacacauacaucaaacuuucugcaagcuuuaguuuagagucgaagucugcccuguuauuucugaucauuggugauauucgacauagcauuuuuuagguggacagcuugggaaaagagccaagucaggcgcccaguuucuacauaaauggcaccccacagccucucuucacccuacgguuccuuuucccuggcuccaaggcugcuccgacagacgggcuucgggccacagcuggcagcaggagagcaaagacaggagcagugaggacuggcugacagacugcuguuaccauggccagaggccugcgugauugacaugccagugauugaccucuuuggccagcugaugccgcaggucacgagccaaaagacaugagacucaagaaaauauuuguauuuuuucgguguuauucccauaauguuucauucaaauguacuucuacacuguuuuauuuugaaugauugcauuccuguuugacucuuugcacaauucaggccucggcuucucuuucuuuucuuuauuuuaacucacagaugugggaggaggccauugccuugggcaaggagcuagccgagcaguaugagaacgaaauguuugauuaugagcaacucagcgaauugcuggugagucuuuauuucuuuuuauuuaaaugaacacaggcaaucucagcugguuuuucaggaaucucucuuuccaugucaauguuaggguucaccccaggcacucugggaccuuggccaugucccuccguuuugccuaggaagaugguuuuaguuaauuugcugguugauauuuggcccauaaauauuuacuuuuuagucccaagucagcucuuauaaccaaacucuuaaggcuucuaugaauaaauuguacguaaacaacugcugaccuuguguauagcggucuugacagcccaggagucugugaacauuuguacuaguuuaaaacugaccccaggccaggcgcacuggcucacgccuguaaucccagcacuuugggaggcuaaggcaggcggaucacgaggucaggagaucaagaccauccuggcuaacacggugaaaccccaucucuacuaaaaauacaacaaaguagccgggcgugguagcacacgccuguaguccuggcuacuugggaggcugaggcuggagaaucgcuugaacccaggagguggaaguugcagugagcugagaucgcgccaaugcacuccagccugggcaacagagugagaguccgucucaaaaaacaaaaaaaccugaccccuucuaugagagagggauggauagauaaugaccagaccuuucuucugccaugggaaugcuguuaguuucuaauugcuaccuccuccaccuugucauuuuuguauucagcagaucaccuuaaugaugugggaaugucugucaugaauuuagaacagaacgauucuguuccuuuaaauucucuuugaacguaucccacuaucugaccuauaccuuuuaaaaaauacuaagggccagccauuucuauggcacuucuuugguuauugaaaacacccauaagucacaacuuuuugcugaauuugggcuaguugguucagauucccuugcggaaugauggagaaugagugaaaaauaaugucaaaacgauggagugagaugaaauucaggugcaagccucaguacccucucccaccaucucccucucccaccaucucccccucccacccuauagaaguugccagagcuuuuaaagagcccgcaagaagaauccagaggcacacaugcuugaauacucaaaccugaaaugcauuuucuuuuuuccuuccagaaaaaacaggcucaguuuuaugaaaacaucgucaaagugaucaggcccaagccugacuauuuugcuguuggcuacuacggacaaggguuccccacauuccugcggguaaaguuugguucugccuaaucugagccaugauuguucccccagcagaaaauccccuucccguucugaggaaggguggggaguuugcauccgcgugggaucgugcaacucucuacacugccauagcucggugguuagcccggggggcagagagggguugacaggauuuuauuugguugcauauaaccuuucuaucugauuuuuccguaaaaggacccuccuucagagauuuacacguauuauuuuaauugaggugugauauaugauaugugauacuauuugccaucuuagccauuuuuagguguguaguucgguggcauuaauacagucacguuguugugcggccagcaccaccaucuaccuucagaacuuuuucaucuugcaaaacugagauucugcauccauuaaacacgaacuccccauucucccuccugccagccccagcagccaccguucuacuuugugucucuaugaaucugacuguuguagggaccuuguauuaguggaauuguacaguguucgcccuucuguguuuggcuuguuucacucggccgaaugucuuccaguuucauccagguuguagcaugugucagaacuuuauccuuuuugaggcugaaugguauuucauugcauggagaggccacauuuuauuuauucauugauccacugaugaacauuuggguuguccccgcccaaugugcugcuaugaagauguauguuuuuaauuauaugggaaauuggaaauggaucuguauggccacggugcuagaaacuccaaaccaggcuccaucccugagacaggcaugugcuuucagacauguaauugaagcaguaaccgugaucaccugccaggugcccauuucccaguauucacaugaggccaaaggagaaguuacauaaauauuaauagugcugccuggccuaccauagaauuguuuauacauuuucucaagaacacauucuuuggaugccauugaccagugggucaugauuuccugauauuucuuaugacuuuuuuuuuuuuuuuuuggacacuugguuuucucuuauccuaggagacuaugugugauugcucuggcuuuaggaagcagaagcucugugucuugagcacagccgucuggggcaguugaaaccaguugggagauuccccugguuccagacguuguucauuugggguccuguguuuccgacuccacgggagucacuaauagugugacaucucuucaucacggcacccagaggauacagaccuccccuuaggaagggcaugucacuguugacaggggagcaccacaguucuggccugcucuaggaggugaggcuggcugcccacucaguguccugccuggugacggaggcgucuggcccuguccuggucacuccuggucacugcuggucagcuucuccucuugccuucaucgugcagcaaagacagcgguugaucagaagcacagauucugaacaaagucuucccuuccaaagaaugaauaaaggaggcuuaguuacaagcucuaaauuagagacaaauuugaaauuagcuucauucucaauaaaaaacaaagcugaaggguggaaugagcuuggaguuaaagccacuuacuguugcuaaaggcuuuaauucgagugugugugugcuccggaacauacaucuuuaggaaagggaggcagguggacccuaagccaugcagccuugugcagugcuugguguuagauggugcguguggccccuguggauggagaucuaccucugguauguaggcaccaacucuggauccgugcaggaugguuaucccagaauccagagcaagggagcagccugcguggaauauuaugugagggcagugccgggugcggaggacacguugcagcucccgagccaauagaugccagguugugccaggagcucacacacagcaggcuccaggggcggugcugggucaucuccaccaccaaaaggacaaaaugaaaagucugaauggagguuaacaggcucgauuaauauugaacugacuuucccgccacaccuggaucauucugugggucugcagcaauauauuuaucacacuucacagaugagcuggcaggggucaaucugccaaugacacuggcaguuaccaaaacgugggcagaauguuugcgugcuucaugcccugcuggagaggagccuccaagaacugacuagcugucccuuuugcuuuguuuuucucuaaaaauuggucucacuguuuuuugugcucauguugauauuuauagaccuuacaaggaauaaauaucuuugacuauauguacauuucccccuuguuuucauguucaaaaggaucacuucagaaugcaaaguaacugacauuuucagaaaauguuauucguguuuuuaccuauaacucacuagcuuuuuucuauuaaagucuuuauauacauuuuuauuauuauguuuucucauguaaagcauaagaaaaaugcuugcuaguuugauaguagucuguuauccauuaaaucuuacugaauuuuggaagugcguggcuuuauauagaagccuuagaaguugcucagacuguauuuaagaugacauauuaucugguuucugcuugacuuuuuuuuuucgggggggcgguggggagaaauagagcauuuuucuuccauaaugguacuucuaagacauaucuaagcacaaagugaaaaagaauucaauucuuaaacugguucuuuuuuuagcgauuuaggagaacucagaauaagcuggggcaagggaaggggacugucuuaguccacuggggcugcuguaacaaaauaccuuagacuggguacuuuauaaacaacaggaauguauuguucacaguuccggaggcugggaaguccaagaucaaggugccagcagauuuggagucuggggagggccauuccucauagauggcgccuuccaccuguucucaugggguggaaagggcaggcagcucucuggggccucuuuucugaggcacugaugacuuuccuaaggguggagccuuuccagaggccccaccuucuaauacuaucaccuuggugauuagguuucaacaucugaauuuuggggacuacaaacguucugaccacagcagggaucaauugauucagugucauagaaucucucuuaauccuuuugaaaauccuuuaguuagacaaauuuuaauuugacuucaaucuuagucuuuaggggguaaguguaaaaauaugcagcaaaaugcuguccucucugucugucucugucucuguucgucucccucucuggcaccuguccaggaaugacugcagauggggcagggcugcagcugacuugggagcagccaaccuggagguucuucccccguguccccugaucaaagaacagaagcaccucagcaaccacgccccguccuggaaaguguuacccccccaaccccagacuucuguuucuuguaccccuguggcuucugcucgcugucuucuccuuguggcaguuuucauuucgguugagacagccccagaugggacaggauggguggggggaggcagaaggcuuccaaaaccagcagcagcauuacacuagguacucauuggccccuuucugugaccgaguucacacucagaacacacguguugaaaucgggaaaaaaacggagaccuguuguaucuugcaaggaaaacguuccuuacagguauauuuacagaggacugugucacacucaggcagaaaugaccucaacaagacagccucguggaaggaagaacacuuaccuacuuaacuccccuccccgccccggacugccuagucuagccuagccgucuauaacaaccccaguggacugacauuccaucuuggaauuuauggaggugacaaaagugucauuugagauggaccaaacccagcccuuccaagaagagcucuguauguuuuaucuugacauguguugaugaauaaugaccugcacacacauucugaaugcaggaagggaaguccugcucuccguccaucgccagucacucacucgggggaggccaggaacuuaguagcucucggcucuggucugcaucccuuccccucggguucugcucgccucggcugugucucacaggagucagcgcccggcggccgugugcaggugcuggggccccaccuuagcucaagcucucuuaaauuccuuauggcagaaugaaaacaacuucauuagggccuaccugagaagaaaacaaaaacaagaaaaaguguggacaucauuauccacuuguccuggcugccuugcccccuucuaaccauuucaugcccauucuagugugggcuucugagugcucauuugguuuuucauauaguuuuuaaaucaguuguuacugucaagaugaaaacauaucacagauguuaguagcgcagugcugagugcuucuuaaacaguauuaacuuacaugcuugaugaccauguguucuugauuaacaaagccaacgcaaguacaaaaaaaaauaaaaauuacaaguuguucuuaaauuuaaugacauuuuguaagaacccguaaggcauauuuuaaggccagcauauugcaugugaacucuuccuggcccuuucucugugguguuaugaaaugaaugucacccuuuucagggaaaaguuuucauuuaccgagggaaagaguaugagcgccgggaagauuuugaggcucggcucuuaacucaguuuccaaacgccgagaaaaugaagacaacaucuccaccaggcgacgauauuaaaaacucuccuggccaguguauccuuuaagacaaccucaucaacucugaaaccauggugaugccauucauuugggugguugggugugguggggggccucucucaugguugaugucuaugcugccuuagugauccuuaacccccucaccucagauauucagugcuucacagugaagcccaaacucgaucugccuccuaaguuucacaggccagugucagagcagauuguaagguaauaaucccauuuuucuuacccaacgugaggguuguaagaggcuguguacagaucucuugcuaauaauuccaccuuuuaaaggacggacuuuggccauggauucgcuuuccaaaugcucuuucuguccucuuugaagagcaagggaagcuaauuauuuucagcauccaaaaaaagugacaggagauguuaauccaugugcugggagcgugcaaagccuauuccuuucccaaagucagcugacagcaaaaaccuaagagggcaguggaggccgucuggucuccuuuauagaccugcccugugggguacaauccccuagggaacuucacagcagugcacaaguccugccuguucccagcaaagccaaguucauacaugugaguguggccugaauguuugcauuuuagaaggcgggaaaugggauuugcacauuugcuccuggugacacacaggagaacccuucagccuuacagcacagcaauuccauaauguaggguuaugagggggcuuuuaaaccuccugagucaacuguccauauuugagugagauuuucugccugucaguuguaucgcaccugacuuagcaauggcauagaaagaccugcuuuagcagauguguuugauauuaagacuuuucuguucuguuugauccauguucuggugaaaauauuaaucucuuugaugaccucauauuccuuaggaucagcuucauuuugcuuccugaaguuuggugguuucuuuaaccuuucaucguuucuuugaccuugcaucagcaauaaugggaaauaaacugggacccuguuuauuuacaaaugauugcucucgcaaggcauacauuuuaaggguugcaacauuuuuuuucagaggccuuaagcaaauagugacgcuuagagccuucucagaugcaguaguuucuuuugcuguggaagccugccugcauuucagugcaggggagaaaucagucucagucucuccacgcccugcccugugcaugcggaaagccugccucguaccccgaccgcggaggcagguuacuuauguuuccugugugucacucuuggggugguugcaaaaucugugcuuuguagaucugaaacuaagguauguaauacuuuuuuaaaauaauaauaaacacauacguugaacacaaaagcuuuuuucucucuccuucgcuucaccuuuccucuguuuuugcucauuucacucuuacucagcuucuguuuucccucgaggguuggcagggacagggaagaggcaaaaacucaaguuaauuuuuccaccugccaacauuucccuggcugggagaggacaccaaggcgauggcuucaggucaagguuagggacauuuuacaggaggcagugacauguucuaaggccagaccccguguccaaaagcaaauuggcuauuugccggguuaaauaucuaaugaucugucugucucuguacaguuuuuacagggugaacgagguccagcgauuugaauauucucggccaauccggaagggagagaaaaacccagacaaugaauuugcgguaaaaaacaaacaaaccaccaaaccaaacaacaaaaaauaucauuccgccaccaguagaacugccacuggagaagcguggccucagaggcagccacggagccauauuaaaugucuuuguguauuaugugcagaaaucuuaaucuauuacccccuccaaaguuagaaaaacuaauugccauuucacuaacaauaugacuaaggucacugagauauuuaauaaggagacugugccguccaaaugccggagcucccauaugaguagcgcacugccuucccugcgagccccaggugagagagcaggugccugucaucucuaguuaaaaauggacccaccgagugcugaggugcggggugcugacguggcuuucugcaggugacacagcagucagcacaugaacuggaucuggacccgggugcucauuccucauucaguauccagcaccugaacuucaguggagcacaacacacaacugcaggguugaccccagcacuacuagcaauacggaccggguuauucucugugguggggaccauccagugcauccagggauguuuggcagcaucccugaacacugccuacuaggugccagugccaccaccccaguugggacaaccaaucaaaaagauuuccaggccaggcaugguggcucacaccuguaaucccaacacuuugggaggcugaggcagguagaucaaauuaguucaggaguucgagaccagccugaccaacaugguaaaacacugucucuacuaaaaguacaacauuagccgggcgugguggugcacgccuguaaucccagcuauuugggaggcugaggcgggagaaucgcuugaacccaggaggcagagguugcagugagccaagaucgcuccauugcacuccagccuggggaacgagagugaaacuccaucaaaaaaauaaaguuuccagacauugcaaaauaaaacaucugccccuuguugcaaaccacggcauucgaguuguagaaauaacagcaaacaucuuuagagccuuuuuucuuuauuuuuuuauuuuuauuuguuuauuuuuuuugagacagagccucgcucugucgcccaagcuggaaugcagugccaugaucucagcucacugcaagcuccgccucccagguucacgccauucuccugccucacccucccaaguagcugggacuacaggugcccgccacuacgcccggcuaauuuuuuguauuuuuaguagagacgggguuucacgguguuagccagaauggucucgaucuccugaccucgugauccccccgccucagccucccaaagugcugggauuacaggcgugagccaccgcgccuggcccuagagccuuuuaaaaauucuacauacaaacugcuuucauggauucauuuguauuuuuauuuuauuuauuuuuuuauauagagguggggucuauguugcucaggcuggucuugaacuccugggcucaagugaguggauccauguugaaaaggcaucaaauaagccauaauuuuuuuaaaauguuaauguuuauccgucuugccugggaaaccuccggaaauccuucuguacuccuguauugcaaggaggcauuagcccggggacccccaaggaggaccggcucugcugagaauggcuucucuugugugccguccgaaggcaucuaggcugcaaaggucaaaggugaauuaacacccuacuccugaccagagcaaagcucggaacccuuccagcaggguugccucaaguaaagagugguggcuacccagucucccucccaaucccucaggggucugccagucaugggauccucagggcaguaccugugagucuccuagcucagcucuuaagagccauggggaaguuccuuccagccccgaggccagauuccuugugugucaccaaggagcacaaaggagcuuggaguuggugaaaucugcaguauugugcagucccagcaggcugguuguuugaagauuauguucacccuauuuguuggugaacccagcacccuggaccuccuccaggacuggucacuacaguguccauugucugcaacagugcgggcagaaccuaggcacguccaaccuggacacccucgcuaagggcaguggcuuucagagcagacugcaccuguuacugucaucauaagcacuaacgcuaguguuuauauggagucccucaacugugggauuuauaggcaguucuugaauuucccucacaccucucccaucuggcaaguagauauauucuuagacuauaaagaaauagacacaaggaggucaagugagccacuggagggugcgcggccaguugggugcagagcuaagaauaacgaaggcucuugacauuuugagcuaugcugagccucagaggcuaugcuucuucuaaauggcccugaaauccccuaauggcccuguugagguccgggcacuuggacaaaguguucggaagcugcaggauuugguccuucacaugccccacaaagccuuagauaagugcaacgucuuuugcucuacugggaagccagccucggccccuccagcggggagccuggcuccaagugcagggggcuggggaagcugcccaccaggccgagagcagugcgagguggcucaucccugcagaccuggcaaggggugacugaugugcuggggagugagggcacugacgaggaggaagaugagacagggccugcgugaggaggagcuggccguaaagcccaggauggaacccagagguccgucucagggcauguugacaugagagaaagcacuggaaucuggucuagagguggaugugagagggccagaccuguuuccauugccaggacaaaaaccugagggagccguccccauggggcaaagaggacuggugugggacacggaggccuugccuguguccuuauggcuucagccagcuccuucccuuuccuccuauggaacguaagaaguuugggauaaaugcuuuccaagauccaagucaguuuucugaaaauuuuuuuuuuuugagagagagucuugcucuguugccuaggcugaagugcagugguguaaugucagcucccugcaaccuccgccucccgaguucaagcgauucucaugccucagccuccugaguagcugagacuauaggcacaugccaccacaucuggcuaauuuuuguauuuuuaguagagacgggauuuugccacguugcccggccuggucucgaaguccugagcucaggcaaucugcccgcccuggccucccaaagugcugggauuacagacgugagccccccacgcuugucccaguuuucuggaaugacuggcauuccauuaucccaucugcuuaagucuagauuccuguugacacucagacugcucagugacccugcagugcagggagguuggaauggcagaagauuguugcaagcuagacaguacgaacgaggcaguaggauaaaggauuuccaguugaccccugcauuggaguuuuugugcaauccuuaaagaguaguagaauuguauuuauuggguuagaacaguuuccugcaauagguaauauacuguuuuacaaagaacacauugucaaaugauguuuuuauuuaaaauaugcauagacacacuuuuuaauacuuaguaagaagucuugaacaauagauacuaaagcauauagguuaucagcuucagguaggggaugguuuuuccuccugcucuuuccauaucuuuauguucucauauaaacauauauuaguuacgucaaaacauuuuaaaguuuaaaauaccgacugguuuuaucagaacaucagaggucacuuugauuaaauccagucucccaaagauguauuugccccuuuuaguuucuuaugaacacuguagcuaauguaagacuucuuuggagccuuccucaaaaucuguuugcucaagaggggcuccccauaccucauuuuggaguauacacaucuuucucacucaccuaguauacuuucauugucaaauaccagaguggugggcaauguuggcuaggggacaggggauacuuugauguauccugagcgaccguuagguagagcguggcuugugaggugcuaccugaaggcacacaugcccugugcugagcaccacagacccuguccugcugaaggaccugacuccuuuggaguuauucuauaaaucccccuuagggcagagcuguccaccugcugacauccuucuaacccguguuguguguguguguuuccuuugcagaauauguggaucgagagaaccauauauacaacugcauauaaauuaccuggaauuuuaaggugguuugaggucaagucuguuuucaugguaaggauggccccaccccagaaggaauuguccguucccuuccucaauacagucugccacgccuucuucaccugcucaugccccguggucacuguggcagcgugcacacagcagacucuacaguucccauaaccaccccaccuguucuugagagcaucgauaucuccucgccuagccauauuuuaguggaaaugcuguguaaucacgaccaacucuagcuuaucaaaaaaccagaaugaagauuucauuucuucuuacaauguauuuaaauucagucauagcugugcuguuuugacaaugcuuuguguuaaccaagugaaaaguugaagacaaauuccagucuacauaaacuuuuuuaaagauuuuuuuccugaugguuuuauugccauuuacaugacaaacaacuauuaauuaauaguccuugcccauuucaaguaaaaauagccugagaacauaccccucccugacccuuuuuaaagaaauaacgauuuccagcucucaacaaagcuaaacuuugcuuugagauggggcaguuucauuuacgugaaacucacauuugcagugagcuauuggacaguuucauuuacaugaaccagaguugggcugcagauuuauugacaguauugaaaugucagggccaaggcaacuggcaauauaaaaacaucugauugaaaucuguacguuuuuguucaugugucucagugccuuuuguuuucaccuggcaagaacucacugaggggguggcacuugccauuuaguuuucaaugaguccccccgaaacaccugauuauuugucucuaggggccggcaucucucugcccagcugcguguccagcgccgagccuucuccuuugcccacaccagcaugagcuaugggcagcuaugggccacucucugagagguugcccgcagucagagccacugcuuuauacucaaagcacccagggcucuucaccuaccccuccuggggucacuuucugcucuggaguucccuuucugugccccuagcagccaggcagugccugacagauagaaggcugugggaguuaugugucaggugguaaaaaugcacucccuuugcugggucccuuuguagcuagugaggcauuguacaugugagagacaacagaagagcaggcccuccaccuaaacaggccgugauccucuuaaucacccucugcccaugagcccuuuguaaucggggccugccagccaacagcugccggaugcaggagcuuagggagguggagaggggagcccugaccuuucgugaggaugcagcuucuccucgggcugcuuuggccauuuugaacagacuaagagggcaggaaggcaaauaaucccagaauggcaggacucacguccugcuaccaaacccugaugcccuccucgugccaccugggaccaacccccgugggauaucugugggagcagcagcuaaccuucuucaauaaaaauaggaagggauucuuucucagugcaaaugagauuaguaacagggagguaacagucaguccugguggaauacugcccuggagugugcauuuguugaagcugugugcccgggaugaaaugucguagggccuggcaaaguaaguuguggggucaggacagcauggcuaugccugcuguccaggacaccggacaaggggcccucucagcagggugcacguggcuggccacaccagugcaucacaaucuccccaaggcugucccuccaucagugcaaggacagugacaucagugggcagacaaccucuguuauguccacagccaccuaggagugccagucuaggguugcugacggacagaaucgcccauucgcuguucaucucugcccugccccacccccagcucccaggcaguccgcuagaggcuguagcaggaagaaagccggacaugaagauaccaagggcucuugggcaugggugggggcccaucacgcuuccuuuggaaggagcaaaguuauugcugaggucacccugggacaugguccccguggcccagugugaggaggagguuuggucugcucaagcaagaccucagggcagcuguggucccugccuuagacccagccacguugcccuggcaccuuagggcugagcuggagggcacugggcugggacucggccaggccaggcccuguggggcccucagagaaagaggguggaggucccugagagacacgcacuggagccaggaggacaguggucaguccccuaccuccugcacugaaggugucauuaaccauggcaagugugcaaaugaagccugugaggguggccuggagugcuccaagcagccuuuuccucccgaccccaggggccaugagcucucuuuguuguuguuuguuuguuuuuuggagucucacucuguugcccagccugaauacaguggcucaaucucggcucacugcaaccccugccuccuggguucaaguaauuauccugccuuagccucccgaguagcugggauuacaggcaugcaccaccacaccuggcuaauuuuuguguuuuuaguagagacaagguuuugcuauguuggccaggcuggucuugaacuccugaccucaggugacccgcccaccucagccucccaaagugcuaggauugcaggcaggagccaccacgccugcccaucacucuuccuucacaugaugguguguggugccauggcggagcccugccuugaccuccuuugcccucccuaaccggacagguagugcaggcugcccgggcuuagauuccucaaaauucccgaacaucuucucccucagcacaacaagcagagaacaagaacaggauuggaagugucuguucugaagcagguguauucaagcacucaaggcugcguguuuuccugggaugaccacauaugugcauagccacaugcacacacacagccccgcccccagagcugagcagcagcuuugcuuuguuccuuuggaauuuucaucucugggaacaaacaauaauaauaaaaugcccagccacccaaaaauucuguuuggaagaaagguucacggaggagcaggaagccugccccagagcacguggcuccucuggugagacccugggaguggaggcagcuguggggcugacaucgggcucuccucucucuuugcagguggaaaucagcccccuggagaaugccauugagaccaugcagcugacgaacgacaagaucaacagcauggugcagcagcaccuggaugaccccagccugcccaucaacccgcucuccaugcuccugaacggcaucguggacccagcugucauggggggcuucgcaaacuacgaaaagguacgggacccaccagcuugcucugggcaagcaguccugcccggggacagacugaaaauucccgagaguccccaaagcccagaaacgccccuggucucauugagcaaucucagcaguggcccagccaaggccaggcagcagcagccaguggcggccccugaagccugcagcaaggucaaggccggagucccggcaaggcuccccugggcauccccagacagccaggaagcccccacugacccacccaggcugggcuuaucugcacccaggccuccaguggcuuuuacaaggucugggaucuuacaggccaaaagauaaaguuagacaaaaacaccagaauaucaggacuagggagguagcgcuuugacgguggagggggcccggccagcuggucucccuggauccuagcucuguaggaaugggcagaaguugaaggacacaggguguauccuagaccaccccugccuguguuuguaacugcaguucuuuuggaagaaggccacgccugugcacuuacuuacgccugaggcuguuuuccugauacuguaacuggcgaguugaguaguggcagcauugaguaguugugauagagaccuguaugguccacaacaccuaaaauguuuaccaucuggccuuucacaaaaaaagcuuguugaccccugaucuagacagagcaaaaacugagacaaaaaggauacugccugagagaaggcugcgaggagaugauuacccacccuugcacaaagaaguuuguugccuucagguguaggucaggccugggcaggugcaggggcuaggcaggaggcaugggcgugugaguagcugggagggcuguauucacugccacccagcaggaccaagccaccaggucagcuguggccuuccuggaccccaagaacugggguugcugcuguagacagcccuguuagcuccacuuacaguguuugaccuugugggacauuuuguccugggugcugcgaagggugugacccugagucugcagugagcuucguguggaucuguuuuaugcacagcucuauucucagggccuggcacacaguaagugugcaaaaaccuguguuugcugagcaggugcacugagcaacucuccuugucuccaccaggccuucuuuacagaccgguaccugcaggagcacccugaggcccaugaaaagaucgagaagcucaaggaccugauugcuuggcagguaaaguguccagcaagaguccugcauggcuggagggaaggaaagcuaggagggucuaggcucagcacacacaccagccagcauggaggucccugggcugcaguccugaugcacguggcugugauugucccugggugaacccacccacugcugucgugaucaacucagcuccugggcugcagucaggaauuugaacacccagaaaauuaucucuugcaaaugaacaaggucucuuuccuccccuuggucaauucugccggcugcuggaaaacuuuuucucugucuguauugauagaacauugaggugagcucagagccaugaagccuugagcucuagccugugccaggaaaggcgcucgggccagugcagucccugugaaacgcauguacgucagaagcugcagugcacccucucccuguucuccgugcaccucuggcgguggugugcguccucaucuguguuuucccagcugaaguugugcaaguuauuucacuguucuacuuaugcuccuggggccucgggagccuuucccagagggccagcaucuugaaagggcagacccugggugccuuggguuuaagugucagaaccggacggaugcaucugugcuucucagagccuuccugagccuggaaguguaggggucaagagccaguccucacaagagcuuggccggcaccagccugcucugcugcuuuaggccacugccucuuuaggcuuccuuuucacaugugggaggcaaggagggugcuguccccgagaucuugccacacuguguaaagagaguugagggaggugggggcaaaggccugcauggguuuggaccaggugucguagcccaggccacuuugcuaagcuggggucccaggcucccagucaaggcccagagaugcugugcaguugaucugcacccaguccagaacagggcaagauacaaaauuagcugggcgugguggugcacgccuauaaucccagcuacucaggaggcugaggcaggagaaucgcuugaacccgggaggcggagguugcagugagcugagaucacgccacugcacuccagccuggguaacgagcaaaacugucuaaaaaacaaaaaaaaaaggaacagggcaaggcuguuccucuuaugagacaucaccgugagcaguuuauuuguuuguuuguuuguuuguuuguuuguuuuggaggugaagucucgcucuguugcccagacuggagugcaguagcgugaccucagcuuacugcaaccuccuccuccgggguucaagugauucuccugccuuagccuuccaaguagcugggacugcaagugugcaccaccaugcccggcuaauuuuuuuguacuuguaauggagaugggguuuugccauguuggccaggcuggucuugaacuccugaccucaggugauccgcccaccuuggccuaagugcugggauuacaggcaugagccacugcaccaggccacugugagcauuuuuauucugacaucccagcagggccucuucuuaguggccucucugucaucagcacauuggccaaugagacgucuuagaguggagcaaggcugagcuuugguugugagccaagguacgaguccucuuaaauuuguguuuagauauauaggauggguuggauuuuuauaauucuaagugcuuauacugauauguaaacauaauauacauuauguauauauuauaaauaauugugauaaaauauacauaacauaaaauuucccaucuuaaacauuuuuaaguguccaguucagaggcaauaaguacauucacacuguuguacaaccagcaccgccaccauccaucuccagagccuugucaucuugcaaaucuccaacucucuacccauugaacgacuuccccauuccucccuccacccaccuccuggucaccaccauucuacuuugugucucuaugaauuugccuacucuagauagcuuauaugaguggaaucauguaauacuuguccuucugugucuggcuuguuucucuuagcagaaugucuuccagauucauccauguuguagugugugucagaacuucauuccuuuuuaaggcugaguaauacuccauuauagggcuagaccgcaauguguuucuccacggaucugucaaggaacaacauguggguuguuucuaccuuuuggcuggugugaacaaugcugcugugaauguggguguauaaauaccugcucaagucccugcuuucaauacucccauaguuugggguauauacccaaauuuagaauugcuggcucaugugguauucuguguuuucuuuuucacgaaacugccaaacucuucuacggucacagcaccauuugacauucccaccagcaguaaugcaugauuccaacuucucugcacccccaacaagacuuguuauuuuguuugucuuuuuuuuuuuuuuuuuuuuuuuuuuugagauggagucucgcucugucaccagccuggagugcaguggcgugaucuuggcucacugcaaccuccaccucccggguucaagcgauucuccugccucggccucccgaguagcugggacuacagaugugugccaccacaccuggcuaauuuuuguauuuuugguagagaugggguuucaccauguuggccaggauggucucgauuucuugaccucgugauccgcccaccucagccucccaaagugcugggauuacaggugugagccaccgugccuggccuguuuaucuuuuaaguaauagccauuuuaaugagugagaaguuuuauuuauauguauauauaaacaaaaauuauauuaaaagggaagaaaucagacuuugucacaaaucugcauuugaaaucuguuugcuuuggaauuaugguuuugaacguccucagaguuugacugaaagggacauuguuggccaacuuuggcuucuuuguauggauuguaagccucauguagacagucucccucuguaacuaaaaaagugggagagaguuuaaaauugugaaugauuccauuuuagauguuguagauuuuuuacuaaaggguacgaaauucaaaauuccucugcaggcuauaaaacuauugcuauacaaaaacuaguuuggucugcaaaaguucuauugauuuuuuuuuuccuauaagcuuuuacagcaaauuggauuuuaagaguuucaaguccuacagaggaaaauaauuuguuccccagagagcagcuuuaugucagcacuaugucaucauuccuaauaacuauauuaaaggaugaauuuuaaagcaggucacaggaaagguaaaagaaucaguuuucuaguaacuucauuaaaucaaagagugaugaaaaaugcauauuccaaacauuaccugugauuuugcuuucauuugcaaauguuuggaaaacccguaucuugguauuggcaacugagucauauguucauuaaaaauaagaaguuugaauuuaucagaaugcuuuguucucuuuuuguuuauuaguucaucugguuugguuuuuuccugaaacuaucagggcagagugagguuuuucuccugggagucccaggacucaugugcagaguuuucaucaccgauauauaauaagcucagcucugaugcauaaaaugguuugugaagguugguuaauaagucccaggcagcuccuccucagcccugcuugcugccucagaaacagaggaugggcugaccugcuccucgcugggugggagguggcagucagggugcacacuguguggugccucuuguagguuugcggcuggcaccaggucaugagucacuuucucaaaggcacaauuccaucuuucuccauacacagcugucauuguggagcaucccugccgaguauccaaagacaaauccauacagucucauauuaaacugcugugauguauacauauuucucuuuugaaauguacgaagaugaaaggcugaacucagccaucauccccagcugaugacaagcaugacuguuguguccagggguggugcuccuggagcauuaagcaaggcuuccagauguucugugcugcuuucagggcaugaaucugugcaggggacagacaggagcaaacuucaaauacggcccaucaggagggcgucuuuguagagcaggcugcaggcucgcuuugauuaauuagaggugugacuuagggaaaguccucucccaucucugggcucugagaaacucuuuaggaaugcagauuccugggaucugccuacagcaaaucagggcucuggaggugggguucaggaauccaccugagauucugaugcuuagccagaguggaacccacucaacuacagggucuccagagaccauuucagacccucggucuauguuaagugcuuuuugugcauuggaauguguuuacucagggcauccucuuaucuucuuucauuuagaaucacaccugcaguucagccccaaguagacauauaacagggaaccaguuccuguccuaucagaagguuauuucccaucaacgucaggaacugcugagaguggugaauucucacaccugguaaauuucaccuaucagauugcaguucgagcagcacaagcguccuaaaccaaaaggucuuaacucucaucugacaaguaccuucuuugacagaaagaaucugaccauuaagaguuuuaucacaccaccaucaacaccaacaacagcaaaacucaggaacuagauuacauuuuguaguuugagaaaggcccgcccuaaaucagaaaugcuuuuaguaucuaggguggcugugcuuucaccuugcaacagcaccuccacacaucccugccuuugcauccagagagagacccaacacauucgacaucccaccaaaaguugucccggucugucugcgucaucccccaaggcggaacucaggaggcagaaggcugacagugagcauuuucuacugcuggcccugaguaaaccgcggcuagccccggggaagcugccaucugcacgaguaauucauagggaauauuaaaacaucccaaguauuuugaaaucucucuguaugcuguccuuucggugauaacuggccagaaaggccugacaugugccuaggguuuggggccaacugucagcaaaacaaacuuuugugucggugcagccuccaagcaggcuaggagggcuaugagcgaggagagcgcugcuacucccuccuuuccuggagcaccaagagaggcaacagcugugugcuauaaaugguaaccaaauacauuugaugcguugauucaucuugauaagauuucuugaauuugcucacaugaaauucaauuguguacuuauuaucguucauacuaauaaaucugcucauuuagauugguguucuguccuauuaggaaaaucuguuuuuaaucaguauuuugauuuaauuauaaauuauugagaggaagccucuuagcuugauuacauggaagaaugucuaacugaguccaagcccuggggggaagcagagaccagggacagaaagggagacuuuuccuucucccaccccacaacagcagcaacucuggugggucucugcagcugggagaaugaaaaugucucucuuagaacguuuuuaaaggucagcuucaucuccacucucggaagugaaguguuggcauggauauuuugugacagcagugucgcagagaagcgauuauuuuuaguuuuaaagaagaauaaauuugguuuucacuuccaaaaaaggaagauuuuucaggacuauagaucacauguaauuaccuuuuggaauaggguucucguaaaggcaauauucuuagcuaaaaaauguucgcacucugacaugacccuuugcuaauagaacaaguuacaucuaaacaaauucaagguguagcucuucccaaacucaagugaaaagcacagauaagucuauucugggaaauuaacugaguagccgugguguagggcgcaccacacuggacauagucaauucagaacacaaaugguuuucauguaaacauuuuggucuuuggugguaauaugccugcugguaaauugaaucagcugguuugauuuggaaaccaaagcagaucguuuugccaguuccccuuuccccaagugugcauugcucguccuagaccauuauccaagaaauaaggaaugucaaccucucuguuuuccagauuccuuuucuggccgaagggaucagaauccauggagacaaagucacggaggcacugaggccguuccacgagaggauggaggccuguuucaaacagcugaaggaaaagguggagaaagaguacggcguccgaaucaugguaagaggguaguaugcguaguguugcagaagagugggugucugggcaucccacuguugaacagggacaagcuuccagagcagaggaacucacauguacacauggugcccgcuuaggaagugggaugugagggagcucagcccccuugggcagucuugucuaccggcaacucagcaaccuccuuucaauaacuggaaaugucagggcgaauaaacauucaugaauuuccuugauuaccaaaugcccccucaccugcugugaacacaguccaaccuuauuguugcagagcaauggagaaaucucacagcgcccaggcaacucagcugguugacagugcacaccuacagucauacaauacacacagaggguucggucauccacagggcaacagcacucacgacggcccauggcagagguagcccagcccaagguugacaucagaggaucauggccaucgaggaagaagugaccaacaucuggagugugaaauuauuagugaagauuuaccuauuguaggaagggguaauugaucuagaccaaggaagauaagccagauguggucaggggaggagaucaagaagacacugccuggggaaaggacucccucaacagaggcugagaggcaggaguuugaauggcaggccaggggccagugcagacacaggcaugcuuugggcagaagagaaaauucagagcggagauggaaaggcacccaaccuccaagaacaagggaugcuaggcuggggcaggaggcucugcucgggaugaagggcagaacugagcuuuugcaaugaguuuauggaagguuucugagcaaaggcuggcaucaggagcaggguggagagcagcuugaguuuuaaugaugcaaaaaccuugcaguucaaaucuuacagcccacuugagacuguccccaggagccaugccuuagcagaugugggagcaaagccaggcaccgugagucacagugcugcccugcuuugcagcucagaguggugcucccaucuuuacucagucucugggagcuuugcugggccuacccugccugcucgggaacuguggagacaccagacacggcaaaggguccccacuccccauuguucagggaugaggggcaauguggcacagagaagcagggagcucucuucugucuacuggaauuccaugccugccggcacugagggggugugcacagggcuucaacuccccggcaaaaggaaggcgagcugugggaagucgcgcugcuucucccagguaacauacggcacuuuccucugcuccuugaagaccaggugucgaguggggugugccauuuugguuuuuuucugggcccagggccgccuguccaccagucccugaaguucucagcuauucucuauugaacccuguuuucuuugacacauugaucucaauaagcaaacaguaauuuagugcuccccacgugccagggaccuuccuaagugcuguauagauacucaguugcuuaaucugccucacacucugugaagcaggcacugcagucaccugcauuuuacagucaaggaaacagggacaugggaagguaaguaggucacacccuagcacguggcagacccaugguucaagcccuauccauguaccuccagggucugugcuuuuagccccuacuccaggggcugacauuuggcaccacagagcuucuccgccucuuucccacaugguaggaaaugcauaugagaccugggcaaccccugagagaagguaauuugguuaugaucacacugcaugcucucccagucuccccgccucugccgggcaugaccgaaccuuggugccuccaagccuaggaccuggugucccucagaugagagggucccaggcccagcagggcuugaacccaacaaagccaacauaacacaacugcugcucugagguugaaaacucagcaggugggagucuggaacugccagcccagcgggagcugcugcaggugaacaggccuggaaaucagggcucuguccuucaaggcugggcuggaggauccuuugugcaagucagaaugcuagaguagcgcuugauagcuucagagccugcaacucauuacagucagagcugaguggcaagaagcguuucggagugcgucacaucgcaucucuuucaaaguugaugccuguauuaauucauucuaagaaacaaacacuugugaaaucuugacauuuucuuccuaagugaaaagcuuccucuuuucucagucauuuaauguauauuucaaaaucacagaaagcugucuggcucaccagacauccugcauauucccuucucugccacauucaugaguucugagugugcuugcuuugggcacagguggagaaagcaagggcaggaagguagggugcuguggauuggugugcuguguggauuggggugccgugugaauuggggugccgugugaauuggagugccuuguggauuggggugccguguggauuggggugucauguggauuggggugucguguggauuggggugccaugucgauugugccauguggauugugguguuguguggauuggggugccauguggauugugguguuguguggauugggcugccauguggauugugccauguggauuggggugucauguggauuggagugccguguggauuggggugccguguggauugggguaccguguggauuguggugcuguguggacugugucauguggauugugguguccuguggauuggggugcuguguggauugggguaccguguggacuguggugcuguguggacugugucauguggauuggggugccguguggauugggguaccguguggauugugccguguggauuggggugucguguggauuggggugccauguggauugggguaccguguggauugagccguguggauugggguaccguguggauugugccguguggauuggggugcuguguggauucggguaccauguggauuggggugccguguggauugggaugccguguggauuggggugccguguggauuggggugucauguggauuggggugcuguguggauugggguaccauguggauuggggugccguguggauugggaugcuguguguccuugguuggagcuuauuuccagcacauugugaggcagcaccgucuccaucaaccuccccacccuucucuguagcaccagcugggucaccccgucuagggggugggaggcuuuuacagaaugaagguugcauuuuccacccugagauacuuuguuccccggacccaccuugcagaguccugcuccauccuuugaccgcaacagcaggcucugcaagcauccuuugagagucaaggggacuggcagguccccuuguccuucccugagaaauguggcaauaaaacgcagucugggaugugccuuuccugucuuaccuacuuuggaaacuugcaaucaucucagagcacuuugaaaagcaaucuaguaucacccuguuugcaaaaaagauggauuuuaaaauuuaaaaauaaacccauagaaaggacauaaaccauuuugucaguguuucugagccagcuuaagccauagaaagagaagauguggacgcccucugacuucucgauacccaggccccucugccacucugccuuggcuuucaucguguucccaguccuggggcuccaaggagcugccauucccuggaugggagcucugcagcccagcuucuccugaccuuuagggagcgaggugugcagggccccagggaugagcccgugagcaccugccacguucggcauuggcccccgugcccucaccggcccacagcgccacguucggcauuggcccccgugcccucaccagcccacagcgugcaggaggcauguguguuggccuucaggcuugugaaaaagagcuuuagguuucucaccaaaacuucaucuaccucuucaaguccgauuaggagcagggaaauugauccugguucugcauucucucuacucccauccaccucaucacuccaaacaccauggagagccauaaccccaagaugccaucgucccccucuccccuccccaccuacagucacaacacccgcuggccacccagacccgggagagaaccaggagucacccuuccucccucaaguuaguucuagcugugguauccccugguggugcugggguucaccccaccaucuuugccaucacaguuggccccugaccuggcccccagcuuccaggauuucuccucucucgcccucccuccacagcugccggggggacccaucccaguaguucucuuaacugggauccaugagacccugggguuccucagaggcuguugggagggguguugacugggagguggagcugauagccccugccucagcaggaacauuuagcuucaccuauuccuugugcuggaguuccauggugaggagaagcaguguggcauggccuacaagaacagccagggaccaggguucuguuucagaugcagagcugauggugcaguuguguccuucagucuuguggccucugagggccggccaagguucuaacaucacacucgcacccucccugcugggccugcccaucuucugccccaccccccagccccuccucccccaccugcucucuccaaaggaaaaugugucacccucuguggauuuccaggcuguagcuggcauuuguauagcaucuggaaagggacauuccagaucacgaugaagugugccugcuucuuacccuuccuuguacagcacuggucccugugauuaaguucagccaaccccuucaacccagcccauucccauccaagacucugggcaguaaacaccuguggcuggcucaaggugggacguuacagcucagccgggagacagcgacguaaaacucagggucauuaggcagggccagaggaucgcuccuggucagaaaacuggaaugaguguuugcucaggcggugaagacagcagcagccaucaggguaaggagcccugugggcuuccccggcaucauuucauuuaguucuaaugcuggcccucugggcagggaagacugcucccugugugcucaggaggaagcuggggcuccgaguggcucgggguuuuauggagggucacaccaucagugccagggccacaauuccagccuaguuccaauguccccaacuccuacccaccagcccuacuuucagucacagugucuggccguggagucccaccucccaggacugguugagacccuaauugcaucagaugaaacaaaaguaaagcccugaugucuugauuucuagaggcucaaucaagaaggaauuaugcggcagaccgcccaguaaacccauggucgcacccagggagugcccucugucucuccuugacgggagucauccuccugccaacccccuuccuuuauuccuugaaauccauacucacacaucucaaccaagaccugaggucaccuucugagauuauguaugggguaagguuuucacaguuggggauaauccccaagcaaccauuucccuuuuaguuucuucuaaaggcagaguaauuacagugaacaucuccaugaagcuauccccuggcaccaucauuggugcagguccaagacugaccaaccccucucugcuggcaaaucccagcugcacgucacucagagccaguggucagcaaacuguggccccuggcgugguuguguaaauaaaguuuuguugacaggcaggccaugcucauucauuucuguauuaucuguggcugcuuuugugcugucguggcagcgcgugcuaguuuccacagagaccauauguccugcaagccuaaaauacuuaccugguccuuugcagcagaggucccagcccucaggcaguggacugguaucagucuguggcccguuaggaacugggcccacagcuggaggugagcggcgggugagggagcauuacugucugagcucugccuccuaucagaucaguggcagcauuagauucucaugggagcaugaacucgauuguaaacugugcaugugagggaucuggguugugcacuccuuaugagaaucuaaugccugaugaucugaggugcaacaguuucauccugaaaccaucuccugcuggucuguggaaaaauuguauuccacgauaccgguuccuggugccaaaaagguuggggacaacugcuuuacagaaaaugugggccaauuccugcccuuuuacaauuuugagcuucuuauuaugaaagagauaguuuacacaucaaaugcuguuuuauuugggaucacauauuuaagaaaaaggcccacuuuucagaaggggaaguggcguuauauuaaucuuaccuguaaucuaccgcuucuggccuuggagggcuggaaccaugguccacagcaggucuucuguaguugauuggcugaaugagaugggcggggugggguugcaggguggggaagucaacgccacacagagaggaggugcccuacaggaacuuaguuuccacauccucagguuaaaggaagguccuugugcagcagcugcagucccagaugugccaacaucuggcucggggugcagguacccuggaauuuucuagcuaaugagauguggacacaugcuguauuucaaggacacuugcuucuguaauaugucaagaagaagauggaaaaguccaucuagagaucuuuuuuuuguuuguuuuuggcacaaugcaucacuaguucacuaccuagcaagugggagaagcuuuagcaacuucagcagcgguuucaccuacucaguggcuucagucacuugcagaaaggaaacguacucuucauuaagcagcaggagcauguuauuuuugucuagaggaggucagucauuauggauucaugcauuuugauggcccguguagucugucaaccugcagagauacacaaaaugcaucuaaagaucgaaagacucuuuaaucacucucuagguguuacucuacauuaaacuuucuggucggcacauucuccuguggcuuuggaauguguugacgcaucgcggucuuugaagaaaacuugcacuguguauuaaaaggcuaagaagguuccuucugauacuuucacaguauuggguuagguuuuaaaagacucaaaaauaaucauuguuuuugucuuccacucagaacaagaacauguacuguuuacagaagucugaacgaugauggucucgauuccacacagcuaaggccacuuuaucucaggagucugaccauggcaggcacaggcaucaaacaagucuccuucucucucuuucucgcucucagcccucaagucuggaugauagaagaggcagccgcccccgguccauggugcgguccuucacgaugccuuccucaucccgcccucugucuguggccucugucucuucccucucaucggacagcaccccuuccagaccaggcuccgacgggugagucaagcucacagcagggcugagcugagcagugagggcuugggggaucuggaaggagccacccagggcucuggguuuauuuucuuacaacugaggauuuuguguucaucaaaauuaucuuugaaacugagacccuccgagacuuucugaccguagugcccaauauuacuuugaggucgugugaguuguugagaaaaacauccucucuuuggguaccacuuugggugagguuuucauccaauuuagaaccuccagugaguguucaguccucuucagcauggcuuagaacaagcuuguccacccgcggcccacgggccacaugcagcccaggauggcuuugaauguggcccaacaccaauccauaaacuccuuaaaacaguaugagauuguuuuugugauuucuucuuuuuuuuuuuuuaauagcucaucagcuauuguuaguguuaguguauuucauguguggcccaagacaauucuucuucuucuaauguggcucagggaagccaaaagauugggcaccccugggaaaaagcaaggugcaguccgggcuggccaagcacuuuguacuuuucaucuccuguucaccuccaggguguugugcccggacaggagcugguguggucugaccaugacacaaccuccacugucccccugugacaccauucugccaagccaacugucacagagucaggcuuucaugauggauggccgggccuucuuuuuuuuuuuucuuuuccucccuuccucauuuuuuuggagagcaaauguuuuguuuauuuuuguuucugcugagguuuauugccuuuuaaagggaaaugguguuuaagugaaugcuucugagaaugaccaucugucccuacuuuuuaggacaacucuggaaaauaaaaggcauauuauccuuuuuaaaaaauuuuguuuuugaggcagacucucacucugccacccaggcuggaaugcaguggugugaucacagcucacugcagccuccacuucccaagcucaagcgaucauaaccauuuguaagugaacaguucgguggcauugcguacguucacaucgcugugcagccaugaccaccauccaccuccagaacucuuuaauauugccaaacugaaacucuguacccauuuaacaacaauuccccacucuuuaccucccauauugauuaaacacuaacuuugcauucuuuccccccaccccugacacccugacaaugucuacuuucuuuuuuuuuuuuuuugagacggagucucccucugucgcccaggcugagugcaguggcacgaucucggcucacugcaaccuccgccucccagguucaaacaauucuuuugccucagccucccaaguagcugggccuacaggcacaugccaccaugccuggccaauucuuuguauauuuaguagagacgggguuucaccauauuagccaggauggucucgaucuccugaccucaugauccgcccgccucggccucccaaaaugcugggauuacaggugugagccaccgcgccuggccaacguccacuuucuaucacuaugauuuugacuauucuaaauacucaugggccaccuucuuuguacaaggccacuuuggagaugcauuuuugcucuugaguacccaauaguuaacauuuauugagcacacacuguggcucuggcauuagcucagguuauugcaaagagaacugcaacauugguauuuuuuuguauuuuugagcggcaagcauguaaaguuuguucuucuacaaaaagaaaaaaauguugcaugcaauuuaaacaacacagaagaaccucuaauuguuuuacugcugauuuguacaguuguuuguguguccaaucccauuuuguuuacaauccaucacccuaucaaacccacaggcaucuggcccccucaacacacagaaacaaacuuccagagagccccaagggacggcucaacucggauugcccuuuguugccaacgacugaugugcccgauggagaauugcaaacuauccccauauuuuuucuuaacaguaauuuuuaucagcgucugauauuuauaaggccaaguccauauggaaauucucaauuuagagguauuuaaaucaugugugcuugucacuuacagcaagauugcuaaagaaauuuaauucaacuucuccccgagaaaauccccggacugguuauggaaagguuuuuauauuucuaggaacauagggguuaggguggaaauuaauggagagguuuuagacagaagaguggugaauugcacaugugagcucaggcugcuggcucuuccccagaaggcauuuguuuaaccuuuaacuggaaggcgucuuuauuacaguccagauuuguguucauucuugggguuaccacccuuugcuagcuaacuaauguggagaaaaugaggcuuuggucucaaauggcacagguuacaugcagaauaaaguucauccuguaggcaguugcuucucguaauaugaaaauuuaaaacuccaccugccuuucucuggguucuuuguauacgcaucaggauuucacaacccgggucuucucccugagcuaaacagcaucuacuaauccuuuucuuaccuacauuaucucaaguucugcuaaaccuagaauaaaaucaugaaauguuugguuguugcuuauaauagauaaaauauuucucaccuaauggauauggauguauuguauauccagugugaaaaguccagaugucccaaaaugccuuaaugaucuaagucaauauugguauauuuuaucaaucaguuuaaauuuuuuaagcauuuuaguauagaaaaaugucaaagcugaguacaguggcucaugccuaaaaucccagcacuuugggaggcugaggcagguggauugcuugagcucuggaguucaagaccagccuaggcaacauaacaaaaccccaucucuacaaaaaaauauaaaaauuagcugggugugguggugcaugccuguagucucagcuaccugggaggcugaggugggaggaucaccugaaccuggagagguuguggcuguagugagccaugauugaaccacugcacuccagccugggcaacagagugagacucuguuucagaaaaaaagaaacauuucagauauguacaaagugggccaaacaguguaaugaggcccccaugccccaucaugcagucuugacaauuaucagcuuuuaacuaaucuuuuuuuuucaaucuguaucaaucauauuuuccagcaaaucucaaauaucauauuuuaucuauagcuauuucacuaugaauuucuaauuuaaacucuuuuuuaaaaccauaacucgguuauauuauauaaacuauaguaauauaguuuauuucacaccaaaaauauugacaggaauuccauauuauaauaauacaugaguguuaauuucccauugucaugucuuuuuuuuuaguuugaggcaaaauccaaauaagguucccaccuuguaccuugcacuugguugauauuaucucuuuaagucucuuuuaguccccuuuucucccuuguaauuuauuugugggaaauccuagguuguguauccugucaugguccccaccaucaggacucugcugauagcgugcccuaucgcauuguuuaauucgcgucucgauucuccauauucccugcauauuggugguugaaucuagcgauuugaucagauucagauuugauuuagggacaagaugacuucauagguacuuguguguucuuccauucagaggcacaucauaaccuguucucucucuuauggagauguuaacagcuauugauaaucagugcuuagauucaauaccauuauuguuuacauagugaccugcagcagauccuacugcacagccauauuagaugagagaagcaaagaauagguggugguccuugcucuggguagucugcaucuucagcagauuuaagcgcaguuuugcaaaugauccuucccuuccugguucaucuuacuccccauuaugggacacacaacauggaaauaaucaacagugagcaaaucaauggggagcaagauugcugcaaugaccaucuuuuuuuuuuuuuuuuuuuuugagacaggaucuggcucugucacccaggcugugcaauggcacagucuuggcucacugcaauuucuaccucccaggcucaagccauccugccaccucagccuccugaguagcugggacuauaggugcacaccaccaugcccagcuaauuuuuguacguuuuaucgagacuggaucuugccauguuggccaggcuggucucgaacuccugagcucaaaugauccaccugccuuagccuccccaagugcuaggauuauaggcaugagccaccaugcccggcccugcaauggccuucuuaaugagaacaguggcuuucuuccaagugucccauucagaaauacauguaaaagaaacuagagcuaggaugaaaauaugacuggcuggcuaaauuaucuucucuugaaaucaugcuccccuugaagaagccaauugcuucuccaggcggucaaggaagucagguuuggaaguugcugugaggcucagagcuccaaagagcaggcuguauuuugaaaauguaagauccuaguaacagcacugccuuccacgugaguuaugcuauaugguuuuucaggcgggcccaugccuucauccauucaaccaucucuccugacuccuccucacagcaggagcugcuagggaugagacuccagucuuagaguuggauccauuucuuccaccuccugauaggacuucuaggaccagaaacaggauggacaugccaaucuuguguuggagugacaaaucacaaucauguguggauaugcuugcacacuaaccuuuugguacaugccuuagacacuagccuaagauucauuuacuccaugguauaaccacgaaugugucuuuacagcaacugugggguaggcagaagggugguggugucuuuauacccuuuuauaagugagacagcugccagagguuacgaggacaucaagagucacccacaguggcagaccuagaaugcaggucuucugucuccagcuuaguugcuggcuggaaaccucagggcaucuccaagcaccugugagcuggcccuggcuugcuucugacugagccaugcaaagugcuuucaccugaaaacaaccgucuaucuguaaucauagagccuuggucaggaucaagguagcagacauuucuuugcauugacgucuauuuuuccccauuaaaaaauagacaaaauauuucuauauaaaucucuaaaagacgaggguuccccuuuugaaauaugcccuaaauaccauccucccaucguaaaugaacaauuccuuaauaucaucaucaaauauccggucagacuucacauuugcccuaucgugcuaaguguucuaucuuuuuccaguuuaucuguguugggauugaaacacaguccuugcaucuggugacuguguaucugaagucacccuuggccucccuuuuaaaucacugcuuucauuguaaaugucuucgauggauugugagugacuuuacacgugucugugggcuggaaagcaauugcucuccuauuaagacgucauugaccuuuccuuuagguuugcccuggagccucuccugccaaagaaaaugcacuccaggucccaggacaagcuggacaaggaugaccuggagaaggagaagaaggacaagaagaaggaaaaaaggaacagcaaacaucaagagauauuugagaaagaauuuaaacccaccgacauuucccugcagcagucugaggcugugauccuuucggaaacgguaacccgacaggguaucuuuccucgcucugcgguagcuucagggaccuaccuuugccccaccuguagccaacagggcugacggugggcucuuauugaacuuguuauaaauuagcaacucagaaaccugggguccuccuccccuaaccucaaaugucccaaggcaguaggacagccagagccacagagagaccuggaggaaggugggcuuagcauuugucccccuuccgcagggccuggggcgaggccgcucugcugcuaggcucugccgcucuguuggacuuguuuccuacacauguccuaauaucccagaagaugagcaggaguccuuuuguugucaggaaacaguccuugguguccgcuaaugccuuccccuugccccuugcugacuggaacucuucuaagcuaguuacggcccaaguguuaaaaucagcggaacuagaauccaaagaccucuucccaccgggccccagaagcuggacccaguccugggguauccugcucugucucaucugcuccaccuuuaaaucuccuggccgucuuucacaaggacuuaacagggacuucacaugacccguacugcugagcugaccuugaagacgggucccagugagucucguucauuccacagucgugggcgugugagggcggugaaacccaggagccggcucucauccuggggcugggccugagggcugauccucccagaagugcaccacauugggaaucuguguucgucuguuuuguguuacugcaaaggaauaacugagccugcgucauuuaugaagagguugauuuggcucaugguucugcaggcuguacgagcacagcacuagcaucugcuuggcuucuggugaggccucaggaggcuuuuauucuuggcugaaggcaggggaggggagcaggcgugucacauggugagaaagagaguauggguggggggugggggguguguuccaggcucuuuuaaauaacuaggucucacaugaacugauagaaugaggacccacucauuacccccauuacugcaaggacagcaccaagcccuucacgagagaucugcucccaggacccagaugccucccacuggccgcacccccaacauuucaacaugagaguuggagaggacagauauccgagcuguaucagagucugagugcgaagaugaggcacagcccacuuccagggcgaacuugauuccaaaagugcuagcuguagugggaaacaaaaauaaagaaggaguucucaugggcugucagcaucaaaggugaagucaggauuggagccgcccucccuggaaaugggugggugucugcuugucucagcccugggcgucggcgggcugugauuagaggguuagacauacugcacugcuuguuuauaacuuaaaacccagaagguacguuuuaucuauacuucaugccacucagaaagcagucacaugcuaccuggcuaucuagagguggaaggcaaacgccccagccaugacuugacguccaacaggccagcgcugcucugcggccuguggguaggugcuguggcugcagcugggcuggagaauucccaugaggguggccgaggaugucagaccaggggggcacuggcuggaggcuggccugaaguacccagacgcucagcguccagcagauugagggguuccugaccacacagcaugcucugucugcuauucuggaaaguugagaugcccaccaccccagaggcuggcugaagucuccaucucuuaagccccagguagauuucucaagucucaaaacauuauagcuggguaggggaaugaacagaagcauuuuugaauauuacuuagugccagacacugugcaagucuuucauacauuuuaauuuaagcuccguuuuaagaugcuaaauuggagggccucggagcaguugugccaaguggcagaauugaucacagcugacuugugugaaaagaaguccaaggacacaagcacacacgugacaggcacagagccagcacagugcaucuucugucccugcccuugguggcccaagcauccuucuaggguccuugcaagcagcagggcuaggggcagccccacgagggcugccuccccacggcuggcccuagcacccucagcaaauccacaggaacucaccaaggucagagcacagaaccuuggcggugcuucucagcaucuggcccagugucagcuugaaccuuccagcaccaggaggcggagaauccgaaccucccacugggggacaggcuuacuauucuugguccagcccagcaaccugucugucuacgcagagggcaccuccuccaggggacgggugccggcaaggucugugaggacagucagacaccugaaguuuccuagcaggcggcugcgugccagugaccagccaugcgcaggaggggaggugcgggggaggagguucacaggaacagaagcagcaacccauucccuggggacaacaccagccacccccccaccacccccacuguaguguccuccuugcccuuccccccugcgggccuccccugcaccccagcuucugcaaagguuuucccuccucaccccuguggcuggguucgguuuccuacuugauuugcaucaucaacaauuuccugaccuuuagcugagccucuccagccagagccuccaggcugugauuugcaucucagcaguccagccuccucagcucucugagucagaaugugcccucccugggaugcagggaggccaggagaagcaccuuaggagaccccaaaucucucuugccagcacauucaccuucagagagcccagcgcuucacccggccuuuccugacuucccacagcaguuuugcugccuggaacaaggccauuucuucagaggaggugcagcuccugggcgcuuggcucccccgacagcacaggacaguucuggaaauagaccuguuggccuggcucugucacucauuuaccagagggccugaaucuuccucccaagccuaguucccauuuccuccuuccagccucaguaaccuccagacuggcccuggcacagcugacuccuccuggggcagacauugaagccuaugugcucuguugcucacccaaaccagcacagcgcauccaccaggcccccagacccagccgcagccccaagcccagagcugcccacucaccugccugcccuuccuugggggagaacguugaccccuccuuuuuggcuggguuaauacguuuucuaauuacuccugcgucagaguauuuuguaacugcuccuguuccccaaagccugaugaucugagaccaaccuguaagaaauauguaaauacaacuuacugauggaacaaacagggaaagggcuuaggugggggaaagucaagugccuccaaaagccagagaugagcaggaaaaaaugcauugaaaaggagagaaaaagaaucccugcccaguaaugaccuaggaugagagaagaagcaaaggaaaggaauagcaaaaauccuucagccaauuccuagacuuucagguacacgccaaggagaccaaagcaugcugagcacagcugggaauaauucugccauggaacaggccauugauuuuguucuugaccgcacggauguugccccguguguccuugcuggcuaucugcaugucuugcaauaauacucagccacuuuugcaucuauauucaggucaccugcgaugugcuguccagcccaggcugugugaggacagcagugccagccccucgugugggggaggucugcuguaaccacaugcugggcggcuccaaccccagaaacucauugucucccaguucuagaggcgucggcagggcugauuccuucagaggcugugagggagagucuacacaugccucucuccuccugucuggggguuugcugccaucucugguguuucuuggcugauagaagcaucacccugaccucugcuuucaucuucacguugugcccucccaaauuuggacacguccauguccagauuucccuuuuucauaaggucaccuguccuguuggaauuggaccuguuacugggaagugugcagguccuugguucuuagucuucuuagaggaaagaauucagccaagagaccaauuaguaaaguagguaaaguaggcuuauuaaggaaauaaaaguagcauggacucugggagaggagcaggcugacccuguggagagcagcccccaggaguucuguguugugguuuuuauauuggacuguuuuaagcucccaccucugucuuaagccucucccuuugucuuugucuguuuucccugcucugucuuaagucuccaccuuuucccugccuaguuccugcccagguuuguggggcucucccuugcugcuaguugaugugcacacguggggcucagugaucaguaggaaccuaccuaauggcggcauugcucauuaccgccaccccaagaaggucauacaguggucaaaucuguacauacuguguguguguaucucuuaggcauucaucccuugcccuguuucccuccugaucagcauguagcuaguuacauugucacacguuagcuacagagggagcaauuacugggugucuuaugggguguuucaggaugcugccuccugccuagguauucuccuccccucugcucacaccuagcauguguguuuuggggggucucuggggcauaagguuuuccagaguuuccucccccggucccccauuccuuuucaugucuuacuaucugcccacucuaacaggcccacccuaagagccacaccuuagcuugaucauuugcaaagacccuauuuccaguuaaggucauauucuaagguaaugggggucaggacuucaacauaggaauuuagguggaaacgcaacucagcccauaacagaccguaacugugcucuuucuguccuuuugauguagauaaguccccugcggccccagagaccgaagagccaggugaugaacgucauuggaagcgaaaggcgcuucucggugucccccucgucaccguccucccagcaaacacccccuccaguuacaccaagggccaagcucagcuucagcaugcagucgaguaaguggaacgcuccccacauacgaaucgugcuauagcuccgugacuuccccucacugaaggcucugagguuagaagcgcuuccucccuccccuugcagcagagggugggaguuuagauaaacaccuggcucccugggaguguccccugggacaggcuguagagucuggacuuccgcaaaucaggccaaaauccagagcccaggucuccagcacuggaggggcagaaagugcagggucugucccaggguccauguggaggggaccugugaagcacguggaaccaccacacuuucuaucccaggacgcagagcugcaggaggccgugggccugcuugugucuaggacugugcacuggagaagcaccuucaggcaguuggcaacagcuaaggggcacagcuuauuuuucuaguuuugaccaauguuuaaauuacccuagaaguucccacaaaacugguggcuccaaacagcagaaauuuguucucugaagguuuuggaggccaaaacucugaaaucaaggagguagcaaguugguucccucugguggcuccaagggagagccugucccgggccucccuccagcuucugguggcucccagcagucccuagcccuccuuggcuuguggccacaucacuccccucucugccccugucuccacguggccuccuucucgguguccucucuucuuacaaggacaucagucauuggauauaggguccacugcaaauccaggaugaucucaccuugagauccuucacuaauuacaucugcaaagacccuacauccaaauaagguacauucugagguucuggguggcccuaagaggucuacauuuuggagagacucuacucaacuuacucuaaguggcagacagcuuuucaccacuagauucagagccagcagagaggagaaaucuuggcagggagaaggugcugaggauggggacggcagcagaaccggggagcccacucuccuuccuguggcacagagaggggucccaggcaggagagcucugugcccuguggcgagggcugugcaaggcagugagugauuguccucugcuccugauuuuccucuugcugaaaggggagcagucaugauucuggagacugucaguggguggggaggcuggcugcaggaguggaugcgugagucuaauugaguaggcaaagagcuuucugggcacuggauaugucuuuggagggugcaucuucacauccuugcacuauuacuacaugaucuuucuaaaaauguguuuaaaaucuauuuuaauauugaaaacagacaccaucacugcugcugcggaaaacaauuuagugguuccuccaaaguucaauguagaauaaaccuauaauaucaacuggcaguccugcuucuaggccuguacuccaaagaauugaagacagggacucaaacagauacuuaauauucauagcaguauuuuucaagagccaguaagcaaacacaggccaaauguccaucaacugauggccagauuaacaaaauguacguccaaagaaauguccgugcaauggaauauuacccagccguagaaaggagugaaguucugacacgugcuacagcacggacgaaccucagaaccaugaugcugagugaaauagaucagucacaaagggacaaauauuauaugacuccaccuaaaucaaauaucuaaggcaaguucauagagacagaaaggcauggcucacgccugucaucccagcacuuugggaguucgagguggguggaucagcugaggucaggaguucgagaccagccagucaacaugguaaaaccccgucucuacuaaaaauacaauaauuagcugggugugguggugcgugccuauaaucucagcuacucagaaggcugaggcaggagaaucacuugaaccugggaggcggagguugcagugagcugagaucgcaccacugcacuccagccugggcgacacagcgagacuccaucccaaacaaaaagaaaagaaaaaaaaaaagaaaguagaauagaggauacuaggggcgggagagaggaguggagaguuacuguuuaauggguacagaauuccguuuggggugauggaaauguuucagaaauacaucauggugaugguuaucccccacggucgaugugauuaaugccaccaaauuguccccuaaaggauggcuaaaauggcaaauuuuaugucguguauaucuuaccacaauaauagcaaagaaguaggcagcaaucaugaggacagucacucaccgaagccuucguauuucccucagccccauggcagagcuuccuuauaagcuuacaguguggccuuccuagcaugcauuuuccuaauaaaggauuuuucaucagaugaauccuaggggaaaacuccaaaagagacucaucaguaaaaauguccauuuuucucucuuuaauauaaaagaaaacaaauuaucuuuaagagucucaacaagguuugagaaaauauccugccuuaaugauuauuccuccguuugaaaacggcuauuuuuuccaguuuacuuuaaaaaucaauuguacuuccccuuggcuuauuuaaagcaacagccacagugacugcuauggcuaaugacuucaugucauacgacuguggauuuuccuguggaaagagaugggaagcuggguggcuggucggcguguuagacuuugcuuagugaaucucuccaggugauaacugcaggggugacugcaggggccuggcuuggcuucgaaagcaguagcagcagcagcggagacgguccuguggcacccagcuguuuaacuuccaccgaggcagggggcccgagcagggacagaagaggccggggugaacaucacccuuucuacaguggcucgaugccuugcuucacacuccaguuuuaguguucgugugauacuugcuauucucuuucuagaacauugccguuaggagagggucccacccuuuguguucgcucccucccugcccucaucugcucuguugacaaacguuuucugccagaugaaguguuucugcugugccugccucucugggagggaacguggagcagcucccugagcauucaggcuccguggggaagucgggcugauuuuaaauagaucccgguuuuccaggcuuggagcugaacggcaugacgggggcggacguggccgaugucccacccccucugccucucaaaggcagcguggcagauuacgggaauuugauggaaaaccaggacuugcugggcucgccaacaccuccaccucccccuccacaccagaggguaagucggcaaucugaaacacaggcuuucauugcuucgccuccacaaaguaggacgagucccucauuccagauacuagcagguuuacuucgggcuagugagcacaugaggaaaaccauguaugaugggcccggguuugauuuugcaaaaagauaucgaagcaguaaggacuccaguggguaagaucuguggcucugcgucauuaucaauaacugcaucaaaaagcacauuuugauaucaugccucagaacgaggaagaggauagacauuccaagguugucaucgguuaucaucaccauggagaucauuccacuggagaugcaauucuaaugacauuuugauuuuugagaaguagcuuuucuaucaagaggucugacuuuuuaaagagguuggccaauaucgcccuguauggcaggcaccuguuguacaccugcuuggcccuggagaagcuugucuccaaacaucccuccaggcagccucaccuggugcugggagcuccuggguggugacaggcacucaccuuacggagacugcagaggacagccagguuuggcuccugggcacagucauccucacugugcccccaccccugggcacccuccccagugcuaguucgggggugcugaccuggcuuccuccagcagcacuggccuuuguaagccuaagcaaccugcuggaaccccucuucagcgugagucccugaagcugguaccccccagcagcuguuuuagucauucaugccacccaaagugccuugugccaaacagccccugggccugccugcccguacaaauauuagucaaagucaugaaaagccauuuaaacaagcaccucaguuaccaguugacaguucuagaaacauucuuuugagauccaccccguuccucuccugguucucaaggaugcugucaggcgucacucaucccugcgggucccagccccauccucaugucgggcccaggcauguguggagggcagcaugagugggauggaggcgggcgagcgauugacucagccacggcgggaacuucugcuucuaggcucaggccuccccaggccauguuauucacagccuuugacaauuaaaucaguggugucugaaggguaaaauaucccucuucauauguggacagcuggccguauuuuuuuugcuauccagccuuagugaaguaauuauauggccgcaaaacuccuguagaacauugaaaacaugagauuguuggguggcucuguuuuuuucauaauggugagacaugguuuuuuuuuuuauuuuucuuuaauaaacaauauaaaucccacgugccauuucuuuuucuuuuuuuuuaauggagacucguugacggaguguuccacaaggucauuacaucccuuaugagaggaguggaagagagaggguguuuguguacagcauacguauuucaucauucccuuuguaucagaaaacuaaacaagcagucaucuuuaauaucaaagaggcagauugcucuucugagacccaagugccauuuaaacaggcucccucucccuagagacgccucgauggggaaccgguccuggaggaggcaccagguuccccugugaagagggcuuucuggcaggcuggaaugguuuguugcaccacagaaauggaagccggaccuuccccggccauuucuaacuacuugugagaguaaaaggagauucgggggggucuaacaagaauauuggguugcuuggaguauuguuucccuaacagcuucguuaauuggucacauucucuucucucuauuuuauugcaaaggcaggaauguucccccuagucucccuacacuaguaaacugaaaauucuaaacuuagaauuacagccaauuccucuucuuguuacaaaucaacuccgggguaacauuuuauugucucaauuucuuggauacaccauuguggguuacugaugccacauacaguugauuaaguaagggauaacauggauuagcucucucucaauugauaaagggcgugugaauucaauuagauuaaugacccaggugucuuuggucuuuguuucuuguuuaauuuacuugcagccugagugcaugcucaggugacacgcuggugguuaguaugucaucauuaggcagaagcgguugcauuuccuggggugccucccuuugcacaggcccugagagcuguucuaggauaaugaucauccaucugccaugaugggggugugaucaauauccuccugucacucucauugaucagccucaggcuuguaggcaacucugucuuuaguuguugccacuaagcugucauuucuuuccaaauggcucuuccugucaguaaucugagcuuacugaguuuaucaccauuaaucauuuugcuuaauggugauaaacuuuugacaugcucauacuuggcauagaggucauuugcagcgcuguguugguaucaggcuguguuagugugguccuuaccugcuccucauuggccuaucagugaguguggcuuucacauguaaacaaacaguuucaucagaccucaaaauagaugucucuuuuaacgguucuaaccaaccuuaaaaagacuuaauuguuguuuuaccuuccuuaauauaaggucauacacucauaggacaucuuuauaucagcuuuacuuuuccacauuuauucuccucucuguguuaagcauuaggucauuuuuguauuuacuagucugugaaucaggaggaaaucugggcgaugagugagagacuacugcgucacugucuauccuugaaaaccucuuuucucacauucagcuaaaugcaaacccacacugagaggcugauaaaaauccacucuuacccuuaaguuagacgauaguguucugugauuucauucugguucuucugccuguggcaugcucccacuuacccuggucuguucacuucuucauucauuuguuuacuuaccuguucauuucuucauuuauccacugacucguuuauucacucauucauuuauucacucauucauccauuuuucuauucgauugacccauauuucuagagagucuccugcacaucaggugugugugaugggcaugagggucccaaaagcaauagggugcagcugcccucagucauaacacuccagccagguccaucagcaagggguuugcuauuaucuucacauuggaaauuaauguucuuuuuuggaaucuaaaguaauauaugcccaugagcugaagccagccagccagccaccuguuucugugaauaguuuucuuggaacacagccacaccccuuucuguacacacugucaaugaccgcuuuucggccacaccaguggcauugaguggcugcaacagagaccguguggccugccaaaaagcuggaaauauguacugucuagcccuuuccaggagaagcuugcuaaccuuugcccgaagcucagaaagcaaaagaaggucucucaucucaccccuggagagugccucuaaggacuuauuuaucccuuagacaauagauggauaacuuggucgauagcaucuagauuuaaaaaggccacgcaaagggcaaugguaccucucaggggcugugcagacggugggagagugcucagaggcgucagaaaggcccaggcccauagcagcccagucuugagccuaguagaccugccagccccaagucggacaggauggagcccaacucauguggggaggaugguuccggcugaguggcugugccaggucagaccccaccuggagacggugucuuuucugucaggacaucaguuaugugacaucuuccccauccucauguuuuuuagcaucugccaccuccacugcccagcaaaacuccgccuccucccccuccaaagacaacucgcaagcaggcaucgguggacuccgggaucgugcagugacgucgcaagccucucuggaaagagugugcugccccuccccaucuccaugcccucuccuucuguguccccugagucugcuguuuaccucauugggccugugauguuaacauuucgugcgacugcuuuuucuucaaaggaguucaguucucaccauggagugaguggccuuuagcgucauggagcaaggugggucugggagguagauauggguccgggaugugcuaucguaguuaucagaguugggggccucugagugugucuggcucugagagagucugagucuugcccaaacauucuuucuuuuugugccaaaugacuugcauuugcaaagagcucaauugcucugagcucagccaaguaggagaggcuaggccaucacucuuaggaagcuguguagugaugauguauaagaauccuccucacugucaugggauguuguauccagccccuccuuguuccagccgguggugugacuucguugguugaggugugucuccaaccuacaucagaccaugaaguucaaccccuccagggaagcuccugauuuccccugcauaauugaaaauaggauauuucucagcuauugaacaguuacuaauuuaugggguggaaacagcauuaagaauacugaaucaaauggaaaaacaaaugaauacaggaagauaaguguucguucuuuucugaaaaagaguauguguaccacaagagcugguuuuaauugggugaauuguuuuuguccucauucuguacagaaauuuguauauaugaugguucuuagaacuuguuuuaauuuuugugguccuuccguuuauuauaauaggcguccaccaaugauuauccauauguguucuuaauuuuuaacugcuggaaguguuaaaacacacacacacacacacacacauuuuuuuuuugagaacuccaaaguccugaaaauuuugguggacaaugauuuuuaaaaaacuaacuuuguauaaccuaauauuuguauucucucaucuauauuuuuuuauucacuauaaucaugauacucuucuaauagacuuaaaaguuaaucauugacaacgaaaaauaaaauguuauuuuaaaagacu

SEQ ID NO: 15447 - RNA, 4504 nt, Homo sapiens
uagggagccugcagaggagggagagaggaugaggacagucuggacaccauggggauggggacugaugggagaggcuuaauccgagaagggccugcaggagccggaaccccaaagaaggaauccccgcaggagaugaaucauaccuucugucugcagcucccaaaagcagaggaaggaccagggcuaagagccauguggagcaaacuugggcucagcaaaagggagacuuucuuagggacaugauggcauauugagcagagaagucaacuugcucagcaauugccaacaccuagauucuuccucauauucaucccaccccaaauccguccuuggaggcagugggaggagaaaugguauugaagcaccauugugugccgguccccaugcuggagacgcagcaucccuaaccucaugagucuuguagucuagucuagagcagggcucagcgacagcccccagcucaaauugggccugccaccucguugaguaauaacuuucuuggcacacagccaggcucauuuauuuacguauggucccgggcagccuccaggcugcacuggcagaguugaaucguugcaagagaaacccugagacccaaaaagcugaaaauacauucaggaaaaguuugccaauccaugcucuagaugagaaaaugggcugcaucuaguguacagcugccacaccagcucuuagagauguugugaugauuaaaggguaauucaugcagaguacuuagugcaacucuugccacaucgugucugggaagucacagcuguuaaugaugaggagggggacgguauguggaacgccauaggagcacgagaauagcagcuaugggggcaggagggaaggcguccuggaagaagugaugucugcgaugacuaucugaaggaucaguguuagccagguggauuacaguuccacacaauuacaauuacauggaaauagcucauguaggagucagagugaggaggcauggugcguuggaggccauuucagcauggcuggagugagcacaggggagaaagugccggcagggacgucagggauguagaaggcacaugagggguuucuccagugggaauucaacacagguuuacugggcacugacacaaucaggcuugaauucuagaaagacuuguccugacugcaguguggagagucauugaagggcacagaggcaggggagggaggaagaccaggugauguccugcuggaagauaacaguggucuagacaaggauuguggccgugaggauggagagcccaagaacagagguuggaagcuugaauggggugaauccugguggugagggagagagaaacgucaaggaagggucacagugcccuggcuggggcaacuggguggugaggggccagucacuaaacucagaaacagggaugaacagggaguggacaagggggaaggugggcaagagcaggcagagacacagggggaucaucacacuggccacagaagcagagggcacaccugucagggaacccaggggaggguagcaaaggcaccaauggcacuggccugggcagggaugaaggggcaaccagggacaaugaagcugcuggaaaaugggggcaggaggccagcacauccuccaggccugaaggugaagggagcauccguuacugagucagagggagcagcugugcagaaggggacacaaagucaauccccagccccacagggagggagagagcccccaacucugccugggcucuccaagucuccuguggaagcccaagggugaggggcccauggugcaguccacaagggucacugcccgggcacggagcaggguggagaugggggagagccaggcagagagcagccagcacagacacggggacacugagggcccaggggacauccucgugucaccuuaccugggugguugaauauacgcgccuuaaacucaggagaaaugucugggucagacacggaguaagaggagccaucagccgagaugugggacaagcacaggcaaauuccacgaagguacuaggagaagcuaucggugaggugcgagggaagaugaggucccucaaagggaaggugaaccgcauggagugcugggcagaggugaaaccaaggaccaaauauugcccauggauauaauuaaagaugugccaucagugagcucagcauagggaucuuacuggaugagggagggaaaagcccaucugcacucagcugaagcgaaggcaucaggugugguuggucgugaagggguagacguggcagaacugagggacaaugggggcucucccugcgugcuggaggguguggccccaguggugaauacagagucaagaacaaggcuccugcuucccuggagggcugagcagagcagagacguagccccauagaaguucuugcuucccuggucuaaugagcuccacacucuauggguuuagaucugaauaaaccaccaaaaccuucaguaaaggagaguggaacgucucaucuguccaaucccuuguuuccaugcuguggguacuggggguaacaagcaaugucccuucaugggguacagagaguggaagggaaggaggauguagugggcacagcuuugcagaaaaugggagaacacugacuauguaaacacacaagauuuuccaggcuacauagaaaacccagagaugccuuccacuuauagguguuaugaccuugagaaaauuccucagccccuucaggucuugcccuaacuccguucauuaacugaaggucguaccuccagcuccaagugugagggugacaaucagguggggugaugauuaccaacuuccgggaaggaacugaugucuaguaguggcacaauacauguucauugcuucuccaaacuccaugugugcuucugaaaauacuugucuugccucuuccaucaacaaagaagccuuaaaagcuguaaacccaaaagaaauaacuuguucaccaagauagagaaagguugagaauaguucacccuucuucuaagacaauacauaaccaaaugucucuuuuggagggacaguuuaaucuauaaucuuucugacaauagaaaucuuuaaugauguagaacaaaaacaacgaaaaaagaagaaugcuuuaacacacagccuuucagcuggcauuuaaaauacaaauggaauacaucuuuuugucaggcuauuccauccuuguuuccauguuuguuuuaauuaguucaagcucaagcuaccuaaauuaucagaggaaagaauuaaaacaaacuugcuaaaaaaaaaauacuuagcuaccaggaaacaguugaagagggcacgcuauuuuuucauuaucucuuaacuguucuggucugacaagaauuacuuuauugucaacagauuuguuacaaauuuaugaaccauuuuaaccucuuucuguugcacugggaacauuuucuggugaaggaguuugaagaaauuguucaaaguagccucuuauggggaaguuccuccauuuucccuggagagcuucugggagaaugaugcacuccaccgaacuuaucaagaacagccgcucaugucuguggaugggagcauaauauuuaggacauuuagaagucaucuucauauaauaggacagagcacugugagauuguucgugccuauugaccuaugaaagugaaagaaaugauaaaaccacauuaaaaaaaagauaggaaauaaaguuccuuuuagggaaacauuuuuaaaacacuuaacuuuccaucauugaucaaaacacuccaaaauuauuguuaguugaucuacuuuuuuuaaucaaaacucaccucugacauucuguagagggcauagcuguguccauuauaaacugcuagaagaaaaaauaugaguguccagccgccuguugauuacauuguauucuuuggacaguaaucuuugucagagagagaggauuauaugucucaacaucacuuuaauugcacaaggaaguaaacggaaacauuuucuuucaccuauaaaugucauuaucucacacgugagccugggauaggaacaugagaauaugaucauuccgccaaaguguuagccacuucucuuuugcagaaagaaagcucucaggucaggguucaagcaauaauuagacacuuucuguauacauuaccuccaauugugccuuuccguccaugacagagaugacccaaugagcauucagggaaguggcaggaugacaacagccuugcuuugauccauggaccauguguaaauugaaacaaacaaaaagaaacucugcauguuaaaagcccuugaaaaugccugaguagcaucaagaagaaaauguuacaaccuaagccccugaauauaaauguauaaaaagaauuguccucuuacaacauugaagaaaaugguaaauauucuuucuuagaaaauaucuugcccaugggaacuggggguauauggaaacucucuguaccuuuugcccaauuuugcugugaaucuaaaauugcuuuaaaaauaaaagcuauuuuaaaaaaugaaaauaacuugca

SEQ ID NO: 15448 - RNA, 1812 nt, Homo sapiens
ccuccugcuaccaguuacacuugcugcuggguccaggaucugcuuuggagacuccuuaaacgcuuugaugcucuuacuaucuccuguuggcucuguguguguuugcguagucuccccugauguccgugugagcuugcugacugcuaggggcucuucuuucauguccacuuucaccagggguaucuugagccuuugcuuggagcuucuugagguuuugaaugacucuggcuguggagauuuacaggauacuucugugauuuugucaucagucauugauuccucagugugaccuggugucuggaagaguucuuugaagccaaccagguccucuagagccucagccuuuuccuuaggagucuguggcugucucuugcugccagguaaauuuccuagcagguccaguuucugcacuggaguuuccacaaauguguugauauuuuucucaucacuuacugcugguuuugguguguccauggcuuugccugcugaugguguucguuuccugagugcuaaaaauucuuccucuacgucugcuuuccugagguuucucuugggccguugcuuugugcuugcugggguguccacugggucugguuguggagauuugcaggcuauuuugguaguuuucucaucagucgugggcuugucagugccuggugucuggaagagcucuuugaagccagccaggucuucuagagccugggccuuuuccuuaggaguuuguggccaucuuuugcugccagguaaauuuccuggcagguccaauuucugcacuggaguucccauaaaugcuuucaugucuuucucaucaccuccugcugguuuggguguguccauagcuuucccuacugaugguguucguuuccugagugcuaaggauucuuccucuacgucugcuuuccugagacuucucuuggacuguggcuugaagauuguugggguacccacugggucugguuguggagaucugcaggcuauuuugguaguuuucucaugagucgugggcuugucagugcauauuggugucuggaagagcucuuucaagccagccaagucuucuagggguugggcuuuucccuuaggaguucuuggcugccucuugcuaccaguuacacuugcugcuggguccaguuucuguuuugcaguuucccugaacacguugaugccuuuauccucaucuccugguacuuugucuguguguguggucugugugagcugcuucagggcugagagcucuuccacuauaucccuuuuccccaaagguguuuugggccgccuccuugugcuuguuggaguguccauugauucuggugguggagauuugcaggcuauuuugguaguuuugucaucaguuguugauuccucaguguggucuggugucuggaagagcucuuugaagccggccaggucuucuagugauugggccucuuccuuagguguucuuggccaccucuccaucccaguuccauaguuugcuggguccagcaucugcuuugcagauuccuuaaacgcuuugaugcucuuuccaucuccugcugucucucugugugucuguguggucuucccugacgucugugugagcuugccgacugguaggaccucuucuuucacaccuacuuuccccaaggauaucuugagucguugcuuggagcuuguugggguuuugacugggucugguuguggagauuugcaggauacuucugugauuuugucaucggucauugauuccucagugugaccuggugucuggaagagcucuuugaagccagccagaucuucuagagccuuggccuuuucuuuaggaguuugugg

SEQ ID NO: 15449 - RNA, 7627 nt, Homo sapiens
ggaagauuuuccgucgccgccggggcgacucggagucagaggaagaugagcaggacucagaggagguucggugcguuuggggcggggcucccauaggcuugguaaagauagacuuguuugggggacucaccaccggcucggcgcuucgcugacauuguuaacugugagcucggguggugguuccuucugcggacgcagaaauugaggcucaaggggugaggccaccgccccaagcucgaacgguugagagagaugccuccgggaugcgcaguggcucugacucccggugggucuaggcacaaggucguccucuggaccacugugcugguggcucaguagcugggcugggaugcccucgaaggugccuuauuggcucuguuagcuuuggauuccgcggggaaucacucagcuuaugcauugcugcuucuucuucuuuuuaaagauuaaaacuggaagagaccagagagguacagaacuugaggaagaggcccaacggggugagguggguaccacgcggggaggaggaggaggcggcggggacgacagacacauccgcguccgggucgcugucacaaauaucuccucagacguagauuuuucucuugacacacuguacaccuuccacugcccaacuuggagaacagcguucuuugcaaauguuuaaccaggacaugcccugagcugugucgucucggggugugcuccagagauacagaaacagaucacuaacucgcguuuuuuauuaaaaccaauuaauugugaaaugcauaucgaucguuaagaguuuguauaauuuagaaaaguauagucaagacgauaaaaagcacccauaauucucccauccggaaaugaucaguguuaacauuuuuuuuccuugcagagccacccaagaaugcacugguauuaauauugaauacucuuuccaaucuguuuuuuuucgucucucucucucagauugugaacaacuuucuauguacuuuuauucccuguucuuuucaacucauuaugacauugugggcauucacccauauuguggaauauuuuucagaaagccuuaauggcugcauaauauuccaccagauguguguauuguaauuuguuaacaaauccccuauuuugggacauguaggugauuuuguaaauuuuuacuaucaaauaaggcugcaguggauauucucuuaaauuuaucuuuagcugcacuuuccaugaugagaauaucuuagaaaugagauuuccaggccaagauaaugccaaauggcuuuacaggaaaguggcaaaguguaccacuucaccaccagcgcacccuucuuccagcaucugcggugcucguugagcccugucuuaugcuuauaggcuuuuccagccggcuugccuacccaccccucaaaucccacccuugcacuaauguugcaauccgcauaccugagaggguuccuccuuaucucugaauuaugccauuucucucucucccccucucuuuuuuuuuugguuuugcucagugcuguggccuugcuggugggagagaagguacaagaggagaccacucuagugguaaguuauggggucuucccugaguaguuauggcagcccucccugcagugcucuucagugagugagcgugcuucacaaaaaaaaaaauuccacuaccauguauuuagaugcuuccucuuaacuguguuugcuuucugcaggaugaucccuuucagaugaagacaggugguaugguggauaugaagaaacugaaggaaaggggcaaagauaaguaaguucaggacaagcuuagaugcaaauucaccuuuagcggcugccugggucuagguucccucagagagcuggggccuguagcagcagcauuaguaggacaucuugaagcagguuuugugcuuugcaaaggguguguuauuuaaaaacaaagaaagcaaaaagucuuuaaaaguuaacuuagagccaaguugguagacuccuuuuguaagaguguauuguaggcgugaugacucaugccuauaaucccaacacuuugggaggcugagguuagcuugaguccaggaguuuaagaccagccugggcaacauagugagaccccugucucuacaaaaaaaaaaaaaaguguguauguauacacacacacacacacacacacauauguacacacauauacacauauguauauacacacauguauauacacauauacacacacacacacacacauauauauauauacacacacgcauauauauauguguguguauauaucugggugugguggcaugugccuguagucccagcuauucaggaaauuaaagugggagaaucacuugagucagggagguugaggcuagagugagccgcgaucacaccacugcacuccagccugggugacagagaaagacccugucucaaaaaaauaaaauaagugaaccuauggggaaguuucauauaaaaacaauuaacaaaaauaauaaauucaggccagcugcgguggcucaugccuguaaugccagcacuucaggaggcugaggcaggcggauuaccugaggucaggaguucgagaccagccugaccaacauggugaaacacugucgcuauuaaaaauacaaaaguuagccgggcauuguggugggcacccguaaucccagcuacucaggagggugaggcaggagaauugcuugaacucgggaggcagagguugcagugagcugagauugcgccacugcacuucagccugggugacagagugagacuccgucucaauaaauuaauaaaucaaacauucaaauaauucaaaaauuaaaaaaauaaaaguuuacuguguacuuuugugacaacuauauagcauuuacauuguauuugguauuauaaguaaucuagagaugauuuaaagcagaugguaguguguguguagguuagaugcagauauuauacuauuuuauguaagggacuucacuaucugcagauuuugguauccuugagggacacuagaaccaaucccccauggauaccuaaggauaaguguauccacucaauccuuggagguaucacuagcagccaacaguuugcuugcauauauuucuagaguuucuuuucuuuacauauacuacggcauuuuuuuuuuuuugccaacuguaaauaggauauuauaaaugcuuaugucuuuguuuucuucuuagaacauaaaacucagccucauugaguugugacuugaaagcucugccucauuguucucucccuccaggaucagugaggaggaggaccugcaccuggggacaucguuuucugcagaaaccaaccgaagggaugaggaugcagacauguaagugucagucuguuuggcugugagcaguuggggcuggacuccagucagaguccaagauauuuagucaacagaugacauuucuagaauuuucuagaagaugucaaaguuggccccucucuuucuacuucccagcuuaagaacuuugaaaaccucuuaaaaggucuuuucaggccgggcacgguagcucucaccuguagucccagcacuuugggaggccgaggcagguggaucaucugagguggggaguucgagaccagacugaccaacauggagaaaccccgucccuacugaaaauacaaaauuagcugggugugguagugggcaccuguaaucccagcuacucgggaggcugaggcaggagaauugcuugaaccugggaggcagagcuugcggcgagccaagaucucgccauugcacuccagccugggcaacaagagugaaacuccgucuccaaaauauaaaaaauaaaaacuuguuuucaaaggugguuucaugacuaguaauauuuccccaaaacauugcagggauaaaacaugggcuugcccacuuuuuauuuugccaacaaagcuauuggcaaacuaucaucuuucugucuucaaagaaccuuguacaucauaacaccaauagauuagugggacauaaccucauagguuggugcuucuuuagaaaauuucuaacuugaugaaaaaacucaaguuauuuuuuuucucguuucuccauggacugucacuggucugcgggccaguguuggggaccacugauuuagaggacaccugguguguguuucccaccccucccugaggccucuggguuucucacuucaggaugaaguacauugagacagagcuaaagaagaggaaagggaucguggaacaugaggaacagaaaguuaagccaaagaaugcagaggacugucuuuaugaacuuccagaaaacauccguguuuccucagcaaagaagaccgaggagaugcuuuccaaccagaugcugaguggcauuccugagguggaccugggcaucgaguauguuugagaccccuaggcagaagacacagugcuuuccaguuaaaaguuaugggggacaggccaggcacgguggcucaugccuguaauccuagcacuuugggaggcugaggcggguggaucacgaggucaggaguucaagaccagcccggccaagauggucgaaccccgucucuacuaaaaauacaaaaauuagcugggcaugguggcaggcaccuguaguccagcuacuugggaggcugaggcaggaaauugcuugaacccugaagguggagguugcagugaggcgagaucaugccacugcacuccagucuggcgacagagcaagacuccaucucaaaaaaaaaggaaaaaaaaauuuaugggggacagguaugguggcugaugccuauaagccuauaaucccaguacuugggaggccaaggcaggaggaucacgugaggccaggagaucagccugagaaauauagucagacuccugucucucaaaaaaauuuaaaaaauuagcugggcugucacuugagcucaggaguugaggcuacagugagccaugauugcaccacugcacaccagucugggugacagaguaagacccuuuaaaaaaaaaaaaaaaaggccagacauggugacuugugccuguuauccuagcucuuugggaggccaaggugggaggaucacuugagcccaggaguucaagaccagccugggcaauguaaugagaccccauguucuuaucuguguccuuagaauccuacaaauacaaaugagauugucccuggcagguuguugcuagaaguuucgcugaaggcuugaucagaguaguaagggccccugacugcuggaagcaaaagugguucuuuagcguguuacagcuguucagcuguaucaggcccuuuauucuucuguuuucuucuagcaggagccauguuaaaggcucacucaccccuucuccccaugauccuucuuaaaauauccacuuuaaaagggaauuguuauggaagagguacaauuguuagaauaaucuucugguacaguagaaagcugggaggcuucugggcucuuuucuggccuuuacaaacuuugagccuuaagcauuuuacuucucugaagcucaauuugcucuugaucagaagagcagaguaacugugguucuccgacagccgugagagucccgugagaaugugacuacaagugugcuugauaaaguggagagcugugccccaggacacaugauuuucuuauguacugcugggcugccagccucaccacucaugucugaguaguaaggugcuaucaucuucuaaguggugugguuucuuucucuccauagugcuaaaauaaaaaauaucauuuccacggaggaugccaaggcccgucugcuggcagagcagcagaacaagaagaaagacagcgagaccuccuucgugccuaccaacauggcugugaauuaugugcagcacaacagauguaagccccucggagagcagucuugcccccauuccccuauuugggcugagaucccuaggaaccucauguucuaacguguccccuggucucuuuggguccaguuuaucaugaggagcucaacgcgcccauacggagaaacaaagaagagcccaaggcccggcccuugagaguaggugacacggagaagccagagccugagcgugagugcaacaaaggccucggggcugccuggagugcucagcaaugugggaacccauggaggcaggaugcagcgggggacaggguggagccuggcauuggagccggggcauauggguuccaguccaugcucuggaccaugacuaugugccuuccccuuucuaagccucaguuuccucauuggaauccuaauagaaccuaccuguuaggauuacucugagaauucauacucucucauauucucacgcacaguagagacucaagaaguuagaaaauuucaguaaggacaaauaaaagcuacucauaagguuagcugggugcagugccucacacuuguagucucagcugcuggggaagcugggacaggaggauugcuugagacuaagaguucaaggcugcagugagcuaugauuggaccacugcacucuagccugcgugacagagugagaccacaucuuuuuuuuaaagaaaagaaaaagguauuggccaugcucgguggcccaugccuguaaucccagcacuuugggaggcagaggcaggcagaucaccuaaggucaggaguucaagacgagccuggccaacauggugaaccccgucucuacuaaaaauacaaaaauuagccaggugagguggcaggugccuguaaucccagcuacucaggaggcugaggcaggagaaucacuugaacucgggaguuggagguugcagugagcugagaucaugccauuacacucuagccugggcaacagggugagacuccaucucaaaaaaaagaaaagaaaagaaaaaaaaaaagacaaauacguaucuacugaggcccuacuguguucacuggguuaggcgcuggggcuccuguggggaaggaaacaggcaguugucuuugccugcauggaguaaagucuagcaguggguuccagcauggcaaaccaccuuuccuguucuuuuccuucucaggguccccuccuaaccgcaagcguccugcuaacgagaaggcaacugaugacuaucauuaugagaaguucaagaaaaugaauaggcgguacugaguugugcagagugggauguaaauaucgccuuccucucccuauaucccucccaugaaaaauggcuuccuggccgggcgugguggcuccugccuguaaucccagcacuuugggaggccgaggugggcggaucaccugaggucgggaguuugagaccagccugaccaacauggagaaacccagucucuacugaaaauacagaaaaguuagccaggcgugguggcacaugccuguaaucccagcugcucaggaggcugaggcaggagaauugcuugaacccaagaggcggagguuguggugagccgagauugcaccuuuguacuccagccugggcaacgagcaaaaaacucugucucaaaaaaaaaaaaaaaaaaaaaaaagaaaaagaaaaauggcuuccaggacagagcaugcucauuugcuggcggacaguuccagaaacagacccuguuaguccuucuacuuaccugcuggauuuuucaagcacuaaauuuauaacuuuuugaaacaaaauaauguguaauuuuccauuugggggcaaacucuauucuugugagcauuauuaaaucuuguuuguaaaua

SEQ ID NO: 15450 - RNA, 302351 nt, Homo sapiens
cgcccccgcgcgccccggccccgcccccgcgcgcucucuugcuuuucucagguccucggcuccgccccgcucuagaccccgccccacgccgccauccccgugccccucggccccgcccccgcgccccggauaugcugggacagcccgcgccccuagaacgcuuugcgucccgacgcccgcagguccucgcggugcgcaccguuugcgacuuggugagugucugggucgccucgcucccggaagagugcggagcucucccucgggacgguggcagccucgagugguccugcaggcgcccucacuucgccgucggguguggggccgcccugacccccacccaucccgggcgagcuccaggugcgccccaagugccucccagguguugcccagccuuuccccgggccugggguuccuggacuaggcugcgcugcagugacuguggacuggcguguggcgggggucguggcagccccugccuuaccucuaggugccagccccaggcccgggccccggguucuuccuacccuuccaugcugccagcuuucccuccgccagcugcuccaggaagcuuccagaagccccugcgcgggccuuggcuugcagcaacccuuuagcauacuuaggcagagucccauauuuccuuccugcuggaggccaaguucuaggggccuucugguuacuauggcugguguuuguguacaucauacccuaacuguauucaucaacacuuagaguaagcaaggcucgcuggagagccacacacacugggcaccguaaugucgguuauaacaccgcagaggaguucugaacuauguauuucgcacuccuggguucaucaucuccugaaaucucagggugguguuugcucucaguugcuucagcugaguagcuggcuuucuguccuggaaagcagacuuuguacaugugugugcaaccuaugccugcugagaucaucaucagacagggaagcggcuugguccagagagcuguucucaguagaauguuaagcacagagagcugagaauuagacugguuauuuacauagacauccaaauagaaaccuauagaguaucuguuaagucaggcucucccgucaucucccccaucccugggcaggugucuaggagaugguuuuguuauuuucagggcccucucaauggcuaaaacacucugggagaugaacaagauuuuaaaaacccaaagcuuagcgcaccuggugggugggggugugaaaacuuugaaggaaaccgcgucaagagccuggcugauuguuaauaucacguuaacucagagggccaggauacuugcccagacccggagucugccugcaaguagcagaggagagcuggccuugcucugccgcgugucuuucuuccugggcccucugucucggguuggaauuugaauaguggaguagugucugccacagucaggggccuggaugaaguagaccaccaguacggagcuauacucagguacuuuucaauguauauaucuucauuaaaaaaaaaaaaucugggccaggcacagugggucacgccuguaaucucagcacuuugggaggccgagguggguggaucaccugaagucaggaguuugagaccagccuggccaacauggugaaacccaguuucuacuaaaaacacaaaaauuauccaggcgugguggugcaugcugguaaucccaguuacuugggagacugaggcaggagaauugcuugaaccugggaggcggagguugcagugagccgagauugcgccauugcacuccaaccugggcgacgagagugaaacuguccugaaggggaaacaaaaaaaucuguaucaaaauaaggauuuaacuaauaguauuaggcacuacuuuaaaaaggcuuugcuguuaguaagguugaaagaaauagagcccuagguauacauuggguagcaccuuguucagcugcucagauucuugaaccuuguugaggucuuacuuugauaucaccugggccuuacuuuucguuguuuggguuuccuccccaggugucucaaucagggccuccucuguccuuuugcagggaagaaggggguaggaagggccugaaaaagaacuugccuuccccauugcccccucagaguuuguuccucuccaguccucuucccacccuuucuuaggacaccaaaacccugacucuuucaguauuuuauaauaaaauaaaguuacuaaauugucuguucuguuuugcagaggacacacauuuaggagccagugauucagaccuuccauuuuucuuuuuggugcuaaugcucuuuucaguauauucucuuugauagaaaaaaaauggaggcaaaacugaauuuucugcauuaucuuuuccuuuagcauuauucuuguuucugcacuucauucugacccccuuccccagcauaaaguuccauguccagauccacuugcccugagauuuuugacuuccguuugggacucuagucccuccaggggacacauugagccucccagacccugcagggcccugugcucauucggcucuugggcuguugcuacgguccuuccugacccucuguuuccugggacaaguaguuuuuaaugcagcuacuuucugaaagagcuggggucuuaccgcagaauauuauuuuauuauuuuuagagacaaggucuuggucuuucgcccaggcuggagugcaguggugagaucauagcucccugcagccucaagcuccugggcucaagcgaaccuccugcuuugaccucccaaguaccagggacuacaggugugcgccaccauaccuggcuaauuguuguuguuguuguuuuuagaggccagggucuccguauguugccuaggguggucucgaacuccuggacucaagugaucuucccuccuaggccucccaaagugcuggaauuauaggcaugagccaccaugccuggccucgcaggauauuauuuaaacgaaaccugaaggauuuaaaaucagagaagacacauaaaccaucaccugacuguggggugagaguggucuuuauauagacacucaugaugcacaagccagcccuucgccccacucuuguuuugaagugaaaggauuuauaugggagggaggagguuugagcugugcaggaggguccuugguuggcaugaggauuuugugaaccuacgcuguuagcucugcaggccugucuuggacauagguaaguagaaguuggagaccuuguguuguggaccaaauguugcaagauguguguucuguggcuuuucauuaacugcugcauaucugcugguugguggacauagucuaguuuucuuuugacuuaaaaaaauuaacaguacagcuuauaucggagggcugcauaguuugggggaaacuaaugaauauaguauggaauguaaugaaugacugacuucuucauagagcuauugaagugauuuaugaagaggaagaaaucauuuuugugacuuuguugaucuuugaaguauuagaguggcuuuggcagguguggaucacccggaaaggaaucaaacacugaguccugccaaggugcucggucccggcagcaaagccaguccucagcagccugcgcucccgaagcuccuccagcuaaguaacugaauaggccgcccugggagcugcccaugcggaugcucugaauggugaaacuugguuuugacaccacaaguuguuuucaguuaaaucaguggcucagcagcagagcaggguucuccaaggaggccucguguccccuucaccccaccuggagguagcuguucuaaaaccaguaaaaaauucuacaaaaacauuuucuuaggguuguuaaauuagucauaguguguguaaccaugaaaggaauggugagagugcaauaaaugccugguguguucacucuccuacuccuaaaaguuucuugguagaauaauuuccuaccugugaugcuugcgaagucagcagaggcucccacccagcccugccgcccauucccagaagucugggcugggggacaccgaauggauaguccaccagcggcguggcuugugaaaggagguacuuguuaaaucuauguguuuuuauuauagacaucguucugccagucgcaauaauguguuuauggacauuuuucugcaagcacagcgcggguggcaguuuuuacugacaaauugagucauaugcauagagguuuagaaagcgcuugccuuauugacggaucaggcaauucuggcacgggauguucagagauauuuaggugggugaagagagugaaugaaucucagggcagagaaggagauggggcauuauauguugaaaugcaauaaauaaucgcuaguuauuuaucauuuguuuuuaaacuuuuagcuacauuguacuucccagucaagaggacuccggugggcagccggggauaucauguucaggugucucuccugcuugugugggguaagagccacuacuggaaugcgauuccagcaaggccugacgagucacagccccuugaaccuguugcucuccguaaagugggaucuucacaggcaacaguggaggagcguuugagggugaccugggcccucugcaucagaauuacugugggugcuggcuagagaggucucucgauugcagggccccaugggagaccuacaggaccagaaccuggggaugccaggggauucuggcagacccuaaugcuugagcaccucuagggaaggccuuaggauccucugggaaguagcacucuccagcccaggcaagauccgagucccccuuccagaaguauccaucggcaguuggcauugcugcagguuuucugugcauaugggucugaguacgguuuuguaacuccugagagacgugaaucucuucaaauugcaaacccaacauguuauuauugcuuuugaguuuucaguuuugugguuaugacaagaugcagauguuaccaaaacuuuggcgucaguuuuacaaacacacgcgaagcacgggcaacccguaucauauuucaccccuucuuuccuuuugagaggguugucuuguuuuuaaucccccucugggucaaggcauuuuccuggucucaggugagggugcacuuucagaggcacagcugaauacauuuugugggacugaauugagcuuuucuacaggaagugccaggccgugugugggagugaugcuguuuccuagcugggucccccugggcaacucuuagcccuccaggcaccuccucauccauuggguggggacgauuaugcuuauucggucuacccggguaaguauaggcacacgagacaguaaauacauauuuuuuuaaaaguaaaauuucuauccacuacauggauagaaauuuuaauuuggagcugagucucacggaaggaugaaacgagaagacggcgaagaaccauuucgagcccucguuuuccccccaguccaauccgaaucuguauuuugcagaucugcacacacccaagcccucacugggggcaugugcacgguggucagaagugcaccuucugggaacagaugggcuuccguuuggaccugcuuuacaaguuacaauccugugcccuugagcagaguuacuuaaccuuccaaggccagauuucuccaaaagcagggccagggacaguucccauccagaaggaggccuggcgcuggggaggccugaaugaaggcgguugguguuugcggaugcagagucgcucuguuuugguggaggcaggacuggaggucgggaucacuuggccacauuugccaccucuggugcgucugaggucacagugcauugucugugugcagcauaagguaguucccuauucauuuacuaggucccugaaguccuuuugucuguaaagaggcuacuggcucugccaccugcuucugucuuuucacaguagacauucucgacguggcagcauucuaaagguucaggugugccacaucggccuagagugggcaggugggcuucaugugugcuccuaggggcacuuggcaguugcugauagcccgagacacugggagccuugacauuauucaucuguuauauugaaagaacuucccaaaggacggacacaggaucugacacgauggcaguggccaggaaccagcagugacaccagcaugugacaguauuuucccaugugugacggccguuuagaucacagcagugagggguaacgcagguccgcuggguaaacuuggucaaaaaugggaagucugcagcauuucguguguuuguggaaaugggccuuauuuuuauuuggggugucuccuuaaucuccugucaugguucagcucacccuggugguuauucugggcgugcugcgcuuguugccuuguacagaccaacuuaggaaaggcucaccaccaccccaugaaggagaaggcgcugugagugucuuuauuuugcauaugaggaacccgggccucggagaguuugagugacuugcacaggucuccugggauagagguagaguuuuguuuucaacccagauuuauuugauaaccaagugcaggcucauaaccacuugugccaggcuggcuuugcaacgaugagccugagaagcuguuagaaguccuuuaaggggcaagacaggguguaaacagacacagaccuguuuauguagcuaauguuuucugaacaucaaugugaccaaguguugucuuuagcauugugggaaaagcaauucgcccaaguguauuccugcuugaaggcguugagccguagcugaggcugggugcagugaggacuuggggauggcaaagcugucccugcgugugccuugugccuaccccgcaccccacuagagaguggaacgaccagggcaguggggccagaggaaagaugggaggaugcagagggccagccaugucccgggacugugcacacgcuucaccaugucccugcaggccagggacccaugccugauucccucugaaacauuugcgggacuguggcuaccggucagguuucuccaaguggcccaaggggugggcauuuugagcagagcagugggacuauggaugcggguacauuuggggaccuggccauaguugaauuugagcaggguguggcaagcauguggggcuggacaggaaggcagagcuagccaguggggccagggccugcggagcccaaaugcugcgcugggugaagggccuugggagucuugugaguggggaacacuagccugucagugcuucccagagaagaucacggggcuggcaggggacugauuggggcagaggaugcaggaugguggcagcaggccuggcagggcggggacaguuccaggagguauagcuggggucaacccugguggcuucuggugagagcggagcaggugggagucgcagagugugguugugagggacuaaguuuagaaucgcuuuucuuauugagagagacgaaagccuuggugugugugcuuuuuaugugagggaagccagauaaaggaucuggcuuuggaaggguagacaggccgcccucugcccugccuggcaucuggguucugaggcgggagauuucccgacugcagccgcguucaggcgaggauggcagcgguggacccaggcucauuaccauugcucccaccccagccugucccuguugggggcaaccuguacguccugcaggagucacggaauuuuaaaaaccaaaccgucagguguuagagguacagucacaucagaaugcaaauuagaaauagugugugcuggggccuuaaacaccaugacguguuucgugggcuggugcggcugagugugccccugggcagcagagauugacgaggguggcugggcuuccuccgggcccugggcucgcaguggccuugucuucaaggggcuccccgugugguagggagacgugcuugucacacccauacauuuuguagguacuggugagggcuggcuagacugaaugaggugaagagccuggccuuuguugggggggguguuggggagcuugguaagugguugaagauguugaagaaguccccucugaggagguggcuuucgaguggagauuugaacagugagagguggcaaggucuggggaggaggcuuccaggggacgagugagagcugcaggugccuagauggcugcaggucgguguguuggaagcacagaugggagguccuaugagggucacggggugggguggggagcauugaggccacuguugcaggccuggauucacucuaggaguguuaaagccagggucucagccuccugcaguugucaucuaguuaaagucaugccagcagggcagggcugugugugucugggugaugggggaucagaugagaaagugcgugccacccucagcacagugcaugagaggcgugaggcacggcggaugcugcgggucuuauaaggccuuuaacgcucgaggggaaguuccuagaauaaugggcgaagaaaaggaaugauauauuucuaaaaguuacugaauuuagcuagcuagcccaagaaaagcccaugugugcuauucuuuauugugcagaaaaauucguuucugucaccauuguguuaucaucagauuaagcugucgagucagauggaugcugugguugugcggggugcgggccgaucagcacacucccagugccucugcaggccgucagccuccagcccaggccagccugagaggcaggcgacgugggaagggaggggcuucccaccaggacacaggagguugcugaggagguugcuuccauggugccacuucugaaauaagaacuguuccuuggaaggaaugcacagguucugaaguuaguguucuuaaaguucaacguuaucuacccucuuggccauaguugaccacccuguggucauccuuggcccagcaagagcacaggcucuuggaaagccacaauccaugaccauauucacagcugaccaaccauuugccaggaggcaggacuuucugugcuaaaauggggaugucccaggcagacugggguggguggucccugccucccucggcucucauuccaggguccuccuggacaucacugcugucacuuugccacuagcuugaguccaccugggccuugaggcagaagcagucguugaauuuucuuuuuuuuugguucuccggaagcaugggcuuauaagccuuccuguuguauuuugccaugaguguaauuagaacaucucccagagccugggucacuucccuuuagcuggacauggcccccgcuguccuugucacauuuuuuggauuguuugucacuccagaaagccuucagggucaugguucucacuuccucagacauuuuucucuucugggugugaggaucuuuugcucauaagacuugccuucuuugggccugagacgcuucucccccagcuguggagaucaugacaguugcagcagacggcuucuuggaaagguagaaggcucugguguuggcugaggagaagcagcuccguggucuccagggguguccuggguucccaggaaucccauggcuccugggggaaccgcugccuggggcagugcugguuccauggucuguugggguuccugggugcucacacugccccagcuuagccggcgugacucaggaugcuaggacccaucgccaggcugcugggaguggcuggguggggaggucagcucuggcaccaaggccaugcuggggcugcagggcuuggcuggaaggggugcugcccuguguguccugcuacaaggggccggggacccucccaacucaggguguccugcacgcccacacugccucccucuucuaucuuuaagacaccugggaagcuucuggacaugucaaacccacaccagacugaguggcaggguccaccacaggaguagcuuagugaagaccagaaaugguuuugagcugggcacuggcacagacagggugagagccagccgcaugguccucgcagccuccccgccuguggaccccucucucaggccaggcaagucugugggcucgugggaccccggcagugcuggccuccuguguuugggccucugcaucugugcucugcccugagguugggugagugggggacucgugucccucucuucccagagcagccucugcucuauccucagggaaccucuucugacccgauccccacgcagacaugcucugcugcccucucucucaaucuuccccacucucacuucuuccagaagcuacuucagcccccacgaucucucucugucuggggcccuucacacaccacuguuuucuacuagacuuguauuguuuccaucucuugauggugggaugcuagauuggaugcucuccaaggccuggugugugguuucuacuggauggaaggcccagcacagagugcuggacacagggugcuguggacugaaccguguccccaagauucacaggcugaaguccugaccuccaauuuggcuguauuuggagacagggccuuuaggaggaaauuaaggcuaacugagucauaagagugggauccuacucugcuaggauugauggccuuggcagagaaagagaggaucuuuuuucuuagaagagaaagagaggaucucucccucccauaccgugugaggacacagcgaggaggaggcugugugcaagccaggaaaggagcccucacuggaaacggaaucagccaggaccagcagcucucacuugccagccuccagaaccgugagaagauaaaugucuguugguuaagcccccagucugguauuuuguuacggcagcccaggcaaaccaauauauaggugaauuacagacuaaaguuguuucaaaggcacaaaacucaucaagggauuguguaugaaguuggaauuuggggcugaggauaacuuugucaucagacagugcuccaaaaaggcacuguucucagguuuagcucuuggcaucccaaaagauaugaguguauugcaguaaaaaacaaguaacaaacagaaacccagauuucaugaccagaaacaucagugguugugggaauaggggacagcaggcaagacaggagacuccagaagccagcagaccauggaaaggccuggugcuguccuggcccugggugggcuugcucugguaagcgguagaggaaccugcgcccugaugggaaggagagaccagcucaaaugcugccagacuggguuuuuaaaaccagucucuacagguucauugggauucuuuuuguugguugguugauuuuuucccccccuccagauuggucaguauacacacacuaauccagccugguucaaaggacagcauguggucgucugguuggacaccagcuacaucucucagaaccauacucuuugcugcuuuucaggcuaagauagcucucugagacuguuuggaggucucuguugauuuaggggccuugcaagacauuucuugcugaaagccccgcuggcccacaccucaccaaauuggcuuauguggcuacugauggggggacauagaaaagguagauagaaaagguuaaauuuacuucugucuaacucaccaauucaugcuguggauuguagaucugcaaaauauaucaaguucacagggauuuuaugauuguugcaaaggaaacucaaauugucagccuuuuccugaaggaucuugccauuccuaagcucuggcuaugccccuacuucuggcuggcuguggccuugcagugcaggcuggcacugugccccuggcaucuggcuuuggggggcccagcugugcagggagcagaugcuguggugaauacaggugaagccagaguccuggcuuggggaauguguucugcuuccuguagugcucuauuugaaguguggauuucaguucuucguuaucuuuuauuuauuuauuuacuuauuagcacagcuuguuuguuguucaguuccauagugagaaucucuaagaauaugauuaaccuugagggucaucuuauccuguaauuauuaaugauugauucuguuuauccuugaaaucaauaagagaggcauaaugguuuggucuguaguugggcgugauuucuuacauuucguaaacacgguucugugacagcaguuguaucaguuuauuacccagaacauguuugaugaaucugaaguguaugauuaguuuuauauaauuauugugauauguaguguuccuuacaugaguuauguuaauauggcaaauaguguuaacaucuccugccacuaauaguuaggguggggacauauaauaauugaucuuccugggagugcuguaauguaaaaacaauucaggcuguuggaaguauauuuuacaaguaugcguugggccuuggggauguuauauugaaaaacccaauuguacaguuaccaugggaacccaauuaaaauagauugguugauuuuuuuuugucuuucaucuugaccaaaaaucuaauguauuuuaaauguuuucauauggaauuguagucauauacugacuugcugugccaaaguauucugcucguuuuuuccaacuuuaagcuaaaauagugaaaaguucucgaguggauccuuaugagaacgucucccaaagagaaucagucauguuuuuguggaaaaguuugugugagugaugaugguagaguggaggugguggaaagcuuuuaugaaaaaagggagaacaagcauuuuccuacgagggcagacaagaacccucauguucuuccuuugguggaggacaugaguguguuucuccguucucacguuuguagaaggugagauuaggucccuaaagggcccucuccguguuguggagggguugggguggggguggagugguggggugggaucuguguuugcccuccuugcuggggguccucacauuguuuggucucagagccuuuuugcacaguuaaaacuuaugagggaucccaaagagauuaccugaguuauauauuaauaccccauuagaaauuagcagugagaaauuuuaaaauauugauucauuuagacaauaaaccuauuagcuuuuugcauaaauaacauuuuaaaauaaaaacuagcuauauuuuccauaaaaaccaauuagggaggaauguuaucaguuuccauuuuuuaaaacuucauaaugccuggaugaauagaagacagcuagcuucuccugcuucauucagucuguugugauauguuuggguugaagcgcaucaagagaaucuggccucacucagguaaguaauuaaaagggaauaguguuuuaacagcuuccucagauaauugaggauguucuccuuugacacuacaucaggacucggcaagugguaauuuccugaggguuuguagcagggugcaauccgagacccgcucugugaacuuuuugcucucuaugacguuaaaauccacagguaugccuugcacuuugagugauuuuguagcgucuuucaucggcccuguggaaaauguugcuucauugaguuauacagaucuuucaaauauugauguuuccuaauacaguccuaaaaauaauauuuguuaauaucaccaccuuucuccuuaggaaagucauuuaguauugggaagccauggugguggguaccaguauucuaacauuuuaaucaucacuugaaaguucuggcugggcacacuggcucaugacugugauuccagcacuuugggaggcugaggugggaggaucacuugaggccaggaguuggagaccagccugggcaauauagcaagaucccgucucuacaaaaacauuuuuuaaaaagaaaguuccccuuuuaucaucagcagcagauacugucaguuguguucauuacagguacagacuauucauuuuugagaaaacauccgccagauaugcaagucugaauaacuguuguuugugagucauucacacuagcaaagcuuuuguucuaaaaugaaguugguaaguucaucagcagucucugccauuugcggagcccuccugguggcagcgucauucugguuuguggcagaagugcuuugcugcgcuucccguuaggucacagaauguuuagaaggucaagauuuagugaaguuugauugcuuccucagggcauucugaagugaaccugccuguugcccugaccgugccuuccuccuagaguuuggugucaauaucuuggcccuugcggaggcauccacgguuuuccccagcauggcuucuguguugucuuucaccgugcgguguguggucagccauaguuugugcaggugcccuuuagcagaugggggauguuuuacucuuuucugcagugaauaugguggauaacucucauugguuuccaugucuucaaccaauuuuguguuccuggauaaaugcccaccuggacuuggugaauuacuguuuucauagauugcuggauuugacguguggauauguuugaggauugugugucuguucaugagagguguuggucagcagcauuccuggagugucugucugcuuuguuaggagggcaaucuugcacucauaaaaugaggccucuucuauauuuuggauuaguuuguguaccguuagcauugucucuucuuuaaaugcuucauaagauuuaccagugaagccauuuguguuugaaguuuucuuugugaaaauaacauuaacuaugaauucaguuuuuuuuaguagcuauagggccauucaggucauuuauuucuucuugagugacuuuuugggauuuuguauuugucaaggaauuugaccauuucaucuaaguuuguugaauuuauuggccuaaaguuauuuuuauauuccuuuauuauccuuuuaaugucugugggauuuugagucauguccuuauuuuuauuccugauauugguaauuugcacuuuguccccuuuuuugcuaacuggucuggcuagagguuuaucuguuucuuuucagagagccaacuuucguuacuugauuuuucucucuuacugauuucuccuguuuauuauugcuuucuugugcuuacuuucaguuuaguuugcuuucuuuuuuguaguuucuuaggguagaggcuuagaucauuugguuuuccuuucuucuuuucucauauaaacauuuaaugcuaaaaauucucucuaagcacugcuuuaggugugcucacagauagacaugcuguguuuucauuuugauucagaguggcguauuucccaauuuuccuugugguuucuucuuuaaugcuuggguuauuuauuaguacaucauuuaauuuccaagaauuuggggauuuaaaaaauauuuggguacuuucccaguauuuuucuguuauugaucugcaggggugaguuaccuuguaaucagaggacauaccuguuaugauuuuaauccuccuagauuuguugagaguuguuuuacagcccagaauauggucuaccuugguggauguuugaaaaguguauacucugugguucuuggguggagugcucuuuaaauguaguuggguaagguuuguugauaaugcucuucaagccuucuauauccuuauugaauuuuguuucccuauucuaaaaauuauuaggaguauugacaucuccagcuaugauuggagacuuauuaccccuuucaguucuguugguucuugguucaucuguucuaagugauuucauuaggugcauacauguuuagaauuuuaacauccucauggggaauuaaccuuuacucuuaugaaauggccuucucuaguuuuguugucauauuccuuuuuugaaauuauuugauauuaggauagccacuccagcuuucuuuugauuaguguuucugugguaacuguuuuuccauucuuuuauguugaaccuguucuugucauuacauuuaauguguguuucuuguagaaaacacaguugggucucuugcuuuaaaaaaucuaaucugacaaugucuuuguaaaauuggaguauuuagaccauuuacauuuaauguaauuauuaauaugguuggguuuaaguauaccaucuggcuguucauuugucauucaccaauuuguucuuuuugcccuuccuccaucuuccguagcuucuuuucaguuauuuggauauguuuuugaaugauuccaauuuaacauucugucuacacuguuggcuuguuagcuaucucucuucuuuuuuaguggcugcuuuaggauguguaauguacauacuuagcuuaugcuuaucauaaucugcauucaugugauauaauacaacuucacaugcagaauaagcaccuuaacaaaaguaugcuucaauuucucucaucccauuuuuuguuauauuauugcuacauauguaauauucuccaauauauagaguuacuauuuuuauguugggcaaucaguuuucuuuuaaagagauuuaaaaaauccagaauuuacauuuauuugcauauuuacuguuuuuugaaauccucauuccuuuguguagauccuaguuuccauugaguaccauuuuuuuuacaccugaaaaccuuguaccaucauuucucaagugcaggucugcuggugucugaauugucaugcauuuguuuuuguuuuuugaaaaaagccuuugucucaccugcauucuugaaaaaaugugaauucuagguugaccuguuuuuuugcuuuuuaauacuuuaaagauguuguuccauuguguucugccuugcauaguuucugaugaucaguuugccgucauucuuaaauuuguucuucuguauguaaucuggcauuuuugccaccucuggccacuaagguuuucucuuugucacuuguuuucagcuguuugauuauuuguuuuuauguuucuucugcuuggguuucacugagcuucuugcaucugugagaauggguuacauaucccuuaucugaaaugguugggacuagaaguguuucugauuuuggauuuuuuuuggauuuuggaauauuugcauagauagauagguagauaaauagauauauagauagauagauauagauauagauaccuuggggaugugacccaaguuuaaacauggaauuuuuguuucacauauaccuuauccacauagccugcaggaaaucuuauguauuauuuuaaauaauuuugugcauguuacaaaauuuugacuguauuucaacugagaccugucauacaaggucagguguggaauuuuccaauuguggcauuguguuggugcaguuuuuggguuuuggagcauuuuggauuaggugugcucaaccuuguuuuaccucauauagauuuuucaucagauuugaggaaaugucacugaauauuucuucagauauuuuuccugccuccccuuuuucugaggcuccaauugcgcaugugcugcuucauacuguccugugucucccugagcccugcucauuuccucagucuuuuuguguuucugugccuugauaguuuaaaaaacguuauuuucucauuguugcuauuuuuuccuucugcugcaucuaaucuguacauccuaucgauuguauuuuuuacuuuagagacugcauuuuacaucucuauaugcuccauaugggccuuuuaaaauaucuucuauuucucaugucauauguggguucuccucuaucuucucaaauauggagcauguuuauaagaacuguuuuuaugucccaguccccuuguuuuacgcaucucuacuuuucuggguuugguucuguugaaugauuuuucuccugauuguggguuauaucccucugcuucucauguguguguguuuuaaaugggauccuagacauugagaguuuuguuguggagugcuagauuauguugucuuuuaaaaaacaguuuuggacuuuguucugcugcagguucaguuucuugaaauuguuuguauccuuucaagguaucaugcuuuuuuuaaaaaaagguuuuguuagggcagguccagaccagguuuuaguccagggauaguuuaguccuacuauuuacauaaugucuuuacuuuauaaggguguguguauguguauauauguauguguguguguauuauauauauguauguguguauuuuauauauguguguauuaaauauauauguauuacauauauauguauauauaugaaaaauaaggcagcucugaggucuuuaccugaugaauguuguauuaggagaucuuuccacacuggcuggugagaacaugaaauauucccagcucugucugugaucaggaauuauuugggcugcuacuucugggcaucuuucuuugaccucagggaguuccuucucaagcagugucucaguaguuaggcagaggccacagggacucuucuggagaugccuggcguguucucugaguaggcccuucuucccugguacuccauccugaugauucuagguguuuuguucuuuuugaauucuaaucucucuccccacuuuggugagagcacccacugguuuugugccagaugacccuccuccuccuuggcacagccuggaggcugcauccagccguucucuggcggcuggcucacuucacuucccuuuccuuggggagcauagccccuggcugcuguuguccuuguucugaagaccauuguuuuauauaaaaguugagcaccccuaauucaaaaucugaaaugcuacagcaucugaaaauuuuugaacauugacaugcugcucaaagcugaugcucaaaggaaaugcuuauuggagcauuuuggauuuuuggauuagggaugcuccaacuguaaguauuugcaaauauucccaaauccagaaaaaucuaaaaccugaagcacuucugguucccagaauuucaggcuacucauccuggacuuuauuucguuuuagcuguuacaugugguucuugcugcucugucauggcuagaagugggauccccaccaaguuauuaguggacucauaaaaauaaaagagaggccugcugggcuguuaccagacugagauugcucagauuacacaaagcccucuggcccugaccccagacuuuuuaccagccugaagugggugaaaagaaagcuucacugacugcuuucuaggcauguuuaagccugcuuauucuggcccucacagaauaagaauucaaaggacaauaauuuucaagaagacuuaauuuaaguucaucuaccuuauuagacuugauauagauagauagccuuuuuaauuuuuuuuucucauggaaacagaguugaagaaaacuaauuuaccuucuaaauuuaggcacagcuaaccaagucaaggugugguucuguucuucucuguucucuucucuucucuuuuuuuuuuuuuuuuuuuggugggggguagacagagucuugcucuguugcucaggcuggagugcgauggcaugaucuuggcucgcugcgaccucugucuccuggguuuaagcaauucuccugccuuagccucccaaguagcugggauuacaggugcccaucaccacgccuggcuaauuuuuugcauuuuuaguagagaugggguuuugccacguuggccaggcuauucucgaacucuugaccucaggugauccaccugccucagccuccagaagugcugggauuacaggugugagccacugcgcccagccgguuauuguauuuucuguaugcuuuuuggucguucagcucauacucagucuuucccuguacuguuugagaaauucacaagugaaucccagaucacagguguuuggugaaauugguauaaaccuuaacugacuuucuguuaagaaacauaaaaaaauuuauuuguauuucuacucugaagaaggacuguucaaacuuuauauggaggggacccaagauugggaaggcagaggaaacaaagggcgucuuugauucacauuauuuuucucuugucaucauugcaggcuuaagugugugucaucacuagaaauguauucuguugaugucugucauuucagcauuuucauguugucaaaaaugagaccagacagaagaagaguguauucuuuccugcuagaacucgcacaacacugucauuaaugccucuggcagucaggacuuuaaucaguuaaauguaauaguggugauaacguuaaagccuuguauggcagucuacccgggcagccuagagagcccugugcaacucugcauuugaaaaaucaaucaacuagggcugucuuuuguccugggcuacuuggauagcugguaugaaccacccagcacuagccuccugcuuguugagaugacacuuuuccugaagccaugcccacucuugacaaagaauaauuaggugcccugcauaaguguauggggaccugcagguggcuuggaugguuugcccugcucucauggggguccacaugagcauacagaauggaagaagucaugaugguugcagugguuccucagaggaacagugaguuuuucaaguaggacucugauuaucuguaaaggccaaacuuguuccagugacaucacaucucugggguugcuaggaaguaaaggagaaaauggguucacuugcacaguuuuggauuacauguaaguuuuaaagaauaggaauguguguguguauguaugguauauacacuauauuaucauuaccaaaaaugaugccuccuauagacuuuugguagaaaggaaauuucuuucucuucugguugucugaauuuuguuuuccuuuuuuuuugcuucccuccggaagggaaucaaaaaauuguauauauauauguacacacacuauauaugaaaugccuguucauauccuuucugccuguguuucuguugggauuucuuuuucuuauugauuuauaggauuauuuuauauagucuggauucuaauccuuugucagguauauuggcugcaauuuucuucucccaguuuguggccugcauuuucauuuucuuuauacacugcuaaccauguagguguauguauguauauauucugauuguggguuauauuucuuugcuucuuauguguguguuuuaaguuggauccuagacauugagagacuguguguguguauauauauaccauauagggguguguguguguguguguguguguauauauauacacacacaaacacacauagguguauacgcagguauacacacacacacacacauagguauacacacacacacacacacacacacacacacacacacaugaauauaccuauaugguuaguagugggaagccaagcuguuucucacugucagaugguuaaguuuugaaauuuucucucauucuacucaaggguagaaugauuggagugucaguguucaaugcuacaggacaauaacuuuuguaaaaaugguuaaagcagauuagaccccagucaguuaauccaccuccucaccaaaacuuggaguuaucaugcuacuaacacugcuaaccuacuggguaaaaauccugucucauagugaucuuaauuagcacuuccgauugagagcaaccuucagcaucuuuucguguugccauucaucuuuugcgaaaugccuguucauacccuuucugcccauauuucuguuggauuuucuuuuuguuauuaacuuauaggauuaucuuauauagucugaauucuaauccuuugucuguuauaugugcugcaauugucuucucccaguuuguggccauguuuucauucucuuuauagugccuuuugauggacaggaguuucuaauuuuaauauaguugcauguaauugaauuuaugauucuuuuccuuuauaguuugcacauuuugugucucguuucaaagugcuuccuuauccccagucauaacaauuccacuauuuuccuaugaaaguaucaguuuuccuuuucauauacaagucugcagcucauuugaaauuaacuucugcugugguauggaguggaaguucaguucuuuuuuaauaugaauaaucaguggcuccagccccauguauagaguaaccccaccuuucuccagggcucugcagcggcuucacugcaaauauaugacaaacaugugacauguggauauagagcaagagaggcacugcagagcccuagagaaaugaggagagacacaguaaauggugcuggagcugcugacuauuccaaguggacgcaugccuuuuucuaggcucuccuguuccauugaucuuuuugucuuucuguacuaacgccacaaugcauuaauuacuauagcuuuaggcuaacucuuaaaauugaugagucagccaggcacaguggcucaugccuguaaucccagcacuuugggagacugaggugggcagaucaugaguucaggaguuugagaccagucuagccaacauagugaaaccccaucuuuacuaaaaauagaaaaaauuagcugggugugguggugugugccuguaaucccaguuacucgggaggcugagacaggggaauugcaugaacccgggaagcggagguugcagugagcugagauagcgccauugcacuccagccugggugacagugcaggacucugucucaaaaaaaaaaaaaaaaaaaaaaaaaaauuggugaguaaauccucauaucuugauuuuccauuuuccucuucaggaguuucuugauucuuuuggggccuuugcucauccauucgcauuucacaaugagcuugucacauucuuagacuaaccuguuugguauuuugauugacguccuugggucuguagacuaauguggggagaauaagaucuuuaggauaugaaucugccucuucaggaauaugcgcucuugcacucucugucucucuuggauuuccuuaaugucucucacauuuuaauaaguuuuuucauaaacagcuugugcaccuuuugaaauacuccccguguccuuauuuuuuguuguugccauuaauauuauaaaugguaucuuuuucuaggauuagauuuuucuuuaugacugauaugcggaaaugcuauuaauuuucaugucaucuuuaauuuacuuucuaauuuuuuaaaaugaauauaccacauauauauucuuuguuuuuucuacauagacagaguuuugcuucuucuacucuguaaaccauuucuuucuuuuacuugucauauugcacuaggaucuccaguuccauuuuaagucgauguggggauaauacacucaucuuguugcuuauuuuaaagggaaaacugcuaacucuucauuaacaaaaaugaugcuugcuauagacuuuugguagaaagaacuuuccuucucuucugguuaucugaauuuuguuuucuuuuuuuucuuuuuucuuauuuugcuucccuccaggagggaaacaaaaaauugucagaaacuauuucagagcugaagaaaacuucuuaaucuccuucuccucuacuguuccuugaaaacuuuuuaaaaauuaugaacaggcuucaaauuuuauuaagugauuuuucugcaucuauuuaacuguuuaugugguucccauccccauaucuguuaguguggaucaugacuucuagggaauuauuaauguuaagcuaucuuugcauuccugggaugaacauuacuuggccacuaagaaucauccuuuaaacaccugcucuagaccaagcuuauuaauuuauugcuuuuaacuuuggccaaacuagugguuuaauuguuuuuaagguuauuuauucuuuauuguuauuaagauuauucuuuuuuaaaaacugguuagguuaauuauaugaagcuauauuuuugcacagucuaucuuuuucuacccuuuagcuuucagccuuuguucuuauauuuaaaauauguguaaaguaauauaguuuuaaaaauauccaguuugguagucuuuauuuuuuaauuauuuaguccagucacauuaaaauaauuauaguugagcuuacuuuuaccaucuugcuaucugucuucuauuugucccaucuuuauuuguuccuguauuucuaauuuauuuugcuuucuuuaugauuaauaguuuuuaaaaccauuuuucuccccuuucugguuauacagauuuguauguuucauuuagugauuagccuagagauuauaauauacacccuggacuuacuauaguucaccuaaauugcuacuuugccacuuccugaauaguaaaauacuuuacaaaauguuagucauuucccuuucucccagcuuggaugcuguuguauuuuaauuauauauacacauuuaaaaugcaguagucacuuuugucacuguuuaaacguuugguguuugugucaccgugccccaugcuugcccuccagugcucuccauugguucuccaucaucaugccuucgucuggggugacuucugcuugaaggacuuguuuguuuacuuaguuuuuaaugcuagucaacuggcagugaauugguccauuuuuaaacacuaauaguuauugauuguugaguuagcaauucuuuaccuuauaaaauaugacauuccaucgucuucugguuucugaaguuugcugaaaagucagcugucagucuuauuguugcacuuuugaagauaaugcaaauguuuuuacucuggcugcuuuuaagauuuuuucuuugguuugaagcuaauuguguuaugguucuuugagguuuucuucauauuuauucugcuuaggguuugcugaacuucuugaauuucuggauugcucucugucaucuauuggcaaauucuugacccugaucccuucaaauauugcucugccucauccaaucuguccuuuccucucggaguugaauuauagguagguuaguccuuuugacugucccucggaucucuauucuuguuuucuuuccauuccuuuccccuuucuugaccacaguuuggauauuuucugcugagcucucuggcagaucacggaccuuguuuucugauguguccagucuguuacuaaacccauccaaugaauccugaauuacaaauuuuguauuuuucaguucuagaaugcccguuuuguacuuuaauauauauuuuaauucuauauuuaaaauucuucucuuucccacuuauguugucugucuuuuccucuuauuauuaaguguauccauuguaauuauuuuacacuucuuaucugcuagcaccaguauuguggacaucuauuccucugcuuguauuuucuucuuuuuucccuucucuuuauuauuauuaaauacauguuuuugcuuuuugcaugcuuuuaaaauugugaguguuugcuggacuugugcauaaaggacuguaaaaccucuggauugucguguuuuucaucaaagcaaaagcucucuuugcccuugguuaggcauauggagugaggggugaaggaccuugguuucaugagggauugaucugggucagggcuggccuguuauuuuacuaaaacucagucccuaguuggaccuucccuuugagcauggucuuuugauuggaagcccauggucucuuucuccucagccuguaaaugcuuugggagaucccuugguucuccccuuagaagguuuugagcugagcucuuuagcuucccacguccccuguuucaaagucuccuaaauguccugaugggagaugugacuaugugugaagcaggcccuucucucucugucuuuccgccuaccuuuccucccaccccagucucguaagugcuauuagauuaagggauagugugcuuuuccuuuuaggagcccucacuugacccagcucucuaggcucaugaacgcagccccauaggauagcaaauugauugcacuuuugggguucugauucugaucuuucaugccauccccaaugggccacccagagcuucccugguuucccuucccagguggaguggcuuuguguggacugccacggugcuccccaucugcacccaggaucagcaaguguuucugggcagcaaagggcagucuccacuguacagucccagucccccuaguccugguugcuuccacagcucuauaacauuuuaaaagacgaguuuuguaauuuuucugacuuuuuccaguuccugugggaacauugggcugccuccauuaguucguuuugcuuggaaaugaaaguccauucugagcacuugcuugaaaucuugauugaagucuuugauuucugcuuucuccuuggucaugcuuucuccugucaucuaucuuccuuugcccacacauuucauaaaugcuuauuucguauucuacacagguugcuuuaaauaucugcaauccuguggguggagugugggcuuugugguuuucaucuuucugugauuucuuguaacucuuacgaugacacgggaccuuguuugaugacuugguugauuauuaauuuauaugggcugagccugaucuguuugacuccugagugccuaaauuagggaugcuuuucccuaaggguggguguuuggguuucuguugccuggaaccagggggucucaaggcagcaccacucagaucuaggacuuucuaaggcuucucacucaaucagggcccucggguugucagggaggccccaguggagcgucuggaggucaugaggugugcaccuucucugcugaugcugcccacuuucccucugcuuccuccagcccuggcuuacucuccuuuuuccaagugccccgauucucuuuggauugccccugcuuacuagagaggccauucaggaaacuuugaaacauugccauuuauucaauaucuagugcaucguagucccuuaauccaaaacaacugguuugguuuuugcauaaagcuaccagaagauaaauauagauaaaaaucuugaagauuuagaaaaaguaauauuaaaauagauccuuagauauguucuuaucaacaucugcaaguguucaucccaauauggauuccaucaguuagagggguuuuaagaggggucacugugcgccaggcccagugugggaucugggggagguugucaaaguugucuucuaauccagaacaacuugcucacuaauauuuauauuucugccuucaaucugggaagcagcccuuuucagaaagguuugcugcaauacucucuaggggacaaagcugagugaaacucuagaggcuugucuuauacgcauagacaucacgugcacacuuacaccccagucauuuccgcaugugggaucaucacaguuguguguuugacuuuuucaccugaccuuguaagugcuuagccauauauugaacucuuuaauaucauuuuuggagauggcauaguguccuacuguaaagauauaaccuucuuccauuguuaggaauuuagggcaauuucauaucugagacucugucuuaaagaauuaauuaaaauuuugugcacaaagauguuuaauauaguguuuugagaagucaaaacacagggaagacuucuugugucuuacacugagaaauucuuagccagccucuuaguuuccugaauucaggacuguguuguguaauuuugaagccccaauagugauauggucauuuuuuucauaucuucauucaaaaaaccucagucaccuggggaguggguggggugugugcuggacccugaccuugaacuguccagacaaguuccuaaccacguggagcucaagcuucccuggggcuuaccugaaugaccugcucaguggccagccacuugcugcgugucagccggugaacucuggguuccuggcuuaucagagacuucaaguccucauuaccuucugggucucaguuucccuaauaugugcaaugacaggauuggccagggcuuuccaacagaaguuuuugcaaugauggaaauguucugugucucugcugcccaaugugguagccacuagucacauuggcugcugggcacuugaaauugacuccuguggcuuagaaacugaauuuuaaauuuuauuacauuccaauuaauuuaaauuuaaauaaguagccacauguggcuaacagcugcguauggacacugccagucuagacggauaugaugcuuguuuaauggucuuaagaggucuuuagagucuauucuaauccugacaucugguuuucuuugcuuguuuguauuuauuuguuccuuuauuuuuaccacgacugcucugaguaccaggaacuccuuuuugggaugucacagaucaccaacuuccuucucugugcugugucaauagggacgucaccccuguggggaaaggaauuugccugaacaagacacuaaaaagauaaaauaggcugaagcggagaagaauaaaagauugugcuggcaugagcuaguuuugcaaaacccauuuaaauaaacucaggauauuaccgaccccaugcacacauucuuuccuugacucugcaauguuccguuaaaccagauugugaauuuuuuucaggauuaacaauuuacauuuaugauucuauuuucuuuuauaaguaacugcuauuuguaaaugagacuaauuauuugaauucaugguacaaauaacguaauuuagaguuacagaacucuugauccucugggucuaagcaaaauaaacguaguaccuaaugcuggaauagagcaagaguuuucuuugaaucucaaaauaucugcauugugaaacuggguuaaguuauuuuggaaacuauaaauagucacuugguaauuagguguuugguuuuauuuguucuaauggagugcuuauuacagucggugcauuuuuaccccacggaucagaagcuuuuauaggccaagugaugagagaccaucuucuacauuucauuugcugauugugacucaucacugaugaucgauggacugcugaacuuuuuaauuccuguuugcuuguagagaaagaaaauucucaucucuuuugauagguccuacuccaaaauucugcagccguuuuguacaaucauaaccuuacacgauaucacacaaaggcagagaaacgauugcauggacaugccuuccugucaaacguguauggaaucuggcccguccuaggcuuaucucuuuccaccaggauucuucuucccauuuuucucagcagagcaucuucacguaguucacaugacaucagaacuucaucaggauguaaguuccugcagaaauaggccugugucuggucaguaaacagagaauguaaugacauucccagagcauucacaggccagagucugguguccuccccagcguccagcaggcugcggauggauggcaugcagcugacaagauugauacugcauuagacauuccuggaggucccugcggcuggggacuggcacucgcaggccucccccugcacacagcugucuuuggagagcacagagcaaugggaggcgguuuuguuuuacuauuugccauuuagagucucacuuuuaauuuauccucacucuuuaagaaauaauugguaauuuauuucuuagagaucaaauguugcuacaagcugaaaacuguuuuauaaauauuucaggaaacuugaaugccuggaauuuucaucgucacgcuuaagucuuccuccaaaaggggauggacuucguuccaucccgcuccaaaagcugguccgauucuugccuggguguuguaugcuauuugccuuuuccauaggcuccaauaacaauaaguacaucuuaaaauugaugaaaguuuaaugaauggcuagcaagcagagagacuacuuuuauaacaagauuaauaccuuggcucaggggacauaacauuuuaguaaaaucaaaauuuguauaguuauccuagcggugcuugcaaccucuggcuuccauauaaaaaugucuaaauaaaauacuggcagccgucucuagccauuauuuccaucugcucuagguggccugacccggaacccacucaggguggugcacucugggccggggucucugggauuucugucgcaucagcuugugcagccguggaauggggauggggcacugaggcuagcugucccgugcucuagagguuccugggaaaaaaauacagagagaaauaacucacaagggagccagcauuugguguuguuuuaaauaaauucauucaucaucuauaccuuuuccccuuuuaauuacuacacuuuaaaagggaucuugguauauauuuauuuuuguuuuguuaauuuuuuucuuuuuuaaaaaauuaauuguagagauggggucucucuacauugcacaggcucgccuugaacuccuggccucaagugauccgccuaccucagccucccaaagugcugggguuacaggcaugacccacugugccuggccaguuuuuuuucccccuuuuuggcaagggaaggcuaucgggguagaaguucugaagcaaguacucugaaugguuucugauuuuaauagggggagcaucauuuccugaucuaauuuauaaugugauauaaagcugcuggccagcugacacuaaucuuaauuuaugaucuauuuaaccuuuauauuuccuagccacagcucguaccacucccccgucucugcaccagcauguuucagaggcaggcaagcagcaucaguucuggauccuggaggcaaggggaggguuuucacggaggggcggugcacagcucugugccuccccggucagcugguccggcacugcagucagcagcaagggcguggugagggcccugcagauucuucacacuguccugguccucucuccuguuucugaauggcaggacuuuggggucagauuagacccugcauguacauagaugacaacggaauggcuuuuuggggggacuuuuuauuuugagauaaauuuuagacuugcugaaaaguugcacaaauagcacaaaguuucuguaugcagccaccaucugguuucugccagcacuaacaccucacacuuaccacaaccagggcgcuaacacgggugcacuacuguaaaccuugccaucucuccuuugucuccucuagugcaauggucugaauuuaugcuuccuccaaauuccuguguugaaacucuacccccauggugauggccuuuggagguggggccuuugggcaaugacuaggucaggcuggagcccucagaaugggauuagugugccuauaaaagaggacugagggagcucacuguccucuuccaccacgugaggacgcggcgagaaggugcucucugugaaccaggaagagggcccuuaucagacacgggcucuggcggcaccuugaucuuggacuucacagccuccagaaugugcgagaugaauuucuguuguuuacaaagcacccagucuaagguauuuuauuccagcaaccagaaggaacuaagacgucuaacuugugacaguuccucuugccuuguuuuuugugacccuggacccuuucgaagaauacuggucagguauuuuguaggaugccucucguuuggguuugcugauguugucucacagagagacagagguuacguguuuuugguaagaaggcucagaagugaugugcccccuugggccauccuguccuggggacauaugucugucaguuacugugauguuagcuuggucacuggguauggugaaucucuugugcauuuccucuugguaauugaaguuuucccauugguaauuaauaccuugggggagauauuuugagaccauuuugguucugcucaggcuuucacccacucaucuuagugaccgugggugugucuugccuguggcaguuauuacuguacuguuucccuaauguuuguauuucccuccuucccuuuucauuuaccaacgggaacuguucuguaaggaagagcugucuuuucuuucccuuuuauuuauuagucauugaauuauucacaucagcguagacucauggauauuuauuuuaauuucugggguauaguccagugcugucuuuacuuaauuuuguuacucaaauagcccccaguuuggcuuuuuggaaacucuuggguuuggcuccuaugucuuuuggaccugcccaucguuuuucuagcgcuuuccuacuuucugggaucauaguaugauccagguguaucuuguguuuucccugccccagcccuggauucagucacuucuccaaggagccucucuuccuuuuagcuggaggaugauguuuagcagccaagaucugggugcugagugugcuugcugcugcugagucacugcucuuccugcccuucucaguagggggagcuaggggcuguaugugugucuacugacccgugcaucugcauuuauuucugugucugcugucugcaugcauguuaaaaacugcaaguucaucugaugccucuaacuugaauucaucacagcagguuuuauucuaaucucugccuuuccucuuuguagcugccuucuccaacauugagaaaccuggcccucuuuaucugcaacauguuugcuuauaugguggcuuccuuuaaaaagaaucugguaaaaccugugucauuguguuucagccacuagaugcagaugaggcuuaguaggaaaagcccuacuugugaagaacaguauuuccuaugcuugcuugguggaaaaagucacagaauuuucuauagaauucucuguaaacaugguuaggaauauaggguugacauuuggacucaaauagaaaaugaaauccuuuuguuucauuacuuauuucguuacucagcuuucaccuugacucuuggaaaacugauggcauguuuccaaauggauaugccagcuaauuagcuuauuucucaaauauccauguuggauguggaaaacaaauaaaaauaaagcaaggaagacccucuacuguuguuaugugaagaauaacaauuaccuuuaauagcauuuucugcuaauuuagagauuuuucuuuuucuuacacuuauuuucuaacuccuaugauuuguguaauucauaucuuauaccuacaucugauucauuaugauucuuaauucucuuuguuguaaacagaaauauugaaaauucauucgaugaaccuaaaacccuuuaaaaggucugguuaaauuuuaacauuaagggugauacaguauucaugcuauagaacacagacagucagaaaucuuaugaaguguuggagacuuuaauggauacuguacuauguagaaucugaucacgagacuccugcuucaucacguuuuuacucgaauuggguuuccuggugacaaaagacugugaaguagcugacggaaauacauccuuaugucaguuuucacccgaugacugaaaauuguuggauauaugcgugaaauaauuaggucuuauuuuuggaagggagagaauauaaccgacugaaaaauaauuuggaguuaauuguccugaaaauucaccuacuguauauuaauagguuagguguuuccuaauucuuucuuucuuaagcauaucuuccuuuuccuuacacucuuuuugacacaaacuuuugaauauggacucacauuauaaaucuugggauuggaaaggccauaaagauuggauuuuuaaaacuucaacaauguagaggaauaccaguguuguauuuguucagaaaguccucauuggcgcugauuugggcaccgccugguuuccuaccguagaagcgugugcugugguggggugaacugggcgggggauucacaccagccugggcccugggccauggggggcugccucccagggcugcuucagccgacaggagggugcgguggugaagaggcagggcucuggggauuggaaucuccacgcuugacuuuaggcuucuacugcucacucgaaaugggaccugaggcaaauuauucaccugcauugugcuggguuccucaccugugauacauggauuauaauaucaucucucuucauggguuauuguaaggauugauuuuauuaauauuucgaauguuaacguuauuauuuauuuauuuugagauagagucuggcucuguugcccaggugcaguggugcgaucucagcucacuguaaccuccaccuccugagcaauccucgcaccucagccuccugaguaucugggauuacagguacccaccaccacaccuuccugauuuuuguauguuuuuguagagacagugcuucaccauguugcccagacuggucuuaaacuucugagcucaaacuauccgcccgccuuagccucccacagugcugggauuacagacaugagccaccgcacgcagcccaaauguuaaguguaugacauaaaauucaggguuacuuugccuaaacaguucagugucucugauuaaugugauuucuguuucacugacagcuuucauguaaauuuaaaacuagauagaauuacagagcuucagaguuguacagacuuguagagguaaaguaaagccaaaacauugagcucagugacggggucagucacuuccuggugucagaguccacugacaggcucuggcaacucuugcaucaaaauccuuugcacacagguccuuucuugcucuuagccaguagcagcuguccugggcagaguucccucagugaaccuggaaacggcaguggcuggaggugagagguguccauguacucacuuguucaaaguugcccccucuucccucucugggcuugggcccugauaccucucagagcuacccugccuccugcgggggugggggaggaugccuuuauuaucucuaggccaaagguuggaccuccacauauguccaugaugagggacagcagucaucccuuucaagaccgagaaaguauuuaacuccuuggaaaauugaggguuuauuuugcagugguuuggaaaaugugcugaggguggcuguagaguuaacuaaauagaauguuucagagucacagagauuuguaauuggugggcuugguuuguuuuuauagugcuuacuccuuuuuaucugccuuguggauuuaugcauuuauuugauaagucagucauuuaccuccccauucuuugguuuucauguuucuguuuaucaucaagauaagcaacuguggguuuucuuccaucgaagcaccugccgcaggugaugauuuuaaugguaugacugccauggucaccacgaccauuccgaggacucuaaacauguuucuuguccaacacuacuuuaauuugaaacaaagccugaauugagcagcauucgugucugugguagaccagggaggcagggcucaccucuguuuucaguuccccuuugcuggaugugcaggaggacugccccguuccacuccuucaaggguggcuuggucauggacuugguuuggcuaaugagcguggccuggaguggcauguggugcuucuugguagaugugugugcacaccagcucuugguucuccccaugugauacugggacagcugugggaugggaugggcgcagccuguggcaucaagcuugcaugaaucaaggccgcugcuggggcuagcccagacccguaguggguuugguggugguuguuacugcagagcgucccagccauccugacuaguacagcguggagugugucuauguccuggagcuuggggagaguccuggccgcaguccaggcuuugaagaauguugacuugaccuggaauacccaccugucccuggagugcuguguucuuaggcuaguuccguaaccucccugucugcuucuucaucuacacaccauuugaucuuccuuagguuugcuguaaggaguaaaugagauaacgcauguaaagcaccuggcccggugccaggcauauuuaguuaauacguugcguuccuacccagcuagaccuuuuaacaguccauuggcaucaggucaccuacaaaaagguacagaagcugccuuucucugugguauuugcuuuuugauuaaaaaaaggaaauaaaugaucacauaauuguuuuauuuugccuuaaaaaaugaguaaaaaaaaaauguggcucacauaugccagaggugugauaugugagucgucucucccugaggaaggcugcagcugagguugggggugaauuuuuuccccugcaugaagaggggugacuggggauggggccgccucccuuccuaaauuuccgugcucccuguugguguaauuaacuuaggggaaaccacacguggggauucaggggcuucucccuuuauucuuuuccuuaaaaucaaguuacauuuuuuuuugagcaauaaacuuuagaacaaaaugaggaauagaaaacaagaugucgagacaaacaagccuuagcgaggcagcuguuaaaagcagccggacccaaacagagcauaaaaaugcauguaguccagagaagcacuuuuucuuuuuacggcucuaccccguauuucauuuauauuuaaaacugaguugacgaauaugaauacagauauuuagaguuauuguaaagucguauuuguuuaugugcgugguccaguuuccaggccauaucuuacaguuuaaaagggagagcaguuaaugguuucgcccacacugcuuggauuuuuuuuuuuauuauuauccuccagcuccuauucuucaggugugcagcuauuuuaguauuaugaagaaugauggaugaugcaggaaaguuucuuuggaagcacuucugauauugugcaaugcacuugggggucagcuacacuugacugaugcaugauuuauccaaugucccugccacuucccgagauaaagcugcugcuuuaucgaaaaugccagcaacugugauuuagaauuuauaaaccuccguuuucaaauaauuguucugauuacuuucugccuuggcaauaaaaugauaaagguaauugcacacaaaugugagauagcaccaaaauacaauaaaauuaaccugaauuagcuugacuugucgaugagaaguauuuaugaaaugugguguugcaauaagggagggagagugauauuauggcuggaaggugaguuauugcuuuaaugugauacucuuugaaauuuaaaaaagagacuguuucuguugagggugauugugcuuuugaaauuaaguugaagugauucuuauaauuggcaacgagaaugcauuuugaagguaauaucuuuuauuguguuaugccuaguugcaucaccuuuuauuuagcuguuucuggcuucagcuuuucuaauacucagguagaagcagacuuggaauucugucggauccaggggcugaaauguuguauucucuuuguagcaaugccccuggucuuaauguuacagacuuuuuccuccuacauuugauuaaauuguuuagauaucaaagguuaaauauuauagcuaguuaauguuuuuuuaaguuuaaaggcgguuuuagaaauguguuuuguuucccugucuuugugugcacugggaacaucucauuguagccugaugguuucaacaguaucagaucaggguuccaugucugauacccauaguucguaaucugccuuuuacauuccugaaaugaaauuccuggauaauauccaucuacauguacuauuuaaaugaaacacuuuaggagcaguaauuuauaauaaaauaacaugccuucagaacaggaaugcuugggcaggacucugcuagcagacauaacguggcaaucagguguauguaccuggaacacagcagcugcaaauggagauugagacaguuuuguuuauuggacauucaucaucuggucaacguugacauuggugauauaauuuuuccaaaaugguggacagcuuuuguaaaguuucaaagaaaaugaaguucaccuuuccauugaguuacaggauaguuguguucuuagaaaacuuuguguagagaaaaacugugcagaaaauuuuguguuugcaguaaacagaauucuaguuuagggucuuaugaauuuuagauuugaauguguugcaggacaguugaaagugacacagguugcaggacgacacuguuguuugggaugggagaacauucuacauucuugauuccccccuuuuaaaugucgauagcucccacaaccauugugacaacuaaaaagugcuuucaaauucucaauaacccccucuugagaaggacuagagaggaugcccuccagaacauccuccccuggccagauugugauuagaucaggagcuucccagcacccuccugcucagagagccugugccaccucacaugccaccaugggaagccugagauuuugguucccacuguugccugggaauccauuuccaaaugaguggggagagagaugucaucaaagcugagaguccuuggcaauugauuguacuguagugcccuccaccaccuuuaggaccugauuuugucuagccuagguuugugugaaugugguaggguuuuuuuuucugacuugguaauaaaguuuguaguauuagugacuuguaggauaucuaacaaagaugaaguuuuggaaacuaaggccaacuuuggaaaguguuauagacuuaaaauugcagcguguguuucccccuguugacuuugggaguacagcacugguaugcuguuuuuccaaggagaaugaaguauugggaaagaauugcucaggaaaaauauaacuaguaggauuuuuuccagaaauaauaaauggaauugagaaaauugaagugaaacaagauucugugguagauaaauaucucuuuuagucccccaaccccacuuuuauuuucuagucuauugauaaacuguauauuauuaugauagccuacuuugacucuugguuuguaaaaaugaaaguauaauacaggcuuuaugauuaggcuagugugaaguuacauguuaaaauagggggcugacaacauaucaaauaccuguguaauuuaauauuaugugauaaauauguaaaguaaaaacugagauuccauuuuuuccaacauuuugacuuaaggcugaauuuuaggggucauuaaauuaucauggagcucagauagauacacggugguucuuugucuuacucugggugugagcaagcuggucuuuuccuucuuuaaaaaugguugaguuacuuucugucugcaucugauacauccaguaucucaagucuuugcuugcuuauuguacauucaucaucuggucagcauggauauuggugacaucauuuuccuaagaugguagacagcuuuuguaaaguuucaaaggaaauuaaaguucaagaacaagcuaauaaaguuuuuuggcuuguucuugcucauggugucuuauuuccauguuuuccuguuucuuugauuauacugggcaucauauuugagagauugcucauuauucaugagagcagugugaagccugagggguugugcuugucccugggguaguuugaucccuucggucaggugcugagcacaccaacaggcuuugugaauugcucagauggccacgagcugagaccugcagaguggucucucgucugcaguugcuauuuuuuuuuuuuuuuuugcagcauuuccucacuaggccagugguuuucaacugggggcaguuuugucccucaggggaacuuugucaugguagacauuugugguuguuacaacugagggggugcugccggcauccaguggguggaggccagggaugccagugaacaucccacaacacaugggcuagccccacaacaaagaggaauucucucuccugcaaugucgguacugucgugguugagacaguucauuggucucuguagaacuuguuuaaagcccagcuugucccuggccccaccccggauuucccugccuacccucgguucauccauggcaucccauccucuugggcaggauucucuuggugccaucuuggaccccuucuucuguugugucuuucccaucacccuauggcaaaagaguuuuccauuucugugguuuuccaagcaucccacaccuccccuugcagccacauacuuagggcuggugaaguagccguucagucaucucacuggcuccagauuguucuccaggcauccagggggcauuuaugcucaugcccagcgcugguggcugccucgaugcuauuguagauguccaaguccugagcccucggacugcuuucaaagccccagcugcccuacccuguccucccaucucucguuccuauaauccgcucuauccgaaagagucgacuugccauuuguacaacuccauacuucacauuuuucuuuucucugccuuuguacacucuguuuauucaacguacauaguacaaauaccuucuuaaucuacccccuuuaaacuccuaaccauuguucaaaacuccuccuccuaugaaacuuuucuuaguccuuggauuuggauguugucaucuucagggcaucuucucuggguuucuuugagaucaacacaauauagucagggcugugggcccugagcccaucugaauaggaucccagucuucacucugccacuuaggggccauguguccaucaccagguuacuugagauccccaaaccucaguuucccugugucuaaaguggggguuccagugcuauguuaugaugcuuugccaggcuacaguggagagcuaggugaaaauguuccugcgacgaccaguuccugugaggaccgggugaaacaggacugaucuaguguugaaaggucucugugagccgucaggcaggugacguuggagccagccucuccaggguggugugcguggugcugcagucucugcauuuaucccauguccuuggguuuggcuuccagacggaugugaaucuccccucuggagcauguagauggaggacaaggccucuggggcagggguggccuggagacaucgcaguggucuugucugguggcacacagacauuucccaguuuggugcgggccgcccugugcacagcuguccuacagcaucagagcaggcuguggaggcagggccaggcucacugggagcaauggcccugcuggaggagaucuggcuuucagucccuguucacagaggguccugcugaauuggggacaggggugccccaggagugagcucugcaguauguaggaaguccuaguuccggugcugggggaggaacguccugagagugggccggaggagauggggauuuaugagcugagcugugggaagcaggcuugcagagccucuggugagugggccaaaaugacaaauggauucugugcaacuuuuuauuguccagccucacacuguauuucuucgcgcacugcuguguuugccaggguuuugauuguauuaguuacuugugagauggagaaaccuuuccgucucccaaaauaaauauggaucugcuuucaaaauguuuuagcuguuaaacuucagcagcuagcaaacaagccgaaagcuuuuguucucauuccaccacagguuuguagaguuugaaucccagauaaaacauguaccaagccacuggauucugggugggauacuaaguccuuugcagggaggugacgcccuuuguucugugacauuuuuguuuuugaggagucucccauuuccuucucucaccaaguuaguuuucugucuuggguggggcucccuaauucuuagggaccucugguacagcccaguagcaguucucagccuguagguccuagcccguagguagacagaugcuguggggcagggccagcccuuuuguggaguaaaaagcccuuuugcgggugguucugauggccacaccacuccagcccgccuggaagccgccauagagauagcuuucacauaccuggugauacguggcagguccuagaagguaugggugaaggugguguguaccagggguuggcaggggaaggaggaagagaggagucguagggcuggaaaaggagaaaaaaguugaucuucaccuaaaacaguguguuugucaguugagaaaacugguuuuacacuuagaaguuaaagguggaguauaucgagguaaaugggugcugaccucucugguauacaacagauuuaauuuuucuuucuuucuuuuuuuuuuuuuuguuuuuuguuuguuuuuuuauuucuuuugagauggaguuuugcucuuguugcccaggcuggagugcaguggugcgaucuuggcucacugcaaccucugccucccggguucaagugauucuccugccucagccucccaaguggcugggauuauaggcgccugccacaugcccggcugacuuuuuguauuuuuaguagagacgggguuuucaccauguuggccaggcuggucuugagcuccugaucgcaggugauccacccgucucggccucccaaagugcugggauuacaggcaugagccaccaggccuggccagauuuaguuaauuuggaaaaccccauuaaauagcucagaucagauugcuuacuugguugaaaaaaaggcaaagguaauauuuucugucaugaacaagguuuguggauauugcuaauuacuuauuugaaagaaauaauaaaaugaaauucaguaaaaucaaauaacuuggcaguuauuugaaggaagcggcucuuuucugcugggcugcgacuuugaggagcaguugcgucauuuccgggugaagccaagagcccuugccaucaccuggcuccaccaggguucucuguguguuuuccuuuuggguugaaauuuucccuuuuagcugcaugagauguuuauuauugcuacucagaagugccuggaaucuauauugcuuuaaggugugggaugaaguuuccuuucaugaugguuuaauuuuuauugcguucgcauagagcguugccgccguucacaggaugcccaugauagucccgccccucgagacgacaugcaggauugcaccuuccacgcccagcacacaccaggcccugcacacgguuccugugugcauuagugugguugggcuccuucucugugugugugccuggcacauucggauuuccuuguguccuugugcgauuucuauagaaaaagguguguuuuaucaaguggaaaauagcuuacaguaaugguaguuaauuauuuuggaguuccaaguuguuuagaauugaucgaauuccuaaaucuugaguuaaaauucuacucuaggaugacuaagaaagacaugcuguguuuacguguauuuuccaguuuaaccagaggugacuuuagacaaguaauucuguucugccaauuuauuucucuaaguauugucaauuuagcuuuuucaugggauucugggauacagaguugcuugguccauugaaaucuauauauguaauuuuguuuuuaaucaaaccuaacuucuggguuuuagaaagcaucuccuguccacagcuuuugagaaaggucccguaaauuggaugacaccaaauggcuccagcaccagaaugaaaaggaagagcagcagagacuuggggcacccaccugggggcuguuuccuagugcugggcagaauccuggggucaggguuggagggccuuaaggccagauuggaggugggagcauggcaagguugccgugccaggaugcacaguguccaucugggguccuggagcggccuggguucuucccgcagggugcuguccucugccugacaaguccuguucccugucuccucgggagaacaccaguaccaggacuccaggaguugccaggugggggcaucuaaggaaaggaaauguucaugggaugcgccacagagaugaucccucggagaauauuuuccggucuuucauagaggcuaaaauauaacauaguuguuagaaauaugugguuuuguaggaaguuacauaccuuggggaaaacgcuggaauugacaccugagaaugggugaaauguuggaagauguugaacaggugagaggacugaaucggugcagagccacaccugguggugggagcacguugagggccugcgggugcccuugaggaaggguuuugguggaugacaaauaugauaggaaccacgugucuuggggaaaacacuggaauugaugagugagaauggauacauuauuggcucuauuggaaauuauggcugacagaucugaagcucugucaugcauugggggcuugcugguuauuucaguuuaguaauuucauugaucuguaacagauaugugucaaagaguuuuaggaaguugauagaaguguacauauugaugaaaauaaaaauucguaagaaauagaugauggguucagguacagaauaagggcaggaaaauaaaugaaaccaguauaccagaugcaggcaugugcuucccaugaugggaaccccagauaccagacgcagccagaugcagccacgugcuuccugugaugggaacccgguauacuagacgcaggcacgugcuucaugcaguaggaaccccauauaucggaugcagccacaugcuuccugugaugggaaccccguauaccagacacaggcacauucuuccugugaugggaaccugguauaccagaugcagccacgugcuuuccgugaugagaacccuguauaccguccgcagccagacacagacacgugcuuccuguaaugggaacccguauaccagaugcagccuggugcuucccaugaugggaaccccauauaccagacucagccacgugcuucaugugaugggaacccaguauacuagaugcaggcacgugcuucaugugaugggaacccgguauauuagaugcaggcacgugcuucaugcaguaggaacccuguauaucagaugcagccacgugcuuccugugaugggaaccccguauaccagacacaggcacauucuuccugugaugggaaccugguauaccagaugcagccacgugcuuucugugaugagaaccccguauaccaucugcagccagacacagacaugugcuuccuguaaugggaacccguauaccagaugcagccuggugcuucccaugaugagaaccccauauaccagacgcagccacaugcuucaugugaugggaaccccguauaccagacgcagccacgugcuucuuguaaugggaaacaucuuugaauaugccaggaauuaagcagugagcuucuugauggucagaacacugauggcacccaaaguaguugcguuaagccagcaccaagguucuggguuguguguuuuguuuaacacagccauauucaccuggccaucaguuuuuuagugaggagaccuucccagggcuauuggggaucagaugaggggccuagcauauacuaagggcagagcucugaauagguuaacaagagcccuagaucccauuagagcugggacuaguuuuaucugugcaggccuagagccccccuaugcaaaguggcgucugggcuggcagcaucaccugggccuacccacuccugcuguaucggaauccgcauugcacaagcucccagcacuggccgcuguggagggaauggcgcugucucgugguaccuucuccccaaggcuggcugcugcucuuccuuaggucugagucuggcuguccucuuuccaggucgaggauuuaaagccgccuagcucagggcucaguccuggguguguggcuggccaggaaagggcagugaauucaauuugcuaagugucugcucugcagaugcaggaugcuggagauggggggcgcagaaagaaacaggcccugauucugcccucgcacguggugggguagaggcggcgagguguuggcagccaucccugcuuuaauugaccugaguugucauucccucagcgaucaguuucaccuguuugcggacugccuguaguacugcuugcuucuuguuuucuuuauaucaacuuauuuuuaaacacccgcuuuaacuucuuccuaaggaauugcagugagaacaaguguuugcuaugcucauuuuguuuauucuguuacacguuaauuuaaaucuauaguuaauaaacuagugucucaacuaaucucaccaccugaggcguguucaacacccuagagucagaccacagccucccugugacuuccccacaccaggucucuggaagggucguucucaugccuuugagcuucgggucuuucaucaucagaggaauggacugugucucauuugcagggcucuuguaaggauuagagaagaggaaagugagugccuggcaugaaggaaguaccaucaaugucacuaaacaacucuuacuauuaaguguuucugaguugaguuguggcuuagcgaugcgugaagcaguuguugaauuguagucugugccguucagugccuugaauauaaguauauuugauaacguuuaugauaaguguuggugaggauguggagaaauuggaacccuguguguugcuggugggaaugugaaauggagcagcugcugugggacacuucuggagguuccugaaaacaugaagcauagaauucccauguggcccagcaauucuaccccuaaggacauaccccccaaaauugaaagcagggucuugaguagauauuuguacacugguguucauagcagcaucauucacaguggccaaaaggagaacacacacaaacgucuaucugugagugaacagauacauuaaauguggccuauccaugcaauggaacauuauucagccuuagaaagggugggaauucuggcacaugcugcaacauggacaaacuuuaaagacauuacgcugagugauauaagccagucacaaaaggacaaguacuauauggguccacagacaugaggcacccagaacaggcagauucagagaucaaguagaauagugggugcugggggguggggagagcuauuguuaaauggggacauagcuuuugcugagguuaaugagaaaauuuuggcuauagauagaggugauggauacacaacuuugugaauguauuuaaugccacugaauuacacacuuacaaaauaguuaacauaaauauugcauuuugccacaauaaaaauauauuuccuaacauuuaaacaaaaggagugucugggacguuaccucugacacaccugguuauuuggcaccaccggcgaccccuggcugcuggcaggugucuggagcagcagcucagagcaggaggcccagaauccacagugccaggucuaggagugcagggguguggcaggaaacgugaccccgcggcuccucuucagagccucggggaccaccaaggcaguucuugacacuuuauccuggccuugguguucagcaucggaaaacaaggagaacuagaaugucuugacuuucuaaagguuguuguaaaacaagggaaggccaugaugcagugaguuuuaucacacucuugcugugaccuucaugaggauguuggagcgucuuuucuucauugcggacagaggcuuccaaacuccacggcugagccccaguuacagucagugugcaguaaguccuguggguagucguagaaguggagaaaauggcaguaucuuuucucuaaaaaacguuuacaaacagauacuuaaugugaguuugcuugcuaauagguuagguucuuagaguuuaaagaaguaguuaauuaucaaagcuuuuucauucuugacaaccagcauuuuuccucuaauucaggcuaccuuugaaaugaacacugcagaucucugagauuuucaucugugaauguuguuugaagaauucauucugcugcaauuuagauaaaauguaccugcugaauuuuguaauaacauucacaaaguuuuauauuuuuguucguguuugaaauauacaauagagguuuuccucgugauagugagaauauaucaauaugagagagauacaauuauaucaaucaauuauuugaacaaagauuggguauuguuuacauauaauuuuguaauaauuccuauuuccaaggaagaacaaugcacaauacuuugucauugugucauuuauuuuuauuguagucuuuuguuuuuauugaaacauagauuccauguauaaauguggauuuuauguauaucuuuccccguguauauuagaaguauuucaaaucaaauaauuuggccaaaugauuuuucuauauuaaacauuauauuuucauuuaaaccacuauaauuucuccuaguucagucugauuccuucuugcuuuuuugcauacagugaguacuaugguccaaauguuuguucucccacaaaauucauguugaaaccucgcccguaaguuguugguauuaagaguuggggccuuuggggggagauuagguuagugcccuuaugaaagagacuccaaagagguagagcccucgacgauugaggaugcagcaggaaggcgccaucugcgaggaaguggggccucaccaggcacugaaucugccggcgccuuggucuuagacuuccuggccuccacaacugugagaaagaaaugucuguuguuuaugagccacgcagucuauaggauuuuguuauggcagcucagauggccuaacacagugagcaugccccacccggagauggccuugccccucuugcugucagcaucaggacugacagaagcugggcccaugcagauuuuccggaagcugugucagguauugggggucauuggacucuaaccaguacccagcagacagaugggaccugagagaaaggguuggggucugccccuucuccgcuccucagcuuccugcaguggcugggggcaggaaggagggcacaguucaggggauugagagacgugugcugacuguccagcagcagcagauccaccugcaggcacagugcagccuggugucucgucugagaggacacgugugcaggacaggcgggacccacagcugcugcuuccccacucgccaaggccccgucaggagcagcagcugcggcccugggagcccacaguccagccaggagguggugagcacagggcggagugugggguuggggacuccacuugugguguucccagauuugggggauuuccgcaaggccccguugaagggcagugcuccuuagauacagugcagaguccuuggggugaggguccugucucauuacuugauagcacguguccugucucauuacuugauagcacauguuucagcuggcucuuuaaugggaaaguuggugcuuuaguggaagcuccaguccccuagauacagaguguauugcggauauuuaucccuuccuggcugagcgcggggcaguuucugccugcagauuugggcucuggcucuggguuauggaccuuugaauguggccaugccagaguuugugaccuugacgucuugaggcauccuguaagugguaugaccucaagggaagaaagcuagcguggccugcauacaggugggccuguggacuguaaaagcagguuuacuuagcgggaguaauuacccauguugaugacagccucuaacagaggugcagucuucaaauucacauuuaaaugucucugccugcuacugagaaauccacagcaagggaaaagagcaaaacagucuuucugugaagggucuguuuuauuuuuuauuuuauuuuauuuuaauuaaugagacggugaucauccagggaacaggaucuaaacgcagucuuugaacuugaacucuguauguggugucuacagguuugggugugagcagccucacucugugcugguucccagcuuaaacguccaaggaagagcucaugacaguuuuuauauuaguucuuuaaauauuuuauuguaaguucgucucuucccagccccucuugcuauuuuuauugcuccauuugaaguuccagccaauagcccaggcccuuucugucuuugaugucuguauggugggcaagaucucaucacgacccacaucagcuuugcuguuagaaacguguugccacagaggagcacauucauaauugaaaucaccaaauagggaauucuuucuagaggcaguggcugccucagugaaacgugcauggcugagcagagcaaggaagaguuaguggggccgggggcgugcugauaucacaguggcgugggguggggugaagggauacaggugugucccuccucuuacccggcaugguguuuccagaaagcagaugggagagcugugugaugaacaggugagacacuggcuggacccaggugagcugcuauagaagcagaaucaaaaccguguagcacguugccuucccuuucccaauacuguaaagaauuccucuucaauggaaaucuacuucaaacuuuuaucagauuaauuuuaauaaaaagcugaaucaauacgaagcagcuugggaaaacagcuuucccccaccccagcccccaccaccaauaacauuuuacagauucaggcccaguauuucuuguuucuaaugagauggaaggagcgguauucuuggcaccugcucaucuccuucccuuuggaaacucagccagguuuuugucguuagcuuaugggucgcuaauguuaugugcacucauagcagaaauggaaauccgccaucggugaaaguggagaccuuugagaauuuaugcagcaucaaaauguaaauaccaacucuuauagaauauugggguuagcaaugucgacaguucuaccccgagugcgguuggugguggggcuccaauggaaacaaacugguguccagcagucagcugucugcgcauccgucccucccacuccagcuucuccagguaagacuggccaugugagcacagaggguagaagaaggccuuagggacaccuuagaaugggaggagaggucauagcuggagcuccgcuuggggguuucuggugcuccgcccauggcuccuggacagcgaggggcagucuucugaauggaccucagagguccugugguccucuuuggccagagggcacgggcccccuuagcucauuucuaguaaugggauggguggguguuaggaggaaacacgcagcccagcacaggcuccccagagcacaucgugaaucuuucugucgccucccugccccaccucaccucuguucuguggccucccugcacugugccccuccuguguccucaguugccacaugacugacacgugcuuggggcucauuugauggcucuggcaacuuucucuaccucgguuuaccuuuuggcugcccagugcuggaucgccagucugcuuuacuguucacgggaggaagggugucacggcgucacacaugggcauggcaccugcgcuggggcucaccugucucaugaggccguaugucgcacaaggcuucuugagggugggguggccaugagcgagagcgcucgccucuguccuuuuccuguugcagaggaggaaaaagucuggggcccuguuugcucagggugggcugaggcccagaccagcuuccugucuccacacccugacuccaaacccucacugugaccccacgggaaagcauauucccaaauguaacugcgacgccgcagcccgggacugcugauugaaugaaugaguauucuccuuuggguuucccacagaaguuuucccccaguucccuaccaugauggguuguggcuuugucacccgcagugagaauaugcgaaugcuuuagcagauguuguguggcucgggccugccugccuuauuuggagauauuucgcaccucugugggcucccaguggcaggcaucucuggggagggagcgcugucuccaucguccuuugggaggaugugggauggcugcaccgggcaccacucucacauggucuccacaucaggaagcguaucucaccguguccagcauugguguccuggccagaugcucuguuuauaaugauagaaaaaaaauuuuucaucucugaaauuugccaccuucuuucagcagcauuucacuugguuuacuuccuuaauucacgaaauaugugaaaaaacuuuauaaaucuuaaagaugagaaaauucuaaaugauguguguacagauacacacacauacacacacacacacacacacacacacacacacacacauuuggcccuuggacaagacaggucugaacuguguggauccacuuacacuuagauguucuucuaccucagccaccgcagagacagcaagacugccccugccccuccuccccucccuucccccugccccuccuccccucccuucccccugccccuccuccccucccuucccccucccccuccuccccucccuucccccucccccuccccagccuacucaccauggagaugaugaagaccuucaugauaauccacuuccacuuaaugaauaguaaauagauuuucacguccuuaggauugucuuaauaacuuuuucuaguuuauuuuacuguaagaauacaguguauaauauggguaacauacacaauauguguuaguugaauguuuauguuaucauuaagacuuccauucaacaguaggguauuagcaguuaaguuuugggggagucaaaagguuauguggauuuuugacuguguggggcuucaacagcccaaccccugcacuguccgagcaucagcuguauacauacauauuuugccguuuguauuauaguagcucugugcauggggcaugucuccgcaggaagagggacuguccugacucuugggccugguggugauugucuggggcacuccucccagagcccugacuacugacaggucacuucaagaaucaaagaaccucgacuaugaugucauuuuucuguaagcccuggacuacuauaaauuauguuuuaucugucauaauuaagacucggagacuaccaagcugucuucgaggggaaaggccugucccuuucuccagagaaauaauuaauuguuagaguauaugguuuuugaagaauuuacuguaagauaaaagacugguauuuuauucuugcauuuauuaguauuuaaucaaauggaaagugcacuuucagccuggaaaucuuggcuucagcugcaggauuagacugaauuauuguuuaaagaguaaaagguauagaauuauauguucaaguuaucaagccacugauagguuuuggguauaauguaacuaauuuagaacauaaaauuuccugccuuguggacuagagcaucggauuaaucauuuggaagcggggcgcacuuccucugcugcguggccuugcggugagauggagccugucgcuccaggagcacgagaccuuuacggaguucagugccgucaaggcccacuuguccacagccaccggagcauguugggaacaccgggagccgcuggaacgugucuggaacaccaggcucuuccauucgggacacugagucauaaaucaucccaugugucucaugcaagaauucuucccugcagaaauuucaugaaacuuagucuuugcuaaggguaaagaggauuuaauucucuuuguucucaguggugugcaggcuuaaugcucauggguguugacugguggccggcacaucaguggcucguggguguugacuuguggcuccuggcauugcuuugcauuagaggauagccggccucucuacaccaugacuuagaaaauuccagccaggcacaguggcuuacaccuguaaucucagugcuaugggaggauugcgugaagccagaaguuugaguucagccugggcaacauagcaagacccuaucucuaccaaaaaagaaaaagaauaaagaaaauuccagaaaacguuugugacagcaucacuguugagguuguagugccacaggcagugcagcaagcaucugguuuaucugcgugagcucaugacguguucaucagugggcagaaaaagaugggaucagacaaaacagaugcuuucaggauccuucagaucaggauggcaaauguuuccugaaaugggccaggccagaaauauuucuggcucugugauguacagccgcuggcacagcuaccugacccugcuguuagagcugcugcagacaggacccagaggaggaguggggcugcuacccaugaugcuagaccgagguugccgaaacuggagugucccauuguaugcacguguccuaaagcaucuccuuccaucuccuugucuacuccuaccgugcgcauacagagccccuauggugcgaguacagagccccuguggugcauguacagagccccuauggugcaggugcagagccccuacggugcaggugcagagccucuacagugcauguacagagccccuaccgugcaggugcagagccucuauggugcggugcagagccccuaugguaugcuuucagagccccuaaggugcaccuacagaaccccuaaagugcaggugcagaaucccuacaguguaugugcagagccccuacggugcggguacagaaccccuacggugagggugcagacccccuauggugcggguacagaaccccuacggugagggugcagaaccccuaaggugugccugcagagccccuauggugcgggugcagagccccuacggugcggguacagaaccccuauggugcauguacagaccccauauggugcggguacagagccccuacagugcgggugcagagccccuauggugugcauacagaaccccuacggugcggguacacagccccuaaggugugccuacagagccccuacggugagggugcagagccccuacggugcgcguacggggccccuacggcacgcaggcuugccccgccaccugcuguccccggauuccugucagauguccgggugcccagccugacugggcauggcccuccuggaagcaguuucagggccaguucugaucucagguggggauggagagcuggugucugggccucucagagcucaggccccgcacaucgucagagugaccucaccagcuccaagugccccuuuucccucaguuucauuauuugggaagugaggaggucacaccaggcuggacacgggauuucaauccgugugucccccuguugcccgggguggcugcaugcagggugaguucagggaagcucuggaugcagugagcgaggccccgcccagccucuuggugggagucacuggccucacagcucacugcaauucagagaccugcagugugaagauucuuccagauuacuggauggaagggacuucagugaccucauguaagaaaggaagucacccacugguagccucagagagggaaccucuggcagucuggcucacagccggggcuagauucaaacuguauccaagagcagcugcugagagacccaccucaguccugcaggaguccaggcucucucccaggcccccagggaggguguuuccaccugguaccuuggggagaugugaccagagcugcuggagggagcgucuaccugcuggggucagggggucuccauccgcccacagugucggcucaagaagugugugcuguccaccccaggcccagggcaagucccacgaggccgaggcugcaccuugcuguccagggggccgcagcugaggccugugcagccuccccggugcuagugccagcaugguacaggagucgcagcuccaggaggacaugcaggcugccugccaugagaacaucccucugcuguuugcagaccgaggcccaugggugcagaaggaagcgugccggugcagggcacgcagggccgaugggagauggacugaccaguggucuggaccgagcaggcagcaaagggcccugugugcugaacugagcugcugggacuuaaugcacacagaaccacagaaccacagaacguaauggagaagaauuggguaagggugagugggagauaaagaagccaucagaaugcugcugagucugguggggguuggaggucaccggaaauagcuccucccaaguuuuacucagaucuucuuggcagggugcaucuuagcauuuguagaaugcaccaaggaaugccugggaagggcaugggggcccugcaggggucacaggcugggagaggaggggcuuacugccuugggccccuggacacagguaaugccuuugccucagguggccagaagugccuguaggcuuugcagaaagcuacuguuccuuuccugugugggugugugacuccuggacgguugccggagauugcccugaggcuggggugggugcccguccuggagcccccaucccacagugcucuuuguccguaggaucugcgcacacaaggguuugguuguugaaccuggagacacacauuauggugaaucccaguguugacugauuauaucauuaagugggucacaugacacaaaaaccacacguucugaauguacaaauuccaucccagugcagguggaaauuuguauuaaccauggcuuucuucacauggcuucuuugcaaacaaacacuugguacuuugcuaguacaagguccuuccuugguggggagggguguaaucccaugucgaugucuggacgaggagaaagaggaacuuccccucagccaguggacgagacuguccaggcugcuccacaguggccacagagagcccccggcaccugcucggggcaggaauugguggcuuuggccaccuugcuuaauugagaaaguugauguuuccgucagaucuucuuguguucgcacauguuaccuauucucuaagaagucagugaaacuucacccaacuuuagaggcuauaaagaaugagguuauuuucugccaugacauauuuaagcugaagcuucccaagccauaacaguuuuaagaagugacauuucauuuugaacaccagccugccaccucuuuacuccucaugacagacugucacugugcagcgcagcaguuaguugguuccugaagugccagaaaauucccagguugugaggagugugcugcugguggggugagaugugcgacccggcgggggccucggcgggcacaggcgggagacccgggccagagcccuguggggugagcgccauccuggccaggccacacggccggggcagcuucuuucccuucugcaaggcaguuggcauuaucgcggauguuagcauaggaaguucuagcgggacuaguuaaaaaugagggaaaacaugguguucucucauugucuuuuuccuaguaaacuaaaggaaucaugcuugaugaaggcucaaguguaguaugauucaaucgggcaugagacugugcugaggucucggaugucucgggccuggggucagcuugaagagauucauaggcgggucucgaagcccaugcugcugggagggccgggcugccgacguggacggguacagcucccugguucacacaagacuugggguucccuccaccguggaauccgucuugcuuucacgggauuuggggacugugaaaucucuucucuucuaaugcauucccguugucuagaggcuggggagcaccauuugauuuuaaaggacagccacaguccugccagcuccauagagagagcagagguggccucauguucugagcagagggugccaugguauuucugaccaggcgggacccuggcuggacucacgagauugugugaguccacaaugugcuugucagaagccaggcguccuggaguuagggucagauucccaugguggguuucauuacccuccuagagacuggcggggucccagccucuuggaaguguccgcucagacacugccaggugccuuggagguagcagaagcaucucuugauggcaaguguccauugugaccuguguugaagacaaggucugugugagaaggugcacugguaccuacuguguccugaugaccugggagugucgugaagacagagcagccagugaccuucugaaaccaaaagaguggcugcccacucugccuccuggcucuggcacggggacggcuccaggguucuaaggccuaagcuggcugcacuaccucccgcccucaaggacgauuggcaucucuggcgugcucaggccccugcagccuugccaaacaaacaaacaaacaaaaacaacuuguaauuuuucauuuuaucuguauuuugccauuaaaauguuguucucuacacaauuagcugcaggacgcacaguguuuagccuguggacgugucucccagcucugccaugcaccgugcguguacaccugaguguacucagguuugcauacccccgacacugggacauugaugucauggaaucucuucauauagauuuuucuuuggucugcagugacauggcaagugguaaagccuuuuaugaaaccucuuaaagaaacagaugauaguuacuaagaagcuuccaaaaagacuuuuuuuuuuuuuuuuuuuuuuuuuuugagacagagucucgcucugucgcccaggcuggagugcaguggcgugaucucagcucacugcaaccuccgccucccggguucacgccauucuccugccucagccucccgaguagcugggacuacagacgccugccaccaugcccggcuuauuuuuuuauuuuuaguagagacgggguuucaccguguuagccaggauggucuggaucuccugaccucgugauccacacgccucggccucccaaagugcugggauuacaguugugagccaccgcacccggccccagaaagacguuuauaggcucaucuugacaguguucugguaucacaaaccaauugucaguuagagcuagaguugguuuagcuaaacugucggaauggauaugggaguggcaguuauaaucuggaaacauuguuccaaagugcuuuaaguuccagggaauuuuuggagcaauuuguuaaaacuguacacauuuacguuuucugcccuuuucucuaggugugaucuauuucuuucacacacacacacagcaguuuguauguuaacugcuugcugacugauuuccugcuugauugcacagauucaaagcagugcaugagcuucagaacagcguuuaucuuccugcauuacucauauuuaguuccauauauguaccaaagagaagaguucagaaaagaaaaccagauuuuauuuuaaguaugauuuuuaaauguagacaggugccaguuuauaucucaaaaugggugauuuaaagaccagugaacagauuuccuuagauguccgucugcuucugggaucugauguguaggcaucuucacguugguuuuauaaugugccacgcgucagguguuauuucgaugacuaugcugagcccuuuaauaagacgcacgugccuggggugcuucuggaaccuugccaccagggcucauucuuugaccaucccuaauuccccagggcucuuguuguuagaguauucuuuacaaccaaagcaucauuaaucagaaaggugcugugcggugcggggccggcuccgaugacaguaauaaaaaccggcacaccuccuguuccaggacccagacccuggaagucugugccuaagccaagacaugagcagcguuuguggaaugcggcuucagauagaaaccuucuuucaauuugcaggccugguuauguaauucuaaugcagaaucucccccuucguguuugcaugcguguagccggguucacagaacuuuagccacaaacaggaguguuucccuuuuuccagggcucccguguuaggcccccaccaggaggcuuugggguggcguuugggaacgccguuuggaucccuucucaguuugacauccuagguggcagcuccaguuuuguuuggugaaacgauuucaauguaacagaaccccuuucgguugugagagcagaaugaacugagccgcacuugacugucuugugcuggaugugacccagccgaauccacggggagaccccugguuacagcggggaccacggguggggucucagccguggcccuuuauacuuggugagcaucagccacaccacguggccagguuuaugaucaggugauagggaugaaguguuuuugacacaugcuuuucuuuuuuuaaauuaaaauacuaucucaugccugauuuugaggugggcugagcaugaguccugaggaugagaggggcuuccccaaugccccuuauucccuguucagaagggagauugcaaagcuaguuuucaucuugugaugucuuugugggagguugugaggcagucagacacgguccucuuccucccccaggugagccaaucucccccuucacacagacccgaagcccaggccacaagggaccugggcuaccuuguuuguaaacagcuuacaaggaggcuggugauuucucccuuuuaacauguucguuuuuauguuuuugagguguggucucacugugcugcccaggcuggucugcaacuccaggacucaggcgauucucccaccuccgccucuggauaggucggaccgcaggugcacgucaccacacccggcuagucuguuucuguguguuuucauugcacaggauaccagcaguggaaaugguuaagagggaaagacacagagcugcaaagaugguccuggaaggacgguuuuuagaccugacaguuuuuagugcagcaggccuggaaaacgacuaccaguaggggaaaaagaagaguuucuguuucugggucucuuccuuuuaauauggcaggaacuggccucuggcgccaacugcuuaauucagaacauuguuauuuaaacgccauucauguuaaaagggagaugaaacgaaauucauuuuuccagaggucuccaaauagccaugaaaaauaaauuuuuuucugccaccaaguaccaucagccacucaugugguuuagguggaugccgugguggugccgggagcacuaccagccuguggggccgugggcuugugcuucgccggagugggaaguggggacauuaggaagcccgacuguugaaucgccugggcguccuaaaugugggcuguguugucgucccugugcaagccugagaggcagacagcacugaguccacuggaugccugcuugucugguugccccuuagacuaugguacucucagcaacacggcugucccauuaugugcacaugcccuguuacagcuuuuggagccccccuuaggaccgaugguucgaauucuggaaguccuaaacauuugggucuuccacgucgcuguuuauucugcagauuugaggcuggcguguuugaguuagacgggacacuggggcugcccgcuuuccuuugaugguacgccgagggccucucugccccguguguucccugagguuccagugggcugcuucagggaaggcgggccgggaauuccucucuguaagacaggccccguuuuaugcagcugugaaccuugugcuuggguguaguagguggucggcucuuuucuuuucuccuguucacagcacgcuuauagccagagcagacucuaugguuugccuggagagagcuugcacacacaucgucacccugucucuggugguuguggcugcagccucccagacgccucucccuguccccacccuugacacgccuggaauccguguucucccucguuucuccgacuucaucccaggacuuggcccucacggcuccaggagcugcugaggcagcuucaucucaaagccagguccucucccuccuggugaccuggccaccaccuucugcuccuuaaugcucugugcugcuuccagcgccagugccuuugccugugcgcaccugccugccucagucucuccucuccuccuccucuccacccagaaaacuacaacacuaucccuucucucucagcaccuccuccaggaagccuuccuggacuccccaggacauccaaccccuugauacaggcucucauuaauccuggaguucuccuucugaauuccuaucucaauuaucauugcaugauucauauaauuagauauuuuguucaacauauauuugcugagaaaucgugggugccaggcacuguuauucuaaaugcuggggauacagcaguagaucagcuaagacuacucugguuugaagaaaaaacaggaauuccucagaacacagacuugaaaccagcccaacguuccuguucucacacaaggagaagccuagccagccauggagagcugcagugguauaguggccauggagagcugcaguguaguggcuguggagagcugcggugguguaguugugcuucucugagaaagugacgucugagcaugguugugagugggaugacaguggccacugugcaggcugggaaggagacagcaguagcacggaggcugugaagcgagagcgaggcuggagugugaggggcaguggcggggggagcgggggcgugggugcgauggggucaugggggacugaggccagagaaggaaguguggcccugccgaauuugggaccauuugggcuagggggcccccaaagagaccugccguguggagacuagccauggagaaccgugguggcggaguggccguggagagcugcggugguggaguagcucacaguguugggcccugaucugucaaggcuuuuggccuuuuccucaugaucacuaggugguugccacagcuccagccaucacaucugccaugucaaggaaggaaggguaggggauggugccaucugacuuuagaaaaaguauaugaaaacaagaacucucugcaggcuucuccucgcucuuuggcuacaguugugacacauuugcugccuguauuggagcuuacauucuagugaaggugacacaacaaguaagcaaaucacgucacugugauuccaggucauguaaggaaaauaaggcagagaaagaagggguggagguggugacuguuuucggcggcuucucugagaaagugacgucugagcaugguugugagugagaugacaguggccacugugcaggcugggaaggagacagagcgguagagcggaggcugugaagcgagagcgaggcuggagugugaggggcaguggcagggggagcgggggcgugggugcgauggggucaugggggacugaggccagagaaggaagugugggccugccgaauuugggaccauuugggcuaggggguccccaauuuuuuuggcaccagggaccaguuuuguggaagacuaacuuuuccacagaugggaguggggggaugguuuggggaugaaacuguuccaccucagaucaccaggcacuagauucucauaagaagcguccagccuagaucccucccaugcacaguucacaauaggcuucacacuccuaugagaauuuaaugcugccgcugaccugacaguaacgcuggcucacccgcugcuuaccuccuccucuguggcccguuuccuaacaggccacggacuggaccccugguuuaagccauauccacaggaaguguuuucucaucgugauggaaaugaagggaagaugugaucugauuuacuuguguguguuuucauuuuauucuaaucuuuauuuuuuuaacucagaauuauuuuacaccucaguuuuuauucagaaaagcauuaaccaucauuuguuuugcauauaagacauggugagaucacaauaaguggagaauguuugccaucguuuuucuacuugacaucaacaguguaacauuagcuuuuuuuuguauguuauauuuacccauguauucauaauuugggguacucuuuauuucuuuguauagcucucauuuuucuuuuuccuuuuuuuucuuucuuuuuguggggacagggucuugcucuguuacccaggcuggagugcaguggcacuaccguggcucacugcagccucgaccuccugggcucaagcaauccuccugccucagccucccgaguagcuggaacuacaggcacaugccaccagccuggcuaauguuuuuauguuuuuuaguagagcugggguuucgccacauugcccagacuggucuugaacucgugggcugaagugauccuccugccucggccugccaaaguucugggauuacgggugugagccaccaugacuggcccagauuggauauuaauacaguuuuuuucuccuugaaaaguugacucguacuaacuguagaaagcugagagaaugcagauaaaaaaggaauaguuuaaaucauccuaccuuauuugauuuuuuaaaaauaaacugauuuuggaauaaucuuagauuuuuggaaaaguugcaagcaacguauggugugguuuacuuuuuguggguaauuuuucuccccccaggagaucacauuugucuccuuccaguuucuggcaccuuagcccaguagcuccuguguaggggugcuaaggcauugguuaaacgucucuugaucguuccugguuuguuucccguuauuuugucucccuuuugcuucuccccugguuggguuucuccucacuucucaguggguuauuuccacaaucgaccuugguucuggaccagucuugacagagcugccagagggagccucgaaaugcaaaccagcugcaucuccucuuguugaaaacucuguggcuuuucagggaaaaggcagccagcaggaccggccuggccauggcggccucagggcccgaggguggcugugucccccacgccucuccaggcacaccaggccucaucccccagcucucguggcgggugccuucacccuggccugcguggcuccucgcccgggggccccuccccauaguucaguucucuguguaggugucaguuucuccauaagcucucagcugcccacacucuccccccgaaguguggccccagcccugcggagugguucccuaaccgccacucugcccaccucgugcuagccugggugugggcuugccugcuggcucugggcucaggcuggggugcugucaggguugcaggggucacagugaaucuucaucuuccgugggccaguccccuucccagcgucccuccuggggcugugggucuggccucccccguugaauggcccucucuugagguuguugggcauuggugaagauccugauggggucucaucacuggagucagacgucuuucuuccugggucuggggcauggcgguauuacugugcgggcuguugggagagggucuguuacccucauggcugcuugugaccuguccaggccaccacugugccagccuuuguguggcugguauuguggcuucuaaguugagccuccgccuggcuggguugcgaugguuucacuccugucagguuuucaugcuauugaaacucacuuuucucacugccugauuucugccuuuugugggucccuccugguguccgugaugcccucauuuagucugcaggcauccccccaccucucugcucgcccggugugcacaccugcuaggucagcccugggcaucgcaucagagacgcugccgugcucgguggccuggggcuucuguccuguagaggccucagccauugcauuuuaggaaucggcacuaaacuaacuucuacugcugcccacagaagaacugugccaaaugcucugguugucuaccggaaaaaaagguaguaugcagguuucaguggcauaucaaauuccauuucugugggccuuugugggaggcuugcucuuagcgggggcugguggggguggggggggguggggguuuguggggguggguuccagcucauuguuguguucaggugaaaugaggcagggcuuuauuuugauccuauuuagguuguaagcaggucugaggaauucacuuccucaugcuucacauaccuaaauaauuagccaguuggauauggacaggagcuggaaucuguugcucauuuguaagccagauucugaacucauucauuguugcaguuauaaacugguugccuuuuuucgguucuuggaaugauuuggauggagcucaccugguccccccagcucccugcuuugugauugauucaguguguucccauggcuucaggccaccuuugcuggucaggggagcugguucagagggcuugaggccagccugcccuuuggaugagaggcccaugccaugaugcuggucauggggauagcaccacagggcucagucggggauaugccagagcuuuagggucccuugggccagcagcugggguccuugggcauuuccuggguggcggugcucucuggggugcagaguuggucauuccagggcaggcaguucacuuggccacaccagguuuggcuggaagccuucuccaccgcauucccaaccgcuggccucccaaguuuggcuucuuguggucagggcccagaccaugauaaccuugaggacuccucucuccgggagacugucggggcuaagcugccuguggcccuccaccgcccugcuccuuccuccgggugggggacaccccaucccccaugccccuacuucagcuugcugggauucacccccaguggccuuccaaggcuccuaccuuucucccuggcccugucucugcacacuccaaugucuuccccuuuggcugacgcuuggauugggggugaacucgagguguggucugugcagaauggcgugacagcccuuccagcccgucacgguguguagugcccaaagcccuggccguggccaucucagguuagacccucagaguggcacugucagguagaggagucaggggucuuauugaugaggaaauagaggcuugagagaggagugcgcagcuagugucugaccagcccccacauggggcacuccccaguccgaaugucugcagugcagcuucaggcgcugaugugggcaaacccuuccucucccaggccgucccuuccugcagcugcucggacacuggcacauguuggcaggcgucagcaccagggcugggcuccugccugggacucgaaucgggagcaggucccacggaggcagagcagccgagaaucaacgguggccauagccaccacauccuguuuccaggggcaaugguggcaacagugccagcugcccugccugcugugccugguugccccacagauguuuccugaagcuugauuuuggcugugauuggagcguggccaguucugguuccugcuauuuucugagccugcuccuccagccuucccagaaguucuuugaguuguggaguagccuuucaguaaacggcauuugugcuuaaauuagcccgugucaguuucugacaccugcuguuaagagugcuaccugaugcaggugcucggggcuggccaggauccccaccugagucuggagcccugagcccaggccuccugacuccgacagccugcagcccugcccgaacugggaugauagagcagcaaacauggcuccauggagagcgaaacccaagcugggcuguuuacugccagucugcugggagcuuugacccaccaucgugcagggcgaguuuccaagaaauggcgagagagcauccagauuucucacguugccucuagagcccuguugucugaccaguaucuucugugaacauacuuugggaaaugaucucauggacgcuuggccuggaugguggucacacugguaauucaguuccacaaguauuuuaugagccccuugugugugugaugugugcuguucuucagggagcccugagcagagcugccagcauccugccugagaagcaguggcccgggauggugggagaugucugcaggcgcagggcggaggcugugggccaagauuguggcucugagaaauggagaugggagaaggggaggcagucacuuuggaagaaugggcgggauggugaugauuugaaugagacuugggggaguuggggcagcguacuccaggggauaagaucagaggugaaggggguugggcuaaaauguugaucauggugggaacaguagugauccccaaauccuacagagccuuugggaagccuggucuuugcauacguucccucuaaacucgugccgacguugugauuuggucugauuuauccuacagacaaagacaguugaagcaccaagagugauuuucucacagcaaagggacagagggugggaggccgugauuugcacccccugccuuuaucuggccccugccacaugguaaguggaaggcagguggcuccuuccacagggcucucuuugcccucucgggaagccugguuuuuacccuugaggcagcagggaggcugcagggugagauguugaaggagugugaugugggcagagccucugugauggggcaugguuucuggcacaucccauuuccauauucuggggugaucgaaugggauccgguucaaaucccugucagucugcacagaaaaggggagguuuugcaggcggcucuggagugugacaguugaggauugaaucuugagaguaaugcuucuacaaaacacuuguguaguuugcgguccgcugcccgacccuggucccuuuaagggacauaaaugcaccucucucuccucguucuuggaaagacagaugagagaaccaaagaguggccuuagaagcauauguaagacacagaaaggaaagaucagcuggagugcuggugaaggguuucacaggauaggagaccaggcagcaaggugcccagcggacaagcagggagggggccuucagugaaggcgcagagauuugggaugcaugugggauucagaccugcuucauugugggaacagagcaggaaggugccagugagcugcccuuccaggggucagcagaccuuucuguagaggguuccagggguccgcaggccuuuucuguagagggccagagagucaguguucugcgcuugcagggccacacugccucugucacaacugcucaccucugccacuguagcacggaagcagcaggagauuguguguaaauaaaugaacacaauugugucucaauaaaacuuuauuuacaaagacaggugcagugagugagcuuugccccacaggcucuaauuuguugccccugcuccagccccuugauguagggagccuuugcuuuguuguucucagugaacuuugagggcugaugguuggguuggaguggaaagagcccaggugugaugggagccgugaggauggccuuccuugaguagccacgagcugcugugggucuuccugagaagcuguggcaaugggaggacagagguaaaauagcaagacccagugccuaaggaggcugaagagggaggaucgcuagagcccaggaguucaagacugcagugagcuaggauugcaccgcugcucuccagccuggguggcagagcaagaccucgucucuaaaaaaaaagaaagaaauguacaaguguaaagguagccuauagauguguuccccuguauuccccaggcucuauucuucagccuccugagcagcuggaacuacaggugugugcuaucauacccagcuaauuuuaauucuuuuggggcagggucuugcuacguugcccagucugguuucaacuccugaguucaagugaucuuccugucucagccuuccaaagugcugggauuacaggcaugagccacugcacccagacuuguacaucucuuuaaauguaaauuaaaugugcuuuccacagcauuaguggaacaccccagcauugcucauccucuccgggcuggcuccuaacacaggugccguggcauaggugcugaguugaaucucuguuuuuguaagucauugcauacaugcuucauucuaaaauguacuuuauuccaaauauugaacaguuugucuucgggauuuauugucugugguaguuguuuuauuaauuguuuuaguaaaacaaaguuagcuuaguugugggaauuauuuaaaaggagcucuuaccaggucagcuuccuucgguguugcguugguuaaagauaaacgagaagaaucgggauacaguaauuuuaggaaauaaaaggagacuguaguauugguuggcugcucuagguaauggugguaauuuucugucuucagaguaaucauauugugaaaaugaugcaucguauaauuccaaaaaugaggaagagcuuuggaauauauuuugugucuuaaauaaccaguacuucuguuguguguuuuauauacgaccagccucuuaccuauacacuuugucuuaaaaauuauuucuguuuagguacuuggaaaaauggacaaggauugugaaaugaaacgcaccacacuggacagcccuuuggggaagcuggagcugucugguugugagcagggucugcacgaaauaaagcuccugggcaaggggacgucugcagcugaguaaguaugagcccacgugauccuguauaccgcacaugcugaagcaaccgaggaguauaugugauaacggcauguuuuccauugauggcaggguaacgcauagccuuacccccacaaccgcaaccacgaguccgucucucaaaacagugugcugcgacggcuccugcauuugcagcuucccuguguguugcccaggagcucuccaccuccgaugaacccagggccguucccuucauacccuuucauuaguagcucuaagauguuugauuaagguguacguuuacagaggaguugguuggugaugagcauugaacauuuggguucuucggcauaugucucuggaaauuuagagacagggagaugcaggauuaaucuugauuaaaaaaaaaagcccagaucagcguucccuguuccuccagagucugccaggugaguuucauacuaggacugcuugauguucuggaaucccuuaaccaggagucccaguugccuuuugagagccguggucagacccuuggcgaggguguggcugaggauggcccugccagggggaagggcccgaaagccccuuuucagcaugacuuuaaguucuugucauuucuaagagcguacauguuucucuuuuugugaacagcucccacuauauuucucuaauugcaaaaacguaagaaauguaaagcauuccuuaguguuuugcuuugaaauguaacauuuaauuuccuccguucauucuauuaaaauuguagcucuuguuauuucugaccaaagaagaagaagaaaaaaaaaacacccacuccuaugcuugguguuucucuuaacuggcuaauaaacacaaugccaagaacauuagauaaagaaaauacauaagaaacauaaaaauugauuuuaaugggccccuguccgagacagccauaaugagcacaagcgcagucauaaauaucagcacucgccuccgcugucgagauuuuuccuguagagcugcacguuacaaucaauauagucuuuuugagaccaaaaaauaagcaaaccuuugaaccaugugaauauacucuuuucaguuucuaugagaaccaucuggcuguaguguucagaaagucacaggcaccaaauaauuuguaggggaaaaugucauuuugucuuuuagcauguucaguugcacaauaaaucauagaaauuauguguugguuuuuuuuuucuuuugggaaaaagguacaaagugaauuuggggaagaaaaaggaaaacaaaacaaaacaaacauuauaagauauguuuaguuaaaugcccauuguggauuaggcaaauaggaugaagacgcuuaauuuugaauuucuacuuuaugaacuuucugaaucaaguuaggaucagguucagguguaaaaacagccgugaaauaaugcuaaauccugaauaggaucuggcugauugcucucaugaaaacacaccuguggacaaaccaugggagcuggggcuggugccuucauggccccugggaacuugggcuccucugagcuuggggucuccagaugguggucccugcccuggugcuucaagacagcuccugggccucugccacagguaggggagaaagaaaggagggcgugucauauaugggcuaaaauuaggugucuugugaguaaggaaggagugggauuuggggggcagccagcaguauuuguguguaguuaauuuuaguggggggagcauuuaaaaguuugagaauaguauauaaaaguauaugaauagucaauuaaguuuaacauuuuaucauuuuuaaaauuuagguaaaaauuacauagaagucagauuucaaguguacaauucauuugacaaaaguguacaaccguauaacuaccgccgaagauauagaacauucaagauauggaacauuccagaaaauucccuugugcccccuaaaguuaguccucuuugugaauuuuuguuuccauuucuccagaguaaauuccugaguguggaauugcugggcuggauggcaaauguauguuuaacuugacaagaaauugccaaaacuuucuucagagcgggauggaauuuccacuagcagugugugaguuucaguuacuccacguucuuggcagcacuugguggugucaguuuuucagauuuuagccauucuggcugguaugaaguauaucucauugugguucuaauuugcacuuugcugaugacuuauccugaugaagucuuggccauuccuauguuuucuuugugaaauaucuacucaagucuuuugcccauuuuuuuuuuuuauuucuuugagauggaggcuugcucugucaccuaggcuggagugcaguggugcaaucucggcucacugcaaccuccgccuccuggguucaagcaauucuccugccucagccucuggaguagcugggauuacaggcacgcaccgccacaccuggcuaauuuuuguauuuuuaguagagacaggguuucaccauguuggucaggcuggucucuaacuccugaccuugugaucugccugccucggccucccaaaguacugggauuacaggcgugagccacugcgccuggccaccuuuugcucauuuuaaaauuagagguuucuuguuuguguuuuuguugauguuauugauuugugguucuggauguaagacuuuugucagaugucuguauugugaugauuuucucacaaguuggaggccugcuuuuuuguuuuuccaauagugucuuuugaugaguagagguuuuaaauuuugaacaaguccauaugucuuuuuuucccuuuauguuuaacacuuuuuguguucccuguaagaaauauuugucuacuguaaugucugaaauaaauucucccguaauuucuuuuaaaagcuuuguaguuuuuuuuauguuuagauauaugugauccauuuugaauuaccuuuuugugagguacagaguuuauuuuuucccuguagcuauuuaguuguuuuagcaucauuuguuggaaaauaaaaauugucuccuuucuucauugaauuaccaucaguugaccaagggugugugagccuguuccuguuuugcucuguuugguucagccuaccuuugccuguucuaugcccguuccaugcuggcuugguuagguagcuuugugauacaucuuuuguuuuguuuuguuuuguuuugagacggagucuugcucugucgcccaggcuggagugcaguggugugaucucgacucacugcaagcugugccuccuggguucacgccauucuccugccucagccucccgaguagcugagacuacaggcgccugcugccacgcccggcuaaauuuuuguauauuuaguagagacaggguuucacuguguuagccaggauggucuccaucuccugaccucgugauccacccaccucggccucccaaagugcugggauuacaggcgugagccaccgcgcccggccugugauacaucuugaugcuagguaaugugaguccaugaauccucuaaauuuauuuauuuuugaaagguuuggcuucuaugucucuuaaguuugccuauuacuuuuagaauucagguguaaauuucugcaaugauucuuuuuuggauuucgacugggaguucauugaaccugguugucaauuuugggaggguugacaucuugauacugaaguguucaguucuuggcuuugacuggcgucugcauuuguuuggguucuuucauuguccucggcagcguugagugguuuuucagccuggaggcuuugcuuaucuggcagacuccauuucuaaauacuuuguucuugaugguauucuaaauuagguugaaacuuuuuaaccuuuuaauuuauugcugcuuguguuuaacaacugacuuguauguugaucuuauauucugggaucuugacuuaauucauguauuuuuuccaggguuguuuugagauugcuuaggauucuguauaaaaauucaugaugucuaugaauaaagacaauaggcuucuuccuuucugauuguuaugcuuuaauuucuucuauugagcuguccagaacccuccaggaugacuucaguaaguguggugacaacagacguccuucccuguuuccugguuugggggagcuugcaggauuucaccagugaggacuugcuccccauguuggguuucagaggcgucuuccucacuguguggaauuuuugucaaaugauauuucauguauguguugacauagucaugugcucuugcuccuuuauucuuuaaauuugguagaauaaauuuuuagaauuuuaaaccagguguauacuuuucuuuuuuugguacugucuuugucuuguuuuggaauuagucucauucugaugacagaucaauuuggaagcauucccucuucuauuuucugaaagaguuaaguguuggauugauauuacuuuaucuccaaauuuugggaugaaugcaccuuggaugccaucugggucuggugucagaagccuuuugugaagcuuccugguuuaguagaauugggugcugccuucccucaucucggggugcucccaccuggagccaucugugcucuguguggcugcuguccucugguugcugagugacaguggcugcugggauuuggggcagcauccugcuggcucuggccccugcccucacccuucuccgagugccuaugagucccagggugguccuugcuuccucugaauggguguuucuuuaguagauaaauuacagguugaccacugggccuucuucagugacauugcaucugugcuuguguacaaagugugauucccgcuccccaggugaauccacuuaccuguguguggcuucgcacggggaccaaugacuuccuugcauaguuaccuuucccucccuaaaaacgugugagaagcacaucaguugggaaagugguauauuuuccaaaagggaagcaacauaagcugcuuuuaaguuaguuucauaacugccugacaguaucagguuucugugaaugccaucacguccaggagcacuuggccucugcaagagcggagcagcucccccgcgccaucuucccgcagcugcagagcucugaccucgucagauucccugcagugcccacagucuaaugagaggggccaggcuguauguguuuacuuuucuaauguuauuuuggggcuuguuuaguuuuccauaauguugauugccguauuugauuacuugaaaaaauggaccguaucacccugggucauacuuagauuacaaaaauaguagcaguaggacuuguagaucuuggaagcuggggagcuaagggggcucaucuuucacuuaccaagggcuuacccuuguuuuucauucuuuuauuuuuuucacauaagccuuuucagaaaaauauaggaaaagcugauagaguccaauugaacuaaaccacuuuaaaacuuuuuguauuuuggaaaauguggggacuacacacagacugucuucuacugcagaggcucuuuuucugucuucaugguagggauccauuuacaggguuugugggucugcuuuuggcaucuggcccagccagcccuuggauugaggcuggguggggcaugcagguuggcccugacccucuucugagcaccuggcuggcuggacagauagggccuucagucaccagcuaggcuggccugacccuagacccucuggaacgugagaacguauccugccgggccucuguguugaaccugggaggagaguugucugaugucauuggaugcccuaugaguuucugcccucgaaacgugccccauggaaagcgugaagaugccuuugagcuucccgaagggcagcugcagcaggaggugaccugcguuuugccucucuccugcucaucucuaaauguguucaggaacucagucgacccucagccgugcauggggucccggcuggcuugguaugugcaccugccgagucugugcugccaguuauccccacggccucuccgugcaggucggucugaccagugccagucggaugguuccucaagguccacgggccaugagaaccuuccugggaacuucacgaauucguuuuuuucugacagauugggaaauuaauacagacacuugccgcauucacguuacuauaauugaucuuucaaggaggagaagaaacuguucuuaaggacaaacacuuagagaagcacugccaguaaaaauaacauccaaaaaaacgcgcucuguaggacuuuuaccugcggcaaguucggcugucucauugcuuuuccucagugccgugaaauaaugauuuguguuguaugugcuuaaaaaaugugauuauuuuacuuuauagaguguuccuuaaggaggucucuugagucaaauaagcauguuucugugaggaaaacuugccaggcgcuccuuggcuuuauagaaaucgucuguuuuucaaaaacgaauggcugaaugcccuggcgagccuggaaccccuuguucuugccccugcuggcucugcgauuccaugucggugaggccuguccacgcugacggauguugccucccguuucugccugagagggguaaaugaucagugguggauagggaguuccucuugugacuuauguuaucaauaacacaaauugugcauauacuucaccccaugcuaaacauuuauagugcaguguccuuuagaagccagacaauggccucgucuuucagguugauggcuaaaaagacaagacaggaagccaagguguuucuuuucagcuccacagauccuugugaugaauuauguuccgugacgagaggguacgaugggggccgacugcuggcccccggacacacagugcugcacauggggccugcagagguguuagcguagcccgugaugguggcagcucuuggaccuuaguaaaauaaagggaagcagcauaacauaugcuuuuaagugaggguauggcgugaaaacccugccguugugugauaggagacgggcucugcaggcugagccuuccaagucgugaaugaugagguuugcugugcuccucugauuggcagcugaaagggcaggucagagcuccucucuacagcacugcggagaaucccaggcuguggagcacuggcccauccaccccaggacagagcugccucgccacagaagagcgagguucugggauucacugugaaauuguuguaugguuucugaucuagaaaaucaaaccuaaacaaugcgcaaccucaccagcuucggugcucuugauguuuucucccugcagcugguucuuugcugaccugggggcagaguagacagugguggcagccagguggauaguauuuaaacaagugucacugagauuuaggguccuuaugugcuggacucaucuaagaaaaaaaaaagcaaugcaaaaguuuuauuucugucaauuuuguaacuguguuacaaggagacagagauggcaaacgugugugccugugucugugagucagaagcaaacuuguucauuucauuuaauuuuaagucugccaggaacuucuuggaaggaagaaaagaaugguugaaugacagcuacaaauaggugaguucagaauaugauccaaagugucagagcaaaagauuuuuuaaguuuccaacauuuggaguaaaagagcacuuuagaguaacagguaaauggguuaacuucaggcagagagagguggauguuucugccucucugguauguuaaaauaaaaccccuuaaauccccugcucuuaacaauaaguuuccauuuaagagucauugggcuucaccucuguucggcucuguuugugaagggagggcagcuuuucuggggagaucaugccccucucuccuuuauguggccacagagauccuuucccuguuuucaugaggaggaaacauggaaccuuggcacaauccaguucucaucuagaauuacauuguaugcugugcaggccaggggaggaaagaucccggaaguggcagccaccggauaggcacguugccgccacagccagcaucggcgucuguucagguuucaggaaggucacuucuuggcucaaaucccugguauuuccagguugucuucagacugcggcuuucacccucaggaagccccagcauggccuugggcccagcuuagaggcuuguggggguuuggguguagccccgugcacaguauccugucuaggauucauaaucuugcaacagccaucccugaugggauuggguaagaugacaguguccuuucucgauggcccuggugcccuguggaguuggguccuggcccucacuacccuguugcgugggugggccacgccccuccugcugaucagccucuguugcagagagucuggcccuguggaccccugcccccggccccaggcccugugucugcgcugggcuugcauugccugccucucgguccccucgccucauugcaguuuggugcuucuaauuaguuguggucuugaaaagcuggugaacaggcuuguccacauuguaugggaaauaagguucaaugaaccccugugagaaacgccaagugugggauuucugacaguaucccacagaaacaucucagagcccauuucuguuuccuccuggagucucuguuucucccagaagaggcggcguggccaggggucaggcagaugucaaggaagugaggacucggagggacuggcaccuguggaauagccccugcuucgucugucuggccuggugggaggagguguccuuccgucacugcacuucguccuugggaccccucugugaaguuguuggcaucaaugugcguuuaccaauaagagaaauggagauggggugagggaugguggguuacaaguccuggggaagacuucagggaagaaguggguauucccucuacuuagcugaacuugcaguagagacugccacucugggagugacuucuguucuccugugaaauccucugugacucuugccugcaguugagggagccucugagaccauccugauugggauuuggucagugggaacucaagucaguauuguccugggggccugagugccagugucuuaaaaauagaguguccuccagguaauguuggauuuggaaguucaggcucagcacuggauuuguccucgugauaucacucgccuacuguacacaugagucauuguaaaguuacgacaugagcucgcauacgugcugguauuagagcuccuuggacggugaugugcuguuuuagaggagaaaaagcugagaugaaacaaaaauggugguggcaguuacccagggccacgucuguggaugccauccucaggaugccauugcaucucgggccagccucccucugcuuuugcaaaagcacaaccgucuggccucuacgaccaccaacacacaccucucauacucuggaauuugauuucuggaaugcuuuuuuauucuuccuauaucuguaagauuuucugauauuuaaacuggcugcaacuaaugaauaguuuucaguuuuguuuuaaaaguguucaugucauuuaagcucuaaacucucacaauauacuugguuuguuaaauguaaaauuuuaucaguaauuagaucagcuccuugauauuaauguacaggguagcucuugcgugcugaucaguucagaauuuaaauugaguuaaagguuaaaugaguuuaauuuuugaauugaacugaagcauugucuuguggcaaauucauccagaauuuuuauuuccaguugcuguacaagugacggaagugggucuuuuugcgauaaaaacauugugaauacauuuaggauucagugagcuucugucauuuacucgcucauucucuaaacgugugagugcccugcuccgugucagaccagauggcaggcccugcaugggguggggaggggccagaaugugcagccccaccugcagcccaagcccagcucaggggcagacaggggcagacggggaagugggcuguuccacaccuugagauuggugaauuccucaagacagcggcuggcaggggcccaagccuaggugacuggccacagagcugaauggggcugaccgaguuaggacaucacuggguggugaaccaggaggcccuggcugcugacaggauguaggggcauggagggguagcagaaggaggcaguuaagaggcugcgagcccccucuugggcaucugacgggguggugcuuccucccagggcuaggggagaggugagcaaagaauaaccucaggaaaagaaauaaaagaccuggaggaacaguuuaacaaguggguggccaugaagagcuaccaauggagacugaaggaaaaccaagaaggaccagagagagaauggagccaggaggcuggaaggagagaggcggguuuugugucaggauugcccagagcuccccggagaggagcaucucuccucuccauggcagagcacagaggguggaacacugacgucagaucuucuucaggcccugaacguaagaauuccuugguaccuggucugcuuugagacugacaugcuguguuugauuaguuugacuucgggaugccagcuaaaugcuguuugcucagcauaugccugaacuggaaaugguuccaucacaaaacaaacugaaucaaauagaacguggggguggcucaguggggacacagagccagaggugagucuccuucaccccaaacaccccaaguucuagauuuguucuuggagcucugugucaggguugggguggacaggagggagagaauauccuccgcagaaacacaguuuaucacacugcagaauucuuaguguucuucugacaaggacguuuguucaguuucccucuagacugggccaugcucucuaaauagaacugaaaucauaguuacaacucaaaggcaguugagagaagaguucuagcuuuguuccauaacguccugugucuugauuucacuguaucugucuguucauccugcugggggcguuaacccaccucuucucguacagggucaucucuaguuucacugaggaccucugagaacccuagucccucuguccauacacaucggcaggagacucaccuccccccuuuccuccuguaccccaucugauccacaugcacaaaacacacacaugcaaauauuuaaaaguagaaaggcuuauggacuguaugacuucaguacaccugcagauucauggagugguucuggagaacauugguccuucugccggccuggcagcuacuuuaauuucugguguccauuggcagaauacaagcucauagugugugcugggggcuggguggggcaggggauuaccguuuucuugcagugauuguucuugauggaauccacauuacugcuuucaaagcugcuuuuccugugccuucuuccagaaagcuauccucccguccuugguuggcuggggcaggugaagcauuaggaaaugcucugucucugcauucucuucgaguaacacuggggaguguucauggcuucuggcagaacagcaauguuagccuucagcugcugaagcaagccuucugcucauucuagaggcaucuucuaaacagaucugcacuggucagguggggcuggagaaggacugggcugagagcacagcuaugggaggcaauacuuguucuuguucccaagaagcugaugugucguccggugaggucucucgucagccgaagguuggcacaaggucgccaggcaagggcuuuuuguaugugaaguaugcacauucuagccacagaguuuucugccaggguguuuagacaagcuaaaaguggaauauaaacuguauucaauuugcuagguugcaauuauaaggacaaacauguuuuuaagacuuaacccauuauaguaggaaaauacaaggcuugggguaugcugacucuuucccuuguucgucucucaaauagaaaaaugguguguguaaguagguguuuguauauguacauuauaagacauucuagaaauuucuguccuauuucuuuaauauucuugccacuaaaaauauaugcuccugaaacuagggaaaaagaaacuguuuaucauucuucugaauuauuacagauaccccaaaaguagccuccuccaaauagugguuuuucuuuucuaaaaaucaccuggaaaaauacugagcuuucugaucuuuauuuuauccuuuucaguggcucuguuuggaagaguuauuguacaacccagcacugcuuuuauuaaaaagaaaacugggccacucauuuccuucaaaguuuuugguguguuuaaaucuucucuagguaaacaaaacuuuuauugaaaauaauauuuugagaccgugacacccuucucacaagaagcggugcugaaagcccccuuguuggcugguccugcaggcagccuggcgucugcuuugccugugggccgugcagggugcugggggcaguggggagaggcgucagucccaccugcagcuuucgggggggugcuggggaggcagauuugacaugaacgcaaauaagugcaaggaccaucagggcaaagagacccaggagaccaggccaggggaggaggcagagagccuggucaggccaggcugguccuccagguccaggcccugcaggauccuggaaggcgugaagaugggcuggaggugugagcaccaagaauggggcgcggccugaccuugggucucuagaaguuacccugugguggcauuuucuauaauugaugucauaaauagcuggcuucuuuguuagaauucauuuacuuacuaaguuuggcaaauauguugaaggaaagaaaugugaguguguggauggauuucagcacguugacaucagugccugucuccuuggugccuguuggagacaccguguuggaauaaggaugagguuccucccucagaaugguugauccauuuccuucaguucuucuucaguuuugcagcuuuucuccccuaacuguagcagaccaucuccuggaaucucauauuaaaggcauaauuaaucaugugauauccucucguuuuuugcaucagaguuuucaagagcccuccagauuuuuauugccugcagauccgugugcuuagacauaguaccgucagcaguaaacuggcuucuggagaagaaauugacaaacaacuuuauaguugcauuuuuagccuuaauaucugagggcgagaagaauguucaggauuuaugaaguuccugaauuuaaaauauaagcaauaaaauguuccuaaugugggguccccaucugcaucuauuauuacaaacucuuaaagucacuuuagccuaacaugucaauaggaguuuucuucucuuucucuuuucuuuuugacaaauuguguccaagcaaauuaguuugcuugcaugaagcgucaucuguguuugcaagcuggaacaguuuugcugguuaagcagucuagagaugauaaaauuuuuuguccgaguaugacuuugguggugaauuuaaaagaaucacggccgcugcuggaagcucagaggagagguccauuuuaaagggcgucugcugcacucagcccaaagcguuacggggauuguuugaauugacaaaaugaaaauauguauuauauuuucucuuuuuaaaauccauuuacaguuuauuugucugauauggaggagcagagguauaaauuacagagaaauugucaucauauccucuggaugauaaguagggccagggcuucuguuuauuucggugguugguuacccacucaggacaguaaaaucacaaaguuuuagcuaaggaaggagaaaucccuucugccuguauaauaaauguuguuuugacccaacuacacuguuucuugugauaaaaauaugucacuuaagguuuccugcaucugccauuugugaacguacaguugagcgacauuaguuggugccaucugugagugcacagugcagcaacuuuaggggguucacaauguuccgcagccaucaccgccgcccagcacuggcauguuucacaguguuccgcagccaucaccgccacccagcaccggcauguuucacaguguuccgcagccaccaccgccgcccagcaccggcauguuucacaguguuccgcagccaccaccgccacccagcaccggaauguuucacaguguuccgcagccaucaccaccacccagcacuggaauguuucuguguuuugauucuuuuuuuuuuuuuuuugagacuuaaucucgcucugucaccuaggcuggaguacaguggugcgaucucggcucacugcaaccuccaucucccagguucaagugauucucgcgccucagccccccaaguagcugggauuacaggugcacgccaccacgcccagcuaauuuuuguauuuuuaguagagaugggguuucaccguguugccaggauggucucgaucuccugaccucaggugauccaccuuccuuagucucccaaaguccugggauuacaggcgugagccaccgugccuggcuucaucuccagaacuuuucugucuugcagaacugaaacccguacccauuaaacacuaacuccccauuucugccagcccauccccuggcacccacccuacuccuuuccgucuugaugcuaacacaccuuguguggguuccuccaagucaagagaaggaguguccaaagaccccugagaccagaacccucugccaacguugguagugcuguuucggccuggagggcaggugggccucugggcacuucuucgucaggacauggagccauuucggguagggcccugggucuacccugucccagccccguucccuaucagaaacccgaggcccagaggugcagggcagcugcagcaccaggguggacagauguugaugaucagugggaaggaauucaaagaaauagaacauucuacacaaauguggggagguaucuuuaguaaaaacaggacccaaguacaugcaaagugcacugugagggagagagaugcucugaagaaaggcacuguuuuuacauuaaugagcauuuaaaugaugcuggguuaaccauuuggcuuuuuguaccuugucaccaucuccuuuauggugugauuggacuuucgagagaagguggaggaagguuaauagauagguaggagaguugcaggcaggaaagacagaaggccccggggaugauagguggggcagagggagggauggagaggugacuucaggaagagcaucagcugccgcaggccagggcacccucaggaagcaggccccccaugcuugcagcugcccccgggagcccucauccccagucugacaacucgagguagaucuggguugcucuuuauuuuuugaugauuuuugcauaguuucaaggaucagugucuucuacacugauauucuaucucuguaaguuucuccgagguauuuucaccuguacugacauuguagucuuuccuuacucucuuauuuauuuauuuaccagaccccaccacugggugcagugaucaaaaccaaaauaucaaaccagcaccagaaacucuucagcagaccgguggaacaugccuuagagaaagccagaggggucaggcauagccuccugugccuggccugcgcucgccugggaagggcaccccucgcuguccaagagugaccccaggccacagaaaccacgcugaguaccaaaggcgaguccccagggugugggcaggcuccuugcuggcauguucagcccaggcuugccggaaguggggcucaggcucugucugugggauaaugaucagaagcuuggcagucaugggaccaggauaagaagaaccaaaggacagcucuccucucaugguuaugggccaaaaaauaggugauuguuuuaacuguggaaacugacccacuaagggggaccugcugagaggaaggccaguggggccgcagacaggaggggaggccacagccgcccacccgcucauggccgagcgccccguuuccugaacaugugggaggggcaggcuccccacaugggaaccacugggccgugacuguggcgcuccagcugcuggcagugcacacccgguggggcccucuguggcuugagcugcgucaccaugacgcugcaugcccagguggucauccaggaggaugacucugugcagaccugugugcccccgggccugggccuccugcaccccagaggucagugacaguggaaauugccacagacguggguuuguggccuucaaagccuucaaugucacagaauucugagucuuuagcuaaauuaaguacauguucacgugagugugugauuucuccaugaggacugagccucauaguuugucccuguaccggugucaguucaucgcuuuggucuugguggagaauucugcaucgcaggcacaucgucugguuagcgggagacauguuuggccagcggugaaagacugccuugcccgaguuccugagacuucggggcuacugauggcagggagaggcuggccgagggcagggccacgcgguccccuucugcugauguccgugaggacugggcacagcugccagagucaagggcacggaagugcaagcaguccguccuuuucugaagccugcucuuuuuguuuuuccccacgugugucaccuuuuaacguuuuuuuccuggcuuuuucauuaauguauguaaaaauauuaaaagcccuuguauauuacaugaaaaacuaugucagcugccuugcuuuuuucuauuuauuaaaacuuuucaagcaguaaaaacauuuuacuuguuaaugagggaaagugggaaaauuaaugacauagagcuuggauccaccacgaugucuccucuuaaccaugcgcagccagcuucccaccgcauggaguuuaauuucugcgauaggguucaguaagcaaaugcaaauagauuuaaugauuugcaucaguagaucauuucucaguuuaauauccucugauauuuugggucaaggacucuuucuuugggagacuaguauaauuucuagagguagaauuauuaauauuagugauauuacauuauguugaagugaagugagauagauguaucauuuucacaaagucagauuucugcgugacuuuuauucauuguggugcaaaggaaacccuggcugcugaaguagacuuaggagcaggcagaauuccuggacgcaggugccuuggagugaggugacccucucuggcccccagcaccuugcgagcagugguuuuugcaucuguucaccagcgcaugugaaccugugggcccgggggacacgugguccauuuuuguugaguacguucaacaaaggaaugaauuaaaaugagaacucuuuucagcaaacgcugauggagcuuucugugucucguguguggcaccaugcugacggaaugacgagaaaccacaaccuggccucaaggagcuuugucuacugcgggagacagagaugguggcagaucaguccuggaggcacaaggagagagugguagaaauacacaaaaggcauugaagaccaguggagcaucagggucacuuucacagggaggaggccaggggucuuguugccugccugccccaaacguggccuccauuccuucuuucugucucccgcuggaaaggcugagugcaggugccagcucucucugccucacugagcggguaugugugagaagcguaggccuacuggcaggcuccuggggaagacguuucuccccugauacaaagagcagcaugaggaagacucucccggcuccccagucugcggacacaguugugugaaugugauugcaggagggagcugggcagcuguuaugugaccaugagggcgugggacuggggcugaaagguggcgugcugccaaugagaaagauggggagagcugggcaccugcuggcccuguggccggccaggccgccucugaacaccuauucugugaccugaugugcauccucaucacacacugcagccgugagcagcacgcaggugaugacgggucauacgccaucuggggacuugaugcuccuuuuagcaaauacagaaaguacaaaggaaauaagaaucaguuccauuaaucagugauagucuuuugguguaauuccuucuagcuuuuuuuuuguuuucaucgacauauuuaaaaucaguuuugaauucuacuuaauuuuauaucuuaagcauuuuucuuguucugacaucuuuuuaagcaugauuuuucaaggucugugcuugguucuuuguuaaggccuguugcgugguuguacguggugguauuuuaacugucuauguccuggugaaccucuauguuuuuguuucuguuuacugggcugcaguaaacagucucgaugaacacuauguagcccugggugagugcuuccugagcaagcuugcuuuuuggccuuucucccuguagcuuuuuugucuguaacaccccuuucuguauugcagguuggcuucugaaaucaaaugugacccuaagugacuccucacuguuuuuaagauaagaaagcauuagcucuguguuuuccuagccccuccguucuuguacuuagacccuucacucugaacagcagguaugccagccuguacuuccuggcauuauuacccaguggcccauagcucagaagugacauuguguggugugaacgcugucuccggagcgagauuccuaacuccucuacuuuacagcuauaaaguggacaaaucacuucacuccaugccucaguuuccccagguaucacacauggggacuauaauagcaucuaaccacauagauuguuggacaauuaaaugagcugaccagcaggaaacucuuagaacaacgccaccccauaguaagcacucaauaaauggcaacugcugccguugaugaggaugacgauggugcuauuucuaccacuuccuaaggucgccccugcgugcucagcagccaccuccacccugcccuacccgcugcccacauauuucauaggccuccuuagaugucccugucuuugagccgggagcccucgcacucccaggcuugcuucagaucccuugccugagccuguccagcacuuugagcccgcucugcccgagcgcuguucuccuuccgugccgugcugucugcugugaguccuggagaacagggaccaugucuaucuugcuggccuuaguaccccucacagggccuagcccagggggcacucaagaaauuguaaagauccauaggccgggcgugguggcucacaccuguaaucccagcacuuugggaggccaaggcaagagacucacuugaggccaggaguuugagaacagccugggcaacauagauucugucucuacaaaaaaacuuaaaaaaaaaaaauuauccaggccugguggaaggcgucugcagugucagcuacucaggaggcugaggcgggaggaccgcuugagcccaggaguucagagcugcagugagcugugauuaugccacugcacugcagccugggcaacagagugagacccugucucuaaaaaaaaaauaaaauaaaaaauaaagauccuguaagugaaggguuagaagaguggaauauaugugcucuuaacaaagaauggugugauuauagagaugggaggugaaaaguagcacgaauuccaaguuuuauuuucggcaacuccgucagaguccugaauguucuuuacccaguuucucacucccacugggacucucuagggccagcgggaacccugcaggcauucggagaacugagcgcuggcuggaccuccucaaaacggggcacccuccagggagcugucgaggggcucuucugccucuucagaaaccaucaucagcugugaaaugugggcuuccaagugguuuugugucuccucaguuuacagaguccauguuuuuggugacucuugccuuggacccugauggcgcugggggguuucaucgccauuuaacccuccgcgucucacagagaccaagcagugcuuucgggaucgcucuguuggucucuguguagcacguggcccccaaaauuuagguguugaaguccucauccucagaaccucuggaugugacaguauuuuugagauagggucucuuagaaaggugauuaggguaacucagggucauuagaggagccccucacccagugugaccgguguccccaugagauggagguuguggcacagacacacggagggauggccacgugaggacccugggagaaggcugccuucugcaagccaaggagagagcgccuuggagaaaaccagcugugccuacaccuuggguucagacuugcagcacccaggcugcagggcuucgucagggcagcccuggcggaagaacgcagccucgucgguggguuuggugaugcugugcaguucagcuuuaccgucuugcugcagcgggaacguccugcuguagaagaggcgccgccaucccagacaguguucauaaacaccgacggcaaagucaggacgggcaggagcguucuaggcaaaugaugaaaaugguauuuuacacauauuugaaaagaaagguuugagaaggcauccauuauuaaaaccaaauucaacagagaauuuaaaaacuggcuguggugagcaauguuagucccaaaucacuuuuucacaacuuguuucuguucugucguagggcuagugagaccagcuuucccuugaguucuggggcgggacguggaauguuugugaggcuacccuucauugaaggggggcccgugauguugaguguucaccgucuuucagaacguuugugcgguggcgugucccuucuguaaauugcugugaccugggcugcaugcuccacagucagacucgcuucgcccucuuacuggucuucauuaauucguggucccuggaguggagcgggaaauacagauauccaccuccucucauuauccaaauacaauaacaaauuacgaagcaucuuauccuaccaaccauuauccuaucagaaagcaugugcuaauuucgaggaagcaagaggaacuaugucagaugugccaugagauguaaaauguacucgcccuguaucuuggucuucuccuagcaguaucuugucugacaaucuccuuguuuaacuucuugggcuuuuucuuugacaucuucccaccuuucccuaaggguuuaacugucuuagaucuccuugucugcuucugcccgagacucugggucccugucaacucggguagaauuuuauugguauuuuuaggcucuuuaacauacuuuaaucauuguguugcugcauauauuucuucuaagauagaaguaaauuguaauuguccucagauaauaaccuaggaccuuaaaauacacacaaauguacacacuaaugaauuuuguaaauauuacauaacucgguaauuauuguuucaaauuagauaaugcagaaaucucuggauuuuuaugucgguguuuauaaagcauuuuaaugauaauuggggaaguugguuguggguuuuuagcuagaacaggaacccauuauaauuuuucccaauuauaauaaugggacauaagccucuguaaccugaaauuuuccucuaugacauguuuucagaaguagaauuauuagauuugaugaguguggaugccuagguuuguagucaacuuuuugaacugagcuaaucaaugcauauuugggaagagcauauaauccaaaauauugggucuacaaauguaagauugccuuuggugaugaguuggugucaucugucuucuguaggaaaugaagggccucuugcagugugcugugccucauuuuaaaccuuuaacuggcaagugguccugaucuucccucuggacagcugcgggaagagguuucccgguuuaccuuggcccccguaacaccacaucaucccacgugugcgugaagagcccgcacaggcccccugugcgcccggggucagguguggauggggucgggguauuuccaguacuugcgcuucggagucuuuuuaaaauugagagcucaucuauuguugauaaauggccaaauauaaauguauaacaccuugauuaauaggcugcuaugaaauugaagguggucuuuucuaggaaauccucauugaaauacugcccauuuugaauaagucuaauaguacgaugaaccacacccuuaguggaaacguuauaggaugcaaauaggaagauuuguggguguuuuuccuucaugaauuuguuguuaucuuugcagaagugaagaauaucaauauuuuauggccuuucuuugggauucguguuuauuaccagugaugcagagcguggcccugguccucagcgccucugccuuugugguggcgggggccaguuugccugguggggagguguguguguuuucaccaaguuagcaaauuuccuguuuucucuuuuaaaauggaaggcuagcuuccucucccauuggcuuuuucuggagauuggaaaugguauuacagucuuuguuguguuauuguggaaaucuccggcgucucuccugauguugccgcccugcacggccguuggagaguacuugcaggcagccccgcuccacaccacuuuuaucaucuucauuuucauucuuuugugaaaauguaguugcuuuggagccuuucgaaaagugugucagaucauuuuugccauuucucuuuuuccuuuuacuuucuguuauuuuccauuucgaucucagauacccuucuuaggaagcugcauccccgacgccgggcuggucuguucugcucugggggcggcgugugcucucauuucacucccauaaucagcuuuggcauaugggauucagagacgcagugcuuggucuucugagauguuuugugcagcagcuaggugaugucccaguucuccuggaauauuugcaucgaccaggaugcuguuucugcgucggaacguggugucuuuguuuacccuuaggcauuaucuugcuuguuuaccuaaaucuuuaacucuccuuaggugagugacuucacugauacuaagagugauuaaaauaaugugauguauggagucaacuuaggcaauacauuuaccuguacaccacacguccaauauuuauucagaaugauuuuuuucaaauauuuaauaagaaugaauaauugaauguacuauagccuucuuacuuugcccugcgaucccauaagaccuuuaaagcuaaaacuaguuugggcccuugagggguuuauagaaauuagguaugucugaguauggaaauggcuggcauggugaaagaauugaguccuuaaguaauuugcuauucccagugauaauuagaagaaaccccuguucuagcuccauuuucccauuuuuuuuaauguuuuaggggagauuucuuuagguauuagcggcugaucuuuuuuuucuuaccauguacucccgcuguaaggugagugguuuuggcauauuguguugccuugauggguuauuaaaucgucacuuggaaggaugaauguggguuauagaguauguugugccauauaucaucuuagucaucaggaauguuucagaaaacugaauaagaguaaaguuuuuuaaauuuaugauugaaauuagcaauuuuauuagguccuuuuaaaaaaaccuacaaacuuuuaaaguuuuucucaaaauauacaucuuuguucucagaagaggucugcagacugcccuaauuugucuuuugaaaggacacagaauuuuagcagaauacuuaugcugcagaaauggacaaaugcaggugcuguuccuuggauggucagcauggaagguugacgugcuccaagauuuacugugcgucaccuuagccaucagucccaucguauucauuuaacuccacuaauaagaaacggagcaaaaguggaauuaugaguucaguaguauucuaugaaaggucaguuguuaaaaaggcagagucugacauucugugaaaaaggugccuucauuaaucauucugaugggagagcacggggcguucuugaccaauaccagugaaccuugcaaugcaaaguuucagggucugauguguaaguucuuauauaaaaacgaggaucguuugaauauauguugagaucauucaaggaauugcuuuaccuuugcuguuuaaaaguguguauaugauauagaacacguuauuaaaugugcauuacuguuuugaaaaaggaaaaacaccuguuaauuuuauagauaaauuauggaaaucugugguagacacagcuccaggcaguaaugcauuuccaagcgaaugaauggacauuuccuauauggaucaucuacagauauugguaagguuucuuuaagucucuuuuguacucugcauucguggcuaaaccuaugcacuuugacccuguucugcaaaacaaaccauggccuacuuucagacucuccuucguucuuuugcuguugguuacgguggcagagugccuacuguguacacagaaucuagacauuucacauugaauuaucugaguauuuaugugcccugacaauucagcguuaaaguucaauacaaauauauaaauuauuaagcaguuaaccagugacacauucaucagcugaacgucuuuuauuguggccuguagacagauuauuuucauucagccauuaaagcacaauauugucgggugaaauucuguuucuggauuuucuuugucucuguugcugcuauggaauuucauugaaagcaucgaaauaugagacuaacacagaauacugaguguuucuuuucagaaacgggaacuuucagacauuuucucuccagcugaauucaguaaagagcaguguguguguguguguguguguguguguguguguguguguguguuccuuucccagccagcaguguuauaucugaagggaaggguggggaugagcuguggugccgcccuucacgccauugagacgggcugggaaggugcccuuucacccucuaccugcaguuggugccuagugauuuuaaagauucaggaaugucuuucaccgugauucucacuauuaaccaaucucacguaucuaacuuuccuuacuauauuauuaguuacuacuuucuauacaagagagagguggagccugccugugucacgauggggaaggcccuugggauucgcucugugggugcgggcagcgacaggggugggucagggugcaggcggugagacggcgagcgaggaggucgggaaggagccuccacaccccagcagggcccauuccacacgagaccccagacgaggggagcagaagcugcuggugccucucuguucuuugccggaugcuaccguugucuguggccacacuugcuucuucagguguggaaauagaagcucagagaaguuaaacaaugcgccaaauguuacaccuucccauucuaacgauuuugucaauuucggugucaaggugauaucuugucugaugguggaggucauaguugucugugaggacaugguauccacccucaagcauguaauuaugcauggagagggcucaguucaguuuuaccgagacacaguuuauuggagucuacaaauagcauaaacugcuaugucugcaguguuaccauucucuuuccuuauugucauaauuuuuguuuaauggcuguuugugcuacauugaccagguccauggguugcuuaacauaaaugauuacauuugcuuaugauuaaaaacuuccuccauuagaagcacugcacccaggacuuguaaaugauuuguuguuaaaguuuucuacuucauuagccacgucguugacuccagagucauugucuaagaguuaggaacacuuguaaugagcuguauaauauggacccucgaacgaaauuuaaaaagagaccaagccuucuaggaacagcuuagcaugcagauaaaaggcuaggaaaaugugugaacagcgccaggcuguaggcugaggcacguuccauucugacucagaauggcaugggugaauaaagucuuuuaugauggagcaagacuuguuguaaaaaauuauauaccauucaugaccaaaauccuucaaaacacuccgucaccauucccuucugaacccuauagcuuaaguucuaagcaucuugugagucucuugauagagcguugaaaacuccaugcaauggucuuugggacgccauucgaaccuggccugccccuugcuggcaccuuguucgucuuuggcuccauccggggauuugauugucagugacccaccugauuacagugggcugccauggcccuggccucgugguacaaaaacauggacgauuuugugauuuauuaucggaggacagcuagcaaagagaacuuccuggaauaacugcauuaaaugugaugggcauuuuugugacagauguaaaauucuuaaucuugaaagcaguugcaugugucaggcagacuggguguuaauuuucugacagcaguaggaggagcuuuuuuuccccauuacagauggaauuaggucuacuuuguacacaguacuuugugacagugacucuggccaggggaggggauaugcugguucuggagucugagaagauggggcugagccagcugugacucggccacacguggcugugggacuucgcacugacuacgcagccucugccagguuucuuuguaaaagugaaguuaacaccgaucucacaauaucuggggaggaauaaauaggaacacacaugcugaguuaaaguccucaguuauuucgucuucagcgacagaugauccccgacuuaccgugguucagcguuugaguuuucgagcuuuaugauggugcagaagcagccuacgugcaguagaaacuguaccacaagugcccgugccaccauucugcgucucaguacaguauugaauaaaggacaugacacagucaccacuuuauuauaaaauaggcucguguucacugaugcugcccaacuguagcuaauucaaguguugugagcacguuuaaggcaggcuggguggaaccauggcguuugguguauugaauguguuuucagggucgauguuuuuaacuuucacugaauguaucaggauguagccccaucauaagucgaggcacaucucuguuugagugccuguuacgugcuggccauggucccaggccugcgggaugcagaggcgaggacaguguuugaguuucuagcgugcucacuguguguggguaggaugacccugccggucugugcccuggcuuagugaacuagaucucguugguguccugaggccgagucuucugugguuucucuggagaguguggcucucccuggucaguauugugaccucaguuaccacuuucuguccccuacauucauauacucccauucauguauuuaacaauucuuuacugcuguaagauaaaugguuuucaauuaugaguuuugucaugaaaauuuaauuuuuuaaaaaaaaucaaaagaccuggauguggugugagcaugcggagcuccccuuucugcccaggccuuuaccuuccugcuaggaggcaaggucagcccagggacagugcugggagagagcggaguuccgucguucauggguugcuaauuuuuggaguacugcaauacaauuaaauauacuuaaccuuaaaauuacccagaaugugauugaaucugugauucacaggccccuucugguucucccgugccucggugugaucauuaggaggauggaucaaccuggugcuaucgggaacgcacugcguuaauggccucagugcccagcaauggagaacuuuccacugaguauccgcaugcagcgugcccggcggaaggugaaagcuucacccuuugucucccuugccauccuuuggccuuguguguuuggaaguagccagaggugguggaacaguggugggcugguuugggucuuguuggcagugccaaagggacaaaggcuggaugugggcacgaccucagccucgugaugggcaagacaggugggggugacuuucuguucugaaaaugaccuccuccccuucuuccuccccucaagcuuccuaccuuuccucccccucccccucccuucuucuuccacucccccacuucuuccuccucucccccuccuucccccuucccccuccucuucccccuucccccuccucuuccccuuccuccuccucuucccccucuccuuccucccccuccuuccucccccucuccuuccuccccccucuuuccucccccucuuuccucuucuccccuuccuccuccuccucuuccuuccucuccccucccccuccuccuccuucucuuccuccucuaccccuugcuccuucucuuccccuucuucuuccucucucuccccuuccugucuuuccccuuccuccucccuuccuccuccccuccuccuccccuucuuccuccacuuccucauuuuccuccuccacuuccucaucuuccucuucuuccuccucauuauuuuccuccuccucccccucauuuuccuccuccucccccuccuccuccuccccugcuuccccuccucugcuuccucacccuccucuccuuccucccccuccucuccuuccuccuccuccucuccuuccuccucuuccuccuccuccugcccuucuuuuccucugucuuccuguuuucuucccuuuccccugcuguauuccuuccucacacgccccccucagccucuuuucuggggacuggcucuucuaggaggccugccucaaggcccucaggccaguucccggggcagccacugagcagaaccgccccucccagcgcccaccuauggccacugcccucagggucccuuccuccagcauggugcuggcggauggcgccauaaacaggcugucacucaucugcaggcugccuugucuuucccccagcagauuaaagccuucaugaaaaaagauggagggcgcuugacuuugcgacacgcacauucugccgucuugggaagggggaaagaggggcaucuagcugggcgcugcguguagccugcccggcggggccgggguguggcaggaccgaagccugcuccucguguggggcccggcgcgaaaacagcuugugcagccgcugagugacugaggaccgugucccaguguagugucauuuccucguacauguggaguuuaaagaauuauagguaccuugagcuacuggcagguaaaagacaguaaaaaaaaaaaaaauagugaaagacacagucuacccucugaacugaucuacaaggcuaugaaagcaucacuuugaauaauaugcaguagauauguuagaaaaauguaauauugguguguggaccccucagccucuuugacgaguguuguaauauaucuuguugaaugaugaauaugcuaccguauguuucaacuauuccuuucuuguggcugaaagaaaaauauauugaaaaugaauguaaaauauugacauuuaguaguuguuaugcuccacuguaauuucuuguugcuuuggaugugguagacaccucacuaauuacacgguguguacaugcgcaccuguaacaggagccgcgugaaagucugauuggaacucugacuugaucagcccauguucuucugccauagccacaggagcaucugaacguggugauggaagaagacccuggcgccccgucuccccguggauuagcggcccuacugugagauccuggugaucuugaugaucgaggguuauuugaagcaguucauuuugugcugcaguucauugaaaugccaccacccagaagaccccugaguuuccagagguccuggugcuuuuuuugcuggggcuuggaccggagcgucuuuagagugaccacugccagggaagacaccguggucggggccugugauuccugccggggccccaggcaggcuggagccacaggucugaguucuguccaguucagguucguaggccacucuugcagcucuguuccuucuucagcuccucuggucauucacacguggccuggccacuugccuauuguaccagcucuccagggcuggggacuugcuagagcaggguucccagugcccccaggcucuacuuugcucugccuggucucaggguguaggggauggagagcuggacuuccagccugcuucuuggcugucuaggugccaggggcucgggacacagagcuccuggaggccgagcacaagccuugggcagaggugaggcagagcucugacuguuucauucgacuacguugccaaggagaugcucgcucggagugguugcucuggcucugggauuccaaaccaagcugccuucucugauguggccuuagugcucugggcggauguaccuuggcucugccuggacccucucucucuuccaggccucugucccaccaggaugaugccuauccagagcucauuguccucucccacuuccuccccgagcuucccauuccgugucucucuggagggcccaucaucauccugguggagguguugcacugaggaccacagcagcccucgcauuccuacacauaccccuuugcccgugggauuuuugcuguuucucuucucccacuguuggucguuggcuggaucucguugaaggccugcggagauucaggugccauagggagggucugggacuuuucucucggaggccccaugaaguugguauuccucagcucugccccagggucccucugauuccacggaggagcugcggaaaguccacauuuuugaagagcugcaggcuggggagcccccguggcgaacagaggcucuaagagaggggucuuuguuuuggggcagugagacugaguggccagugagcaauccgucaucaauggagaucaauacccaggaggugccaucucucuuggcgggugacacguaacuguuacaaaugggugccugucccugucacgucaccggagugugcgucuugaugcccuggcucccugaggcagcucguguuuucgaguguuuccauuuuagagacccggaaaagggauccuuagagcugcuuuguuuuccuuuuucaccagaaacaaaugccuuugugcuucucccgccugcggacucccacugcguucagcccgugcggguggucaucggccagacccauccagccuguggcccguccccuccaccucucacagccaccuaggaaaguaguucucagcucuaaggggcauugucuguuccaagaagaaugacugcucccugccaccucccacccccaucccauguccccaucauagacccagcaggacagacccccccagagagccaguggccuucuugcccauaacucguuggugcuggagagcuguggguagcguagcaagugccacugagcauccuggaaacccugggaggggucccggcgagaaagagccaucacccuaagaagauucaggaaugggaugaucaugggguucagggugccccaacaguagguugaaaauccugucccuggccaggaggcagggaaguagcaaccuuauucaaggggaaaaaaaaccuccuggagucuagauacaguaucuuaguaguaauaaaagcacggguacagauuuacuggugucggaguuuuaacuguaauacuguggaaugguagguuauuuuguguucaagagcuacauuuaucacaaaaaugaugauauacaaaucacuuccauaucacaaaauguucuuggucaaaauuggcuugaggcaagugauaucuucgaguaaacaguauaugaagaccauaucuuaaaaugauagaucaccuaauuuuguucugacagagguuuuugccgcaacaaacaucugucauugaaauaccaauucagagauauggaagccaaauuguagagguuuuccuggauuugucacuccuaacuuaagaaugcuacuguucccaucguagcuuuuauaagauauuaggcaguguugcacuuuaagagacauuaaaacaaaauaaacaauucagagaaauacgcuuuaaaugcaaaccaaccauuaaaaaguauagaagucaggaaugggccgagacagccuggcuguuuuuaugugcagacaucacauuaagcucgcuuuacuuggagauuuugaacuguagaggccuccaggccuccugccuucacuugagguuuuuggugcuuuuuaaaggacugugauaaugauguuauucccaagaugugaaggaccauucuggugcuguccugacaggggagcagguuuacagcucaggacacuggggugccacggggaccugggggucuccuugugccugggauuccuccucgucaggagcccucacucaggaagcccugcacgggggcaaauguccugggauuggagaggcaagcgugaaucagacauuuccaaagacgacaccgaagaacuucugcuguauuccaaguuaaaaacuaauugaucuugguccaaacuaucauaggauaguuaaaaaaaacacacaauagaauuucugaggugcuugggagacauuuuagaaauaugucauuggugaccacuuuuuauaggcugaauuaagaggaaaaaaagguaaaauaucuuuuaaagucuccaguuucugagaccccucuggagaugauuucauugaguuccucccucugacagcuccuauggaccuggagggcucugguuucuggaguagcaugggagcuggcccugguccuggcucuccugcccaccucugcccccuuuucccugcccccuccugacugcagccaccagugcccgccauuucuuccugcgcugcaacagcucuggccaguccucuccuuauucuguagguugaaguacauuccuggaauccagguuuucaaagcauucuaugcaguuucuugcaugaaauacaggagcagccuuuccugggcugccucacacauugggcuucuguauuccuuuaugacagugugaggcaggccuggcuaaugucuuccagcccauucaucuccccacaggguaugagaugaugggcuuuagcgucagacagcugggcccacacuccggcucggccacuuacgggcucuggcagguuaccucagcuguugaacucgugagcugugacuuccuccucugcuaaugcggcacucucaugccugccucgcagguucagaugugacgauagacauaaaacaccuggcccggcuccggcgcacagaugcugaagucaguuuucugaggucguggugggggcgggggugaggguggcaauggaaauagugacaacaguaguuggcguugucauccuguuuacggcuagccugcgaguggcucaggcgaauccagcacagccuuguccucggguuagcugcccucucagagcuucacaucauaacuaguucauuuaucauccacgcuagagacuggucuuccagaggauauuccuaccucagagccccuuccucccgacgugcugggacggccccugcuguugccuggcuuugccugguauuacaagggaccucaaccuccugugcucuuacccgggccugacuugggugaugcccagaaucccagucaugaggggaccaugacugugggccaguugcugacaaccuugguggguuguagacucaugaaagaaacacuccuuugccuccugaccuugugcaucagggaggaugcaggaggaacggaagauugagcccggggagugcugucucggcagugccacuucagacaagugagugucccuuugugggacguguucucaacaggcacaggugaccuuauagguauugggaugaugggggugugccugcagguugugaauuacuuuuugccuucagagccaccaacacauucacacaaacauuuguuuuccuuuugauuuuaucaggagaauuuuguuucuuugcccgccugaacauugcuugcccuccauaauugaguguagacuaacucugcagccuaagccaaaguacaucuuuugucugugcgaagagaaaguuccauuucccuuuaccaaguuaucuccauggcccuuggccacagcacccuccgcagacccucacgugcauggccgcagcagacugcccacacauuugcacacugacauuggucuuauucucaucaacuaauaauuaaaccagaauccaaguaagugcaagaaucaaaggcuuugaguaggaacaaaaggcuauguuacuuuguauccuuaacuaagaauuuuguuguucaagaaauccugggcuuuuguugguguagcucugcaagucagcagcacccggguuccacccggugcuuacaggucacgaguccagugacgcugauugaggugugucaccaaauaugcugcagauccggggccagcccaccugggccuccggccacggucugugcccacgugucacgaggcacaucccgggucauccggagagggaccuacaaagucuauuuucaaaccaaguuauuuugugaaauauuguagugaacuuaucaaaacuggugaaguugaugaagugaaaugaaaauacugccaugaaaauuauuuuagugcaacauaaugaguucuguuuuucauaucuggcagauauuaccuacuaaaucuaaucugcaaugcugagaauuaugccauuuuuuaugauuuguuuaauuuugacugaaaaaaauugacuauucaucgauucuugaccugcgaguauugagggaaaaauuuaguuaauaagaauuuucaugagguguaaauuuaaauguaugaggauucugccuauccuuuaauacuauagacauuaauuuaaaaauucuauaagggccugagggccuggggugucugaagaacagaacauggaggcaguuaugguuguuaacugguagacaaggucugucaagauaauauaggaauauuuugguguuuucccuauauccuugguuauauguggcugagcauaauuagaaguuaaauuuguuuuagauaaucucuucggcugugaaauggcaucaauacacuuaagaguaacaagucgaauagaaaucagggccuguuguuaguguaugagcacacaccacacaaaguuucuucuugguucccuauuuccgcaguucaaaggggguuuuaaagaagucauaaaaaaugaaggauccuaauauugcaguuggagacugagagugaaugacauauucuuuacacaccucaacugucaacauuucuaaucaaaucacccagccuucuuacuucuuaaaugauacaggcgauauuuccuguaauaaacaccccuaagucuaaugagaggcccuaaggcaacuugaaauauaugaauucauuauaauugaacaacauaaucugcagggcaaagaugccugcuacccagcucugaacuucacagagcuuggguguuuuaugaaaaauguuauacguuuuguuuacaacguauggcugcuguuugaaguauuguauguuccuguaguacauaagacggggccgcauaauggaggaaaaaucaaggaggcaaucuuucauuuuguucugguaugaaaaauucaaaagacugaaaacucacccagagaaauuuugcaagcauauuauuuuccaauguuucgaucaauuugucugucaaccaugcugagagguggaaggggccagcaaaagcaauuuagcuugugagguccaaaauagaaauguuuuagggaaccuugucacauguuauuucuuuauauuagaaccgccguguguuuuauuugcuggucauaauaugaagagaaauugauaucaaucaucuaaguaagcuaugaauaucugauauaaauaugacuuuuauaugcaugcaucagaauacaauauaaauuaaccucuucaugcaugcaagaaucguuagugcgacagcgggcucccuguuuuggauuuuuccauuugacaauucacggugcauuuuaauugauuguacccaagugacacuccguggaagcaucuugcaugugaacguaacugacccugccagggcuuuaauuaagcuauaaucuuccuuuagucagugcaucugggauugauaaacauauguaaaccaugcugaccaucuaaguguugcuuuaaagaaaaaaauggugcagauaugggaguuuuaaauaaacggcuuugauguuaccuccaguugaauuuuuaguugggauuuguuaagaucaaguuaucuuaggaguaguuaauucuaaggugaauauacaaucuuggugaaacuuguccuggaaaaccuguaauucugugauuagucuguguguaccccaacacuuuuucuucaaaucuuagauuaacacugaauacauuaagguuauuuuucaaacagguuauaguucagagaaauuaauuuaaaucaguuggcuuacagaagacccaguuuaguuuuaauuugccuuaacagccagggucuuccugcucuacuuacuuagacguccucagagugucuucugaguaguuggcuaccauuugcauggcaugauuccgcucucggagcuugauaucuuuccagauuuucagaauuuagaauuaaguguggaagucaagcauacugaaaguuuuuuauacuauggaugcugauaaauagaaauaaacuaugacaaauuaauucagaaaucuuuccacucaguguagauauuaaguuguggucauacggaagaagucuugaaacacgauuuacaguaaauuaugauaauuugggauagagacugugccauuaagaguuguuaaacagcaugauucagacagcucuguuuuuuccagugacugccuauuccuuuauuguauauguguacccaagugaugcucucacauuuaucuuaagucccuauuauuaauauacauuuaaagucucccgagguuuuguuugguuugcuuugguccuuuuuuggagugauuugaagcaaaguuaauuguggaaccuauuuauagacaucuuucuauacuugcacaagucuguguauaaucaauucugagaaguagaauuuaaaauuuagugcuuugaaaauuguccucauuuuaauuuuuuggauuuuaauuagguaagguugaacauuuuuccuuauuuucauugauuguuugggguuccuugguaaaaugcuugcuuuuguuuccuguuggguuauuuugucuuuuucuuauugauaugugagaacuuuuugcauauuaaagaaagaccaucauuucuauuuugauuuugcccagggaauuuuuuucagaauaagaaauucaacuagauuuuuaaaaaacuuuuaauugggcaauaauuucagauuuacagaaaagucacaaagauuguacagauccuucacccaggaucucccaauguuaacagcuuacauaaccauaguacaugguuugucaaaacuaggagauuaacauugguccauuguggucagauuuuuaagucccuuccuauggcuucuaaauuuaugaggugcuuacacaaaggccuuuuuaaccuuaagauuuuuuuuuuguuuugcuuuuguuaaucauauauguuuauuuccuucuacuuuuuaaauguuguuuuucauauuuucaucucuauuuauuuauuugaaauguguuuuaauuuaaagagucuugguuggaaccuaucuuuauuuucaucuaaaugcuaacuaaccaacuuuuucaguaucuuuugaauuacucgacuuuguguuuacacacauuuuacaaggacaacaaaaaagugccugcugauugacuuuguagucaaucauaacccuugaccauauuuuuuuuggugguacuucauauaugaaagaguauaaaaucuagguuauuuaauguuguuauaaaauuauucuaagaucaccgaauggagaauacuuagauucuaaauaagugacuuugugagaauugaauuuuuauaucauuaaccaauucuaagacauuuuaaagaaggcagaaugaucuaacccaauacuucauauacuuaguuuuacuguggaaucccaagggcaacaugucccccgacccaacgacaaaauaacauauauuccuauuaaguuuagggauugauggagcuuguaauuguuaauuugucacagaugauacuguuauuuaugcgcaguuacugucucccuuuggagaguuucaugugcuaaauuuucagcaaauaguuugagccucaccuacagcuucuugaccuuuuggggaaaaaacuaucacuuuaaaagaccuuuuacgagugagcaaauauaugcuuuucuguuuucacaguaacuuucagagaaacccacuggucucagcauggccuaugccuuggcagcccuuuccacccguagcagguuguucuuuaccuuucguuuuuaagguggcuuccaguucauaccaagcucacauacuguggcgaagagcuuucugagaaacuucauaagauuuugcuaagauauuaaugaauaauuuaguauauuguugcauauaugacugaguaucacauuucaguaauguuuuuacuaucuuuaaauauagguacauaaauccuagcuugggguaaaaggcauugacauuuucucaguaauaguucuuuguagacagaccuggguucaauauuagcucugccaccccucgagcugugucaccagaaguagguuguccuguacgucuaacuucaguuugucuauuaaaggggauugcaccacugacggcuugaucaggguuaaauacuccagcauuccuuggaaaacacuucugugagcauugucgcagacuugaugauguagcaacuauuuucccuaaguuucccacuuuagaaauuauuaaaaauauugcugccuucauagcuuuuucaaagguuuucucuuauuucugucagaucucuuacaucuaauauucucauucccagcagauaauuaaucuauuaagaggcaggcugugggccccucugauaccagggaaagugaaaggcaccagggcaggaguucugauucuagcaacugccuggccgcugugugaucuccacacagcaucaaaccuugcagaguucuaacagaagugaauagaagauuagucucccacacaacaauaaugggagacuuuaacaccccaccguuaacauuagacagaucaacaagacagaaaguuaacaaggauacccaggaauugaacucagcucugcaccaagcggaccuaauagacaucuacagaacucuccaccccaaaucaacagaauauacuuuuuuuucagcaccacaccacaccuauuccaaaauugaccacauaguuggaaguaaagcacuccucagcaaauguaaaagaacagaaauuguaacaaacugucucucagaccacagugcaaucaaacuagaacucaggauuaagaaucucacucaaaaccgcucaacuacauggaaacugaacaaccugcuccugaaugacuacuggguacauaacgaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagaucuaaaauugacacccuaacaucacaauuaaaagaacuagagaagcaagagcaaacacauucaaaagcuagcagaaagcaagaaauaacuaagaucagagcagaacugaaggaaauagagacacaaaaaacccuucaaaaaaucaaugaauccaggagcugauuuuuugaaaagaucaacaaaauugauagacugcuagcaagacuaauaaagaagaaaagagagaagaaucaaauagacgcaauaaaaaaugacaaaggggauaucaccaccgaucccacagaaauacaaacuaccaucagagaauacuauaaacaccucuaugcaaauaaacuagaaaaucuagaagaaauggauaaauuccucgacacauacacucucccaagacuaaaccaggaagaaguugaaucucugaauagaccaauaauaggcucugaaauugaggcaauaauuaauagcuuaccaaccaaaaaaaguccaggaccauauggauucgcagccgaauucuaccagagguauaaggaagagcugguaccauuccuucugaaacuauuccaaucaauagacaaagagggaauccucccuaacucauuuuaugaggccagcaucauccugauaccaaagccugguagagacacaaccaaaaaagagaauuuuagaccaauauccuugaugaacauugaugcaaaaauccucaauaaaauacuggcaaaccaaauccagcagcacaucaaaaagcuuauccaccaugaucaagugggcuucaucccugggaugcaaggcugguucaauauacgcaaaucaauaaauguaauccagcauguaaacagaaccaaagacaaaaaccacaugauuaucucaauagaugcagaaaagaccuuugacaaaauucaacaacccuucaugcuaaaaacucucaauaaguuagguauugaugggacguaucucaaaauaauaagugcuaucuaugacaaacccacagccaauaucauacugaauggacaaaaacuggaagcauucccuuugaaaacuggcacaagacagggaugcccucuuucaccacuccuauucaacauaguguuggaaguucuggccagggcaaucaggcaggagaagggaauaaagggcauucauuuaggaaaagaggaagucaaauugucccuguuugcagaugacgugauuguauaucuagaaaaccccaucgucucaucccaaaaucuccuuaagcugauaagcaacuucagcaaagucucaggauacaaaaucaaugugcaaaaaucacaagcauucuuauacaccaauaacaggcaaacaagagccaaaucaugagugaacucccauucacaguugcuucaaagagaauaaaauaccuaggaauccaacuuacaagggaugugaaggaccucuucaaggagaacuacaaaccacugcucaaugaaauaaaagaggauacaaacaaauggaagaacauuccaugcucauggguaggaagaaucaauauugugaaaauggccauacugcccaagguaauuuauagauucaaugccauccccaucaagcuaccaaugacuuucuucacagaauuggaaaaagcuacuuuaaaguucguauggaaccaaaaaagagcccacauugccaagucaauccuaagccaaaagaacaaagcuggaggcaucacgcuaccugacuucaaacuauacuacaaggcuacaguaaccaaaacagcaugguacugguaccaaaacagagauauagaccaauggaacagaacagagcccucagaaauaaugccacauaucuacaacuaucugaucauugauaaaccugacaaaaagaagaaauggggaaaggauuccuuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaagccuagaagaaaaccuaggcaauaccauucaggacauaggcaugggcaaggacuucauaaccaaaacaccaaaagcaauggcaacaaaagccaaaauugacaaaugggaucuaauuaaacuaaagagcuucugcacagcaaaagaaaccaccaucagagugaacaggcaaccuacagaauaggagaaaauuuucucaaccuacuccucuggcaaagggcuaauauccagaaucuacaaugaauucaaagaaauuuacaagaaaaaaacaaccccaucaaaaagugggcaaaggauaugaacagacacuucucaaaagaagacauuuaugcagccaaaaaacacaugaaaaaaugcucaccaucacuggccaucagagaaaugcaacucaaaaccacaaugagaugccaucucacaccaguuagaauggcaaucauuaaaaagucaggaaacaacaggugcuggagaggauguggagaaauaggaacacuuuaauacuguuggugggacuguaaaguaguucaaccauuguggaaaucaguguggcaauuccucaaggaucuagaacuagaaauaccauuugacccagccauccuauuacugaguauauacccaaaggauuauaaaucaugcugcuauaaagauacauguacacguauguuuauugcagcacuauucacaauagcaaaaacucggaaccaacccaaauguccaacaaugauagacuggauuaagaaaauguggcacauauacaccauggaauacuaugcagccauaaaaaaugaugaguucaugucauuuguagggacauggaugaagcuggaaaccaucauucucagcaaacuauugcaaggacaaaaaaccaaacaccgcauguucucacucauaggugggaauugaacaaugagaacacauggacacaggaaggggaacaucacacacuggggacuguuguggggugggaggagggggagggguagcauuaggagauauaccuaaugcuaaaugacaaguuaaugggugcagcacaccaacauggcacauguauauguauguaagaaaccugcacguugugcacauguacccuaaaacuuaaaguauaauaauaagaaagaaacaagaugagcuuguggacugucuuucacauccugggaacuuauagaaagguaguuaggauuauuaagcaacuaaaacauuuuccuuuauuuuuccuuccuuaccgcuaccucucccaaguuguaauaauuuaauaguuacaacuauuaguacaaauaguuuuaaaagucucuuugaguugccacccuggaguguguaucuccuaaugggauaauacuuaaggcauuuuauaaacuuuaaagugccauggacaucagucauuugugcauuugugagcacugccucauuuaagccugccgucgccuuaauguacuguguacauuagauacgacuucaguucccuuaucccaggagggcugaaacuuacugggauuucuguuauauugaccuaacagauuaggaugauuuuaaaauuuuacucauuuucuauauugaauuaaaacaagaaauuagcugagcauuuuccaagauggaaggaaaaacggccauuguuuugauuucuaguuauguaacccauuccaaaaauucaaacaugagauuacacggagugcuguauuaaacagaugaguaccugcucacuggcuuccuuucacacagucgccuggcacugcagccacaccugugcucaccuguaccugccuaccuguggcugggccaggccccaggagucccgugggucaggagcauggcauggagggugggcagagcuuucugcucauccccggaucauggcagcgucagauggaacucggccugccccguuucugugcagcugucaggauguaugggguuuucccaugcuccgugccuccaugccugcggcacuuuggaaggacguuaaggcaggacaucuuuaggagaaugucuuuauugacuuugucuuuauuuaccuugggccuggcgcuguuaucucagcugaguguccguguuuaaaggcgacacauggaacgagcauggcucauaauuuugaguuucuucuucuggagccuuacuauuauaugcucagaaaccaucucugucugcgugguaucucuccucuggcagugcaguaggucacacaucguugagguuaugagcuuuggagacucuuagacaucagcucucauguuaacucugugauuuugggaaaguugaccuauauguuuuuguuuucuuuagugugaaacaggaaugccuucugcauagcgaggcugucagaaaagcccuugacacuuucuggucccagagagggcaccgcagccacccaggccugcccgugagagguggcagcucugggaggaacacuccuuaggccggugugugguacugucaggugcuuauuuuuguuucacaaacuugguauuuauuagguguuccaggcuuuguucgacccgggugggagggaggaucuuuguuggaggacucucacuuucuaauugcggguuuuuguucugaagccauaggguguguugccgucucagcagggaggaguauuccccauuaacgggcagguggcaucgugggagaagcaccugcugugcccgggggggcgggacugcgcaggaucagggggaugcgcgggagccaguggugcugacacugcauaccaugugucaggagccuuggaagucggcuuaaaugguuuaaucugauuuaaucuucacaaaaaccuugagggauaggcauuacgauuaggcaccacaguagaaacugaggcauggagaggugcaacaguuucccugaggucacacagcucuucagagggggagacaggacuuaaacacgaggaggcuggcuccagggcccgugggcuuugagcgaggaaggccuucuaggucuagacguuccuaggcuggggcucagugauacccuaaagcccaugcacaccuccucagaccuggcuccugagaggcaguccuccagaguggccucuuugcugagacugugagccugggcuucugucucuaaccacuagcuacaaaaggaugcuggacagacauccuguaccuagggacaccccaugauggcuugucccccgaccacagacaccccaugauuggggauaccccgugaccauggaugccccauaaccacagacaccccacaacugggcagcucaaggcagcaagugccuuccuugugugcuuccguuuuguugaggucuuuguugcaaacaucguuuguugagggcugccuuacccuuagaagacauaguaccauuucugggaaccaugguugcuguugagaaaugcauccuuacacgcccagauccagccgcugucuggucccacugacauggcacaggaaucaaagcaggugcuugggggaugucaacaguugaauuuggauuccucauaaagcaauguuagcacaugacacucugugaggaaauaaugaugcuacuuuguaagauaagaaaggggaaacagcugcguugguggauaauuguuaacggugcagcugcagugugaguugcacacuggaagguguuugccgugaccugucgcgggcugagcuuuuugguagccuggcauugugguggaugccuuucauuccauccgcuguggcugaguucugcuuuccugccccugguucugcaguggcgugacugggcugcuuacaggcccugucuuuccaagccaccauuuaauuggggagggcuacugacauggcaccauugaacuugagaccugccauuccuccgguggcaguccuuggagaacagggccccaggucuuucugaccccacaucauuggcauggucucgcagccaaguagguuauguuuucugaggaaaucaucaugucauucccaucuacuguuaauuuuuaaaaagcugugauuccugaugaaacaaacuagagaugaugcaggaacucuggaucuaaauggucagucacuaucuucugcaacuugcuggagugcagacacgucucagaauaagauauucucagacuagucagaacauuguuuccuuucuuuaaaaaacaaaacagaaaaccacugagcccagaguucaaggccuccuaaagaggaagagggcuuuggcuaccugcagauaagaaagguuuuggugguaaugcucaagugugaguuaggugugggcgugagcaugcccaguggccgucccguccuccuggagacaaaaccauuuccgggguauccccuggcuaagcauuugaaagcagcaauuuauuuucaacaguuucuauccuuaauauuuaaaaaauaggaaaguguacucaaucagcuuucuguugacuuucugcugccuggccggcgucuuguaggaggcgcucugccugucugugcaggaggcuguccagggugugcgagccacgugggccagccucugugggcggacugucccaggugggugguggugagggggugaauuccuccuucacauuugcuuacaagugcuccuuuuuugaguguugggagcacaucuguguaugaaggacaucauucggacgcuuuccaggguggugggaagcagccucccuuagcccggcuacgucucaugaaugugcguggaccccgccuggccuucugcccgacauguacuccaccccgccuucuaccaggagccaaggcugugaccauugugaucugaacaagccguugagagugugcucuguugucagugaauuaguucagagagucccuccucguguuauaguucucaugaccacugcgcaguguugcugugcucugccucugacggguggcugccaggcauugaaaaaauaacaucguaaguccuuacugcuaacacugacuuuuaaaaacauuuaauugugugccuuuuaaacuuuuguucuccguacaacgucuucccgauauuuagauuuuaacuuuuaaaagacaguuacaaauuauuucuaaaguauaaagucugguuguuguuuuuuuuuuugauggagcugugaggaggaaaaaaaugagauauagaauuuuaguguaggugaucuugugcuuuaggauaaaaccauuuuucuguuacugcuuuuugguaucuaaauccccggcaguuucccccuucggauaaagcaucauguagguuuuagcacaccagcggguuccuggcucuuuagugaaaagguggcucugaggauugcccugugcccgccaugaccauccugguggcuuggcgacuucauauugacugcaggcccuguggacagaaagaauuauuucuuuuuuagagaaaagauauuuaugaccgaaaacagugcuaaaaacaugagaauauugaucaugguuuugagagaugcuugcacugaaucacuugauauaccuaaauaucggcuuuauucuaucuucccuaaaagacagauugccaacacaaaagaugaaccaucuugagggaaaaaaaucuuauaucuuucugauaggcugucuugcuuccuuccauaacaauggggagaaaagaagucugugugguuuccugaaauaagcaacaaauauaauaaaugguguaucggaagcuucuguaaaacugccuuggguguacuuuauuuaacuuguaguaauaaguuaaauuaacaucaaauggaaauucaaauagcuaaacauuuaaccaaucuaacaguaaacaauuauucuaaaaucaacauaaaaauaaagacccauuaucaucagaagaccuaauucauuguuuuuagagguaaucucuugggguucuguggaaauuuauaaaggaaugagugaggcuaauuauuuacucaucagauuuuugaaggcaaauacuuuucuguuauucuuaaauuuuagaccuauuuuggaucaagaugguguguugcuuuuguaguuuaagguagaagauagugaggcugacuuccuuccuuaucccggguagaaagccugacuuuuucuggauagauugcagccuagggguugugguuuugguccuguucugcccuuuucccaaauucuucuucauugcaucugauacaucccccuugccugcagggcagggcccugucucuguggcacacauagcaggaccguuuacauuuccucugcucacaggugccgcccacaccuugcuuccuauuucauguccuccucgucucuguaguugagggaagaguauuccauucaacagauggaaacaccauugcaucugacugccaugucuuugaaaccugccagaccaagucuugacuuucguuuuguuuuuuuugguggagcugggaggagacagaugggccauacagucuaugugugggugccuuggugugggacacaagaaagugaggcaggacguggagcaccaggucaucagagcuggcagaggcugcuccaccgugcaccgaagacuuggcaugucaguggagccaggaagucuccgaugcagaagcggaagucaguguggccacaggagcgagguggcaaagugcuggccuuggaggaagagagaggucagagaguagacagagggugaggccuggaucaucaucagaugagcagacaugaaagccgcucucaacaggauuagaaaacacaguuucuaggggauucuugcagggaaacagacauggaggggcaccauuugguuuguaaaaggaagguauagcccugaaguuggcaagcucuuggccugcuggccugaugcagcaggcagcugagaauugcuuggccuguccaugggggccugacagguaucucaaauuuuaauugccagcacacacgaaucaggagauuucauauuucaaaaagcauguauggcugcuguuucuuuuuuguauaaggcuuaauuuguuuuuuuuuucauguuauagcuuuccugagauacauuuuacauacucuaaaauuuacccauuuaaauuguacagcaugcuggguuuucaugcauuuauacaguuguguguccaucaucacaguguaauuuuagaagauuuaaaucucccucuuccccacugccccugccaaaaaagggaccccagaccuaccagcagucauuucccaucccccucccucugguaccagcccaccacuagucugucugugucugugguuuucccuguucuggauguuuugcaucaacggaauccugcaccauguggccuuuugugccugguuccuuucccuucgugugguguuuucaagguugcuccacgcuccagcaugugucagaacuuaauucccugcggccaaacaauaucccaucauguggaugaaccacauuuuguugaucuauacaucaguuaagucaguuucgccuuuugguguugugaauaaggcugcagugaacauuuguguauauauguguucauuucucuugggguauauauacacacacacacacguaggccuaggaguaggauuccuggguccgauggcaauugcauguuuagcauuuugaaaaacuuaugguuuucuaauacagcugccccauuuuacauuccugccagcaauguaugagggcuccaauuucuucauauacucaccaacacuuuccauguugucuuuuugauuuuagccauccuaaagggcgagaaagauaucuucuuguguaaaacgggcaaauaaucaagcugggaaugguaagcaggguuuuuauucacaauagggcugguugaugggauucacaauuacagaaggccacagagggaggacacacuugguguacuauuucuuuuugucaaacaauagcauuauugagauguaaaugacauacagaguauacauacaguaguucccccuuagucauggggaauauguuacaagaacaccagcagaugcuggaaaccguagaaggcaccaaacccuugguaucccugagggguuggcuccaggacuccucucggauacuaacauccgcaggugcucaagccucuuauauaaaauggcauacuauucuuauauagcccagagacacccucccauauuuuuuaaaucaucucuagauuacuuaugauaccuaaugccuagauaucacuucauucuugugaauucaacguaguccuuaacauauagcaaauucaaguuuugccuuuuugaacuuuguagaauuuuuuuccgaauauuuuugaucugugguugguugaguccgugaguccguggcuguggagcccaugcauauggagggccggcugugcaguaucuuuuccuacacauacauccccauaauaaaguuuacuuuguaaacuagcccagugagauuaacagcagcagucuauggaaccauuauaacaacaugccagcaucacuauucuugcacuucagggccauuauuaagugaaaugugggugacuugaacacaagcacugcaaugaccuugauagucuaucugauagauaccaagauagauggcuacuaagcgacagaagggcggggguguguacaguggggaugcaccggacagagggaugauucgugucucaggugggauggggcgagauuucaucccacuacucagaauggugugcaauuuagaacguauggauuauuuaugucuggaauuuuccaguuaauauuuuuggaccacgguugaucucaaguaauugaaaccauggaaaguaaaacuguggauaaagggggccacuguaucucacauauacaguuugauaaaauuugccuauggaugaccccaaucaaaauaacaaauauucucaucacccccaaaguuuccucuugcaccucugugauuccucuccucaccucaacccgcuuuccuuucucauccccaggcaaucacugaucugcugucacugugcauuaguuugauuuucuagaauuuugugaugcacauauauacauauauauuguauuuuacacaaaauuuucucguuuuaugaauggaauuauaacguauagucucuucgugucugaguucuuccaguguauugaguuugauauucaugcauguuguugcaugugucagcgguugauuacucuuuuugcugagugguauuccauuguguggggauaccacaguuuaucauucguuuguuauuguacauugaauauuguucuuucugcuuucggcuguugcagacacugcuaugaauauuuauaugaaagacuugguaaggacguaugcuucuaauucucuuagguaaacaccuaggaguggauccuaugggcaauggguguuuagcauuuuaaaaaguugccaaacuguuuuccagaguggcugcaucccucugccguuuuuaugaacagugggugggaaugcaauucuugcauauagucucugauuucauaucauuuuccuuuugccuggaagacuuagcauuucuucuguggggucugauggugauacugucuuuuaguguuuuuaaugucugaaaaaguauuuucauauuuaaaagauauuuuugcugugcaaagaauuuugaguuuucucuuuuccuuuucuuaaagaucuuguuccacugucucugacuugcauuguuucggaccagaaaucugcugucauccuuauuuuccuucauguauguggagcauuuuccccccuccagggguuuuugaguuauguucuuuaucgcuggcuuugaccaucuggcucauuuuuuggguuggugugcuugucuucaugugucuagugcuugggcuucauugaguuucuuggugccaucaauuacaucuauauuugucuguuuuaaguuaucccacaguucucuaauauugugauuuuuuuguuuuuuuugcaguguuuuauuuugguaguuucuauuauguuuuugaguucacuaaucuuuucuucugcaaugccuaauaugcuuugaaugucaucuaguauguuuuucuucucaggcauggugauuuuaauccauaaaaauuugugucauuuuuauaucuuaauuuuucuuuuucuuuuuuuuugagauggagucuuguucugucaccaggcuggagggcaguggugugaucuuggcucacugcaaccuccuccuccuggguucaagugauucccugucucagccucccaaguagcugagacuacaggcacaacccaccaugcccagcuaauuuuuauauuuuuaucaugauccacccgccucggcuucccaaagugcugggauuacaggugugagccaccguacccgaccuauauuuuucuacucaccuuuuugacaugugaaauacaguuauaacgacuauguuaauauccuugucuguuaauucuaacaucuuugucaguuuuggguugguuuugauuuuuuucuccuccuagcaguuguauuuuuauucuuuuaugcuuuucuuguaauuuuugaauggaugcuuuauaugcaaauguuaccuggcugggugcuagguuauuuauuuaauaaauauccuuuagcuuuguucugggaggcagguaaguuacguggaaauaguuugaaucuuuuggaucaugcuuugaagauucacuaguugcaacuacagugguauuuaguuucaggcuaauuauucccacaaccaaggcaggauuguaagaggagagaucauggccggggacucauggcuagacaaaaaacaggaccucaguccuaucagugcaaggaaaugaauucugucaauacauagugagcuugaaagagacucgcagccucagcccugggagucucaguugcagcugacauuuugguuucacccggagaaacccuuagcagaggacugaguccacccgugccuggacuccugacccauggggcggaugagacaguagauguguggugguuaaaccacugaaucugugguaauuuguggugauuuguuaugcagcaguaagagguaauaccguaugcaucuucuugcaucauuuaccagcuuuuuauuauauguggaagucuuacgucuuuccucccuuuuuuauugcccucugaguaccuuguugucccuuucugugucacauucuucccacucgcacgcaugcauccaggaauaagagcacuguggcucgguguggccaagacccacuguguaccuuccaugaaagauguuugugaguagcaugggcccccgaacccuggguccaguccugccuguacugcgagccagcacugucaucauggauagugcccucagcccauacucuccucugugaagugugugugccagcacacugacaucacagggugccugcagcauuuggaaaacacgcagcaucaugcaaacugccuaggagugcucaacaauuuggagcugguaucuuuacacuuaccacguugaauauugcaugcagacuacauauuugcagagcuuaaugaacagagaggcauuuuaggacaacuaggagaaacucgcgcagauuccccucagggggagggaagcuguuuuguaggugucucuggcaguagccuaaugcaguugcuuuagacccugguggucuggauacugcuucacuguaggcuuuaauugcauugcuccaggucuguggaaggcuggaagaggccgguguuuuugugucacuuuugcuacccccuacucucucuaguugacaggccauuuggagcaccagggaguacaaucuggcugaagaagcgguauccaaggaggacgucauggugucuguucucgcagucauggagccuagugccaacaggccuuaauucuguguucuggugucucaugaguggcucugcagugggacgucagagcagccaggccucaagccgccuggcugggguggggacaaaguguguguugucccuucaucacgggaguguggggccuggcacacgcccugccagggccucacuugggccaugccucagagcaugggugcuacucaccucugaccucuugaguuuugcaggcaaacucaggucgaauuuggauucucagucgcauuguggcucacaugacaugaaauaaaauguugacauuuauuugcuucuuguggccucuacuaaauauauaaaauaaucaaaacugaaacuuuccauuauucucagcaggagugaaacaucuugacuuuggaaauuuuuccuagugauuuaacucaagucggauaucggcagcaccaccugcaauagugacccccuauggccugcggcggggcugcuuaacgcucacauggguggucaccaaggaagggcugcuggacaggcagacucccagagcaguugcuacuuacaaauccagcuuccagcagggagaccauuaaagggcugcuuccaccuccagggcgggcagugaagccuccagcugggagccgcgugaaaaucagagccaaugggagcuggcagcccauccaccaggaggguccagaagacagaggcagaggacgugggaucuggagcccaagggaggggucccagguggguugaggcuggagauggcccaggaagcccugguuuggggugagggugggcgagacugagaggcugcucagacaggaugggugguugaauggagugcggaucaugagaucaucacagggccacagcauaucaggccauggguucccuguuaauuccucucccaccucgaggaccggagcuucuguuaggcaggcgggggcucugccgcaggcccacauucucugcuaauucccuucucuccuaaagguuucagaucugucuguggucuuuuguuuuacuuggaaacacauguuuaauauaucuuauaaaauacguuuaauauaaaaauauaguucacuuuauaguucaguugcuuugagcacauuuaguaaaccaagaugugcuuauaugaacuuuucccugaaaaguaccuggaucccagaguucuacauggauugaauacuuauguuucgauuuuaauuccuuagauggcuaacucagcauuauuuaaauuuuaauaaagagacuggauacaaugugagcgaauuucucucuauauuuugugaaucucuaucagagcaaaauaaaacuguuucuguuuugcaaugaauaguuucuagccauggaauugcuggucgaggcaagaaaguaugaaucuuauuuuuguggaucuagccaagaaaaagaacguaaacuuugaaaaguaugucauuugccauucacagucuaaugagaaacucagagaggcuagaaacucucaauaaaaauucugauaucagcauuuaagauccagcaagauaggguauacgggcauuuaagggauucacaauccacaguuuacuggcacuuuaaaugcugugaaucuuguacuggcaaucacaaucuugauuuuauuaccgagggggaccccucgugaggaauaugucggugcagugugcagguuaaacugugagcugcuccagccucucucccgccggcugacggaaagguggucaaauuaccuucgcaaaucugaagggugcuuggcuccagcaaauuggccauuuagucaaaaagugucugaaaaugacguagucguuggaaguguuugggaauaagcgaugaguuggccaaacgcaguguguuuucuguaggcaagcaccuguggcagcuggcagggaugggcaggccugcagagauggcuuccugggggcgcagcguggucaggcuugaggguggugacagugcccccaggagaaggcgagacuggccagaacugggacgggcaugaugaguggccguguuucaaauauuguccauuuuuaacuuuugaaaaugccaaaagcaaguaugcugccuuguggaaucugugcaagcaguucuuuccaggcugaccuugaauagccugacagcagagcgaggagugaaaugagcacgccucaggcugugguccacucgugcgggaagacauggaccugcuacugcucccugcccucugucuccccaggaaaggagcauucuggcucagagauucucaaacugggucuuccaagaccgcacaggugcugugucaggucagagaugccucuguaacaacgccaagaccucgcguguccaagagugaugcugggggaggcugcucuagcuggaccuagauccaggccaggccccagaccucugcagcuguccaccuacuccucaccaccacgcguuugcaggugguggacgguguuuuauuuaagaauguccuuguuggccggacgcgguggcucacgccuguaaucccagcacuuugggaggccgagguggguggaucacaaggucaggaguucgagaccagccuggccaacauagugaaacccuaucucuucuaaaaauacaaaaaauuagccaggcauggugguaggcaccuguaaucucagcuacuugggaggcugaggcaggagaauggcuugaacccgggaggcagagaucacagugagccgagauggcgccacugcacuccagccugggugacagagcgagacuccgucucaaaaaauaaauaaauaaauaaaaaagaauguccuuguugaagcaauaaacgcuaauuguacuacaaacugacccuggagcaccucucuuuuuaguagacacggggaugaagugaagugugcguaaagcacuucugccauggaccaaagcagggauguuuuccggaggaaggguuugcgugugacucagggugacgggaguggccacuuuuuuccuggaauaccauuuucaccauugaaaguaucacugaccagccaaccauauuuacccacacuuggguuuuuggcagaaauuuucaaggaaaauagcugacaguauuuguugcuaguacugaaugaugaaaucugaguuucaagugaaaaucauaauuuugagaaacuugcaccuacugccgugagcuuaacagcauuucaauguuuaaacaacguuuugcugauaccaguguggcauuaacuagugugaauuucgguagugugcuguggcugaaaugccuaacguagauuugcauaccucagugaaccaguauuuucuaaaugauggauaauguuauaaaauuaugccuggguaaaaauccaaaaugcaggcuaggugaauggauuuuaauggaaccgugcagacaguugauucggaaggcuucaggguccacauggaaacugugguuugggagcugccccuuguugagaguucuguucagguaucaaaggagaguauccacaguggcccaagguagauuuucuuccugcacgucagccagagcccuguauggaaacagacugaaggcagaagcagcugcgagaguccaccugccuucuguuaagccagcuguggaagacagucucaaaaauguaaaccagugcaacuuuaauuaauccuuuuuuuuuuuggaaaaaugguuauuuuucaugaaaauguuauaugugauaacaugaaaucaguucauaacuauuuugaaaugaaauauuuuuaaauguucucagcuuucauuucaaacacaguaucaauagaaauaacuugcaugaggaaaaaaauagcucuuuagaguccucaugaugcuuaagggugagacugaaaagucagacacccaccgccccagacaaacaccaugguggccucggggaugcugcgaggucagagaaccugcacucugcuuccuucuuguguagggugagggagaagccccaagccguuucuucucagggcucaggugucucucaucaguguagggagggucuucgggcauccuaugcccugcucauucccucgauguuauccggacaggagauuucagcuccugcgcagugggcgcuguugggauucccaggccuccaagucaugacggugggugaaauggagcugguauuugagaaggcucggaagccuccccuuagaaagguggguccugaucagcaguuugggaugccccuguguuuccugcauuugggaugggcgguccucccuccugccuccccagcucucuugagcacaguguggccggcaucuggucaggacuucagaguggccagccccguguugccgacgaaucugagagggagccccuggcuucuuauuuuucuuugaacuacgucaacggaauugcuucggauccuuagccauuuuaaaaaacacagucauaucacguccccuucugacauucucuuaagcuuuagcaaauaacagaaauuucagucucacugugccuuguucagaggugacaacaacaauggguggcugaggcguaagucucaaucauccaggcuccuuaaagcagcuuucgggcauguguggggaaaguacgccacagacacccagggcugugcuuccaaagagguuuucaagagguugaguauugacaccuuuccuuacaagguaguggggaggccuggaggccaggcagugaggcgaacagugcucagugaauccacgcuccaggugaggggaggcaaaugucggcagagaaggugggagcagaggaggaguuccuuaugcagaggucucugggcaggcagaggaaaugagccucgacuuugcucugcccugggaagggaagcuugugauccacauuauaucagugugggguuuuaugagcuggacugagaugguugaucuaaagucacaguuggcaagucccuguuuaugcgaggccggcaaagaauucaccucugagugaucugugggggcagcccuguguuggugccugaggccucugccuuucuguggaggucuggcugaugcaugaggcuagaaacagccauucauuuggaagagggcguugcaaugacucagccucugggcuuaagcuuuccuuuugcauaagaagucugagggguccucagauguuuuaucuuccuuuacaaaguuguguugucaacaccaaggaaacagucuugauucugaacaaggagguagccuggguacugaaggugaaaagagcucagaucagaaguuucuuggaaagagauuuaaagauuuuuaaaaaaucagauuacuaaggcauauuaaaauauguucagucuuacacuguguucuuugaaaccuugaauuacucuagcaaaaggcucagaggguacugcuaugagaagcuggaucuuggacaucucuuucaaaugccucgguaccuuucaaagggcuuuggauggaaugaagggacaccauugggucucacagcuuucuccugccuaacauaccacagcaguguaugaaauuguucccaucagcuccagcgcgugaaagacaauacgaacaguaacacccccaaagaaacaguggggcuggagacagcagaauccuuggaggguucucuggcugaagaaaucucucuccuaccacagauacuguccccagagaaggugcaccucuaccaccaaugcccuccauccucaguugacaaggauucaaaaaguuuguuggugacgcugacauguaauauuccccugcgaguuacacacauccaggugaccuucggaccagcauugccggcacacccgucacgccaucaaccugccaggcuggagaagaccgcucagagcuuuuccuugacuggggagaggggagccggagcagcgccccacgucucacgguucaccccugccgucucucggggccuuccuucaggcuuucccuguauccucagaucuucgccaggguccugugauccaguguuaguucauuccaugugucauauaugaaugaugucauuugaaucauuucaaguccuuuuguaggaaaacuaaggcagaaaggccagcaccacaaagaggcauccagaauucuccucggcacaggagggugcagccauggugccuuugaggagacggacacgcuuaguucccccugccaucagugggcaucucgauguuaaccagaucuuagaaauugcucugcucagguuggacucauaaguguacucuuagaugcauucuuccauguuuuuggaauuuccuagagaaaacgucuucuuuguucaugcccgugacacacguuccucccuguggugaccuggcguccauccugagcuuucgugguguccacccaugaaaacaaaggugucugaucccccgugccacagacauacucuuaaccagaaucucccaaccugggguccgugguggucuucgggggggucugacacuacccagggucagaugaaaaguguugacuggaugcguuuaugugggcgcugcgauacucuucuuggggcggggcccagaggguuccugaaauucucaaaagugucugugucccuccuugugaguaggagucacuguuucagaugcucagcuuuccaggugauuuuucaaaucccuggcacaggcuuucaaggugacuuaagauugucuaauccuccugcagguagaaaugagagucaucuggcugauggucacgagccgucggggaguuccuccugucuugcacucaagcagaggaguaaggagaccccuuuagaauguacuucuaauuguugaaaagcaccuaacaaguuuucuaugggggagauuauacagggacuggguagggacaaucacguaagacauaccuguuuauagaaagagcuggauauagaauuauagguggguucagcugcacaaagaagagucagacuacggaggcuugaaggagcugugaauacacugggcaucugacaucauugcuuacuucccccugccccgcccugccccucccugccccaggguaucgguagcauguguccuaauuaaauuuugacauuaugugaguuuuagcaugguauuuucugcauugggcuaucuguauaaugucauggaguggugacauaaauaaugcuagacuuuuccaauuuaucuaccaucccagcccccuccccaacucagucauauguggaaagucaguuucuuuuuccauuuauuauaguuguuaacuaaagauuaaaauuuuacauuucauugcacuguucauaaauuguuuauaaauacagugaaaucuaagcaaaccaagaugaucuuggaaagaaguguucuguauggaauuuaucuguucagacccaacaugcacacccuuccuucgggauguaucaccaagaugaaggcgggcagaucucaugggcaugagcuugugugcaccgaggaaguuccugcaagcaguccugcugcaccugggcgggggacacccuguggagaaccacggugcuugaguggaaggagucugugucuguuuuucagaaugccuucuugccuucacaacuaauaugcaacaaaaauaauaggauugcaccugcuuuugaugccucaagauaugcagaaauacauuucccucacuugagcaugucucuggauauacuaggacagcuaggucgugcuugcguuucaggccacggcccugcucaggagucagguucagcuucuugcauugagucuuauccgccacagcccaacuuuaacaguggaugauagccaggaaagagagggaagcauuuuuggagcugguugugguuuuaaugaggcauauacagacacugcuuuaguggauguaggagugaggggggugggguguagugguugaggaaggggcuuagugggcuggggugaaggucucugcuggagaucuaggaguuuucccuaaauccucaucugaucuuccucuccuguagauuguuaggauaaaugagcaagaagauucugcgcaacaaacugauaccuugcuuucuuuugugagcagcagagcuggggcguggagaggguacguccaguguuggaugucaggaaguucacgucccaggguaucuaguacaucugagcucuaagccugcaaaggaaccuucuuuacaaauugcaccauuguuaugguuggcauucugguuaaaaguucaucuggaucucaaccucgcgugaaauugcagagcuacgacuggaaaacucggcaucaguugagaaccuuuggggacuucucagacauuacaguuagaauugagcaaaacaugcugaguuccauucacucacauuuuggugaguggguuaaaauaacaguuuaguuucgucauuuuuauuaccuacuuuucagacagauccagaaaaauaaaaaaacaaaaaaaaagacaagcaucauuaccauguuuaggaaaucuuugagaagaaauauguaugaaauuuggcauacuggcuagccauucccuuacccccuuauuuuugauuauccaaaagcucaaggugacuuugcucuuccccucugugacugggguuagcaaacaacagccaugggcuagaucuuguccaccagcuguuuuugcaugaucaggacgcugagugugguuuuuucauuuuuuaaaggguuguaggaaauaaagagacuauugaguagagaccucacaggccuuggaaagugugacauacuuccuaucuccuucucuacagaaguggcugcugacuccugcucuuuggggucgaaacacaaagacugaauaaugaugugguauuuuuguauuuaaaaaauggcauagggcauuuuuagggagguuguggcauugacguauucuguguugcuucagagagaugucguucgguggguagaggcugcgcaguggcccacugugauuggcauggugguggcucucggccccugggccugcucugcagucagguccaccauguggaagugcucugagacucggugcacguauucaauguuuagugugugccagccacguucuaggcaccguggaugcggccagcaaggaagaugaggacccuguucucaugcccagccucagggugggugcauggagcaucccuggucgagugugugcucaggauuccuuuaguaugucaugaaucugucguguuucucagagcagacuuaggagccaggcucccugagauugaacccugcgugggccacuucuuugcuguggaaccgugggcaagucucuuguucuuucuggcggcuuccaucuguauaaggggaugauagugccaaucucuuagcguaggugacagauuccgaaguaaagggcuugucaaguaggccuggggugggccuggcacauccugggggugcugccugagggucagaugucaucuugguggcccacacuccccugcaguggugcugcugguucaggaaguuaaaguggaaaacugugcuccggaauaaacacaauugggagaacccaaaaccacacgcaagaaagcaaaaugugcugcccgauuacuaagcauggaguuaaacucuauuugguguuuuuguucugaauuguuagggaguaagaauauuuaugguuggaauccuuggccaauccuaaauuuucuucuaacuaguagauaauuaagugucugcuucuagaggauguagaugugcuugucuuguauauuacaaaguagagacgacuugcccacacccccuccugggcucacacuccaugcggauggcgucaguagcuucugagccucuucaggugcugaacacaugcccugagcugcuuguuuugacagggacaucauuuuuaaagaguccuuuauuaccccaguuuacucaccucuuguugucuccagcccuucccuuuuuuauguucuucucucccuuuucccuuagcaauugcuaauacccuaguugguacugauaaaagaaaaacuuaagcugaauugaauuuaaaggaguuuaauugagcaacgaacaauucgcaaaucgagcagccucccaaagccagaguaggcucagauggacagaaaaaggaaagugacagagacgaggcacagaaacagccagauugguuacagcguuugccuuauuugaacaugguuugaacagucagcuauauuggauuggccaaaacucagugauuggcacaagaguaggcuacggucuguuuauaccuccacuuguuauaguucaugagguacagaaaaaccuugaggccacauucaaaacauggaaggaggcagcuuuaggcuaagcuugauucaacagguugcucucgucacuaggaaguagucauguacaaaugcaaaugugcuugaaguuucaaccuaguuuuuagaaugugggauccugauggguauuccucucaucuugcugcuucuugucuugcgcauuuaucaucccuucgaggcagugguuucagaucuuaauccuuuuuccuagucaccuaauauucuaagauguggcuauacaaagcauuuccaaccauuguccuuccccccucaaaaauuaugguaauaagcguccuucccaccccacagauaauacugcagucagugcagacauaugcuuguacaugcuuucacacacgauucacugaggccggcaagucugugggagggaguucuauaacugaauguuuacacagggugugcauaucuuucucuuugaauagguuguuucuauacuguuugucaugaaaacucagaccauucccauuuuaccauccuuucuucaccagggagauagagugacagagcaacuuaauuguugcccaucugaugcggaucaagugucauauuaacugugcauaucccugcaacguuugcacacuaauguacauuggucuuucuagaugccuguuguuaccuauagguaaguagguagguagguagguagguagguagguagaugucugcuagcaauuugacgggucauuucuuuuugaaggauaaugaacaaauuugaaaccuguggcacagccugggaccuaagucuguguggugcagggagucuaacuucugucuaagucaguaguaucuccagggauacagccuuacauccacugcuggcugcggcuucucugagcgacccaucucugcguccgcccauccauggcugccaucucgcacaaaauuauuuuccugggauggucccuugaguuaguucgugguuagggguagcucucaccuuagucccuacaaacccaccugaauuuccuuugucuccgagccacaugggaaggagacuguggaaaauaaaccaagagauucucuaguagguagagcuagaggcaacagguuaaaaucacaucuuuauaggagaauguuuggggaaugcauucagcagucacccauucucauuaauagacccagaaaacaauuaaaaaauacacauugugauuuggacugggcagacaugccgacuguggagccauuucuuaagagagggagguuggcagguagcuggugagccuauuucuuugcucauugagcuagcaagagcaacacccauuacuuucauuggauuacuuguuugaaaauuaaauuaaucaagugagguaaacauccguauugccucuuagcacccccauaggcugcccgcaaaauggccugcguggguauccuaagagcaggaauuggcuaugaccugccgagguggccaacucagauguggccaguuuuccauacaaguaugaaguuccugaauuaaugggaaaccuggcugcauugucugauggcuuacuggcaagcaguaauuagaaaacauuuuucauaguggaaccucagguuuagcuauccagagaaauuggauauuucaaaauacuccuaguugguuagugaaacauuaguauuaaugacaaauuaauauuaauaucaauaucagaguugaguauguagccuuugggaagagaagggaaagauuuuaaggaccagauuuaaguagccuccauaugccuuuccuucuugguggcauuuuucaucugaaagcauuuuuuuuuuuuuuagcucaaaaacuuagaugugaaaaauucaacgcauugggaagaggcgucaacauuugaaccgcaaaugauuaaaccuuuaugacuaaaguaauagguuuggcuucagucuucccaguggaguagcaagcagagguccuuuucaguuugcaaacaguaguauacaaacuugguccauaucaaauacuguuucucuuccagggcuugugugugcacugggaacagcaacaaaaguugaacagcaacugggugggguuucuuuaugucuucuguuuaaucagaguuuccugaugguuuggccacuucauucuccuuuggcuuaagggguucuaagccauggggcagaccuuggguggcucacugcucuuggaaggaggguguccagccuuccuggcaguguggagaugaguaagggaaacacugcaggggcuucuggcuuccuggauccugccccucaccuggggacuuugucuaaguccucauccuagcaccaccucgagaucgauucaggccuccccagcaguggcagaaauccaaccaugggagcuaguggguuccauuacuguggaguagggaagaagacauaugucccuucuaagucacuuuaauuugguccaaaauaaauaaccaaaguccuuggggagaccgucagggaaguaucuucccacaucacacuuggucuuugcaagaagugcuggugggcgugcagggcuucuugacacuucgcagcaacguaaggaugugguaguagagugcuugguguuccaguggccacugcaauacaaauagagugaguuuugucgccgugguacauuacagccauggaaauuccccguaguucauugguccgugaccaacaaaaaucccccuagacuaacaauuaaucaggcucugcugagccuuugacuggcgacaguugcagaugucacaucaugcgaaaaguuaaaucucagcuuuccccaagaaggaaaaaaaguuuauuuuuacaguuuauggaacuaguuuuccuuuugaucaaaugaccuggucuuuaggggagaaauauuuucauuuuuauguuagcaagugugauacagaaucauauacauuuaaaaucuucauuuuuauugcuuuuuuuuuaaaguacaaaauuuuaauaguaauagugauuucaagaaaauguugugagugucacuuuacuagucaggcauguugaaaaggaacgcgcuuccugaaaucuccaagcgagguuggcauuugagaccucuggguacgugagcuuaaaauuaauauaaguaccugagccuagagcccaggagguuuagaaagacucagagaugcgcuuaaagauaauuggugugcuccucuugugagagcggauucaccaaaaugaaguuaaaauuuguuugggaaguugcuuguacugugccuugugaacuuacaaaucugugucacaauccaaaggguugagagccacacaaagcaaaacagaugggccgugugucguaggauuuccugcuguccuuucggcuucagguaacuaggacuugugaagcacaagauacaugggaggcaaaucugaaaaggaauggugagugcgccccacgugccuggguaauaccugagugcucccggcauuaccugggggcugccacccucccucccccuccuuccuuuccagcucaacauugaggugaacuuuuuaccaugaucgauguagcuuucuggugucuacacagauuucuggauggccucagaaaugucacauacugcuucgggaaugucugcaaguauauuucauacauuuuaccuggcaauuaaaaaaaagucaucuuuaagauauuagcauguggauaccgagguuccacacaaagcaaacaaagaggucauucuuagcagcuaauuuuaaaucuucaggcaacuauacgaaccuaugucacagucucucccaaaauuuauuauaaugcccuuguuauaaauuuagaauauuuuugcaaacucauauaaacaaguaauugaugcgacuaaaauucuugucacauauuuauugcacuaucagcuaaaauuuuuaagugacaagaaccaaaauaaucguuaauuuuuauagggcaaggaucuggcuuuuugucugacacaaagcuguauaaaaaacugcuucugauuuuaugcacauuguuuuuaguuaaugauuuucagcuguuuguuguuucucugauagcaugaaaauguaccauaugcucagcccaaagacagaugauuagcaagugagauuccgggcagcugucugacugagcgcguuggguugauagcauucugcuaucauaauuagcuuaagcuuuggguuaauuaacuuucuaccuggauaugcauaauaauagcaaacugcaaaaagcaagaagcuuucaguacaucaacaacauugcugucuuuuuuauuugguauuucaagagcauauuagaauuucaagagugauuaauccugggaauauugucaucuacuguagauuuuauuugcaagccagauaauacugaaacaauuggaaucuauuauagagcagaaauagcauuuuaaaauuguaauuaaaguuucuaaaagcaauugcuaauuucaaaugccuuuguuggcaagaauauuaggcacacugcuucuuguaugggcagcuugucgggcacaaaaaauaccagcacuuacacugugaagaauaaaacuuucuuuuauuuaagggcuguauugaaaauaaucaguuauuuuuauguaauuugaaaguaagauuacucuguaguuugcagaggugcuguucagacuccuagauugaagauauuaacccugugcccucuugcagguucucaccuuuguuaccuccugagcaguggagggcuggaggccuggguaggagugccuggugcccucuuagaagauuugaugugugcgugugucugcgggugccagaggucagauuuuucaaaagucagugcuauacauuuguagcuugauauuuguuuucuaccccaagcaguuucuaaaucaauuuacugaugguaugaaauggggagagggagggcuuugucuccauccuccuccuuguuugcaugauuuaccaaagcacucucuacgacgcucaucaucugaaggggcugccggggccuuuggagagcacaagcuagugaaguggaugguggauuuggaguaaaaauuguaguuuacauuucccaaagcaccagagagccuagcacuuaauucugaaauaagucaugccuguuguuacacucagaaaaauauuuuaucuucugaaaaaaaaauucuuuacauaugcaguggauggugaagauuugguggcggugaauuugcccuggcuccagaggacuuuacuuacagaaucagcagucgugaaaacgugcuuucucagaugugugacuuguggucagucugugggcucaggagcacccauuuggucaauccaugcaaguuuuauggggcugucagaagccauuuuucaaaauuggcuucaucugaggacacguggaggagccacucucuugguguggguagugaaaggaguggcucccuguggcucugucuugggaguugggggcugcagugguucacugggaggagggggugccccugcaggccccaccugcaccccaccucgccgccccacccccuccccccggcuuucaggcugugaccucaaggccuuuuaucauuuucacaaugaugucuccaacagaccuuuaccccagucucaaaaaagauacugccagagccugccuuugcuuuuuguuuagucugcuucgggcugcgucaauaaagauagcagaggggucaagagaaaagaagugaacggaaucacaguuuugguguugaacccuuaaaugggggccccacugucucugcuguguagcaggcacaggauuaucugucugccuucugagauuucuuuuaauguuuuaccaaauuaaacaugaacaauuucaggaugcaaaaacuugacugcaucuuguuguuucuuaaauaagagcacuuuaagaaggcaauauauggagauucuuuugugggaaagauguuucaaauggguuauuacuggccauugaaagaaagaaaaagaggaaaugcaucgaggccucauuuuuuggccugcacauuugauuauuuuauuuuaaaugccauuucaaacauaguguaaacuaaugauauuauuuuuuaaaaaacuuacucuacuauuugcgguccuugaucuuuaauuucuuuuaaugucaaaauuauuuauuuggccaguuccauuccagaugugacuguugagggcacauuaauuucuauucuguuuucaugggccccuguccccaucuguacaucauuucugacuuccgugugcucccuagggaguucacuuauucauauuguagguuucauuugcuguguaaacagaauaaacagacaaugcaaaaauccccacaauaccagaaaauaauucuuuucaacaacauaguggaucauauuuaaaaaaaaacauggaaaaugcaauacaugugaagcccauuuuuuccacuuuauuguccucccgaggaaaggcuuguguuaccagugcauuucccuugaauuugauaaguucauuuuuauuaaaaauccaucccaaacagcauuuuacgauaauucucaaacacguguuguggacauuucuuuguuuugcguauuagcuuggucuugcggguuaauucggaauguguuacucaacugguaugugcuugcguggccaaaaacacccguugugcugugugugugugaaaagcaacauucaagaacggugauuuuuuuuuuuugacauuuacaaauaaagagggacaugaguuauuuaugcuccaauguugcugcaaaguccuuaucuccauuuggcacuaaacaaggauuuguugugggauuugugagggcugcgcagugccucugugcuaagcacccaaaacucuaggggacuggcacuaauuuccucucucucguaaaacaacguaguauucauaacaacucaagaggcuugacauaaguaaugauggcaugugcaggcgaagauuaccacccaacaguguaaucaaggugcuagguacuaaugcaaguuaaauugagacaauaaugccgaaacuugcauugugggauuaggagggcacuugaaaugcugacgugagcacauccugccugccugccugucuggcgcuccguuccuguuuauacuuaaugaccucaaaauuuguaugucguuaacaccguguacugaagugggagagaacacgguuugggagggagaagacucccugucuucguugacuuuugucucuuuugguaauugguggcuuuuccugccguauuagggagcaaagcgugcagcggggaggccccugaggucucuguaaacaugcugugggcaccgagggccuccgcacccggcgcuaggcaguaauuuacauacuuugaaugaaaagucauuugugccugcaaaauuguuauugcuggaagaaauuuaaauacuagucauauggaaauuugaaauaaagucauauuaaauuuugaugcucagaucaauauuguggagccccgguaauuaaaguggguuuguuuauuuggcuccuuauaaauaaaaagggcuuaauacagacuaauuacacagaaucuuucgucuacggugggauaauaauggcagcaauuuaaagugauauuaaaugagaauuaauaaaggaauauugagucacuuugacuguauuaagcugugaaaugauuccucaucucaauuuaacuuucugucuugagcauaauguuugauaagcaaugcauuuuuguaggaauaaucuauaacaguauuugacugcaauauuuaauaacaacuagacuugugacuuuauguuguuuuuaaaugggcugggaaagcccguuuuuucucugcaaauuuauaggacaacuuagaggguucuugcccuaugguagcuucacaagaguucugaguuggcacccuccgguuugggagguagguggagauggcuuugacuuuuguucaacuuacaagggaguaacuucuuggaagugcaguccgggccagcagaaauggucauaguaggccaugguggaaggagaaucagaaccacgcguaaauccucagaaggaagagggcagucauuuuuuuuuuuuucucuuggaggaauaucccgggaagaauuaccuggaagaaaucagagugguuuuggaagauggauugucggauaacauuuuaacuuaagggcugaaguuccuuucuaccuaaguaccauugaagaaguauguuccugaucuuaaacauuuuuaauagcagucuaggccaauugacucugugaccauuaaguaauuuucaaguggacuggcugcugccaggguguuuguguuuugcuuuguuuuguuugcagaguaacuuguguguaauuucuuuccacugugccgcacagcaugucauguccacguuagcauuucugcccuuuuaaaggguccugcugaaggucaggaccucacacugaacacccuuuuuauauauauuacaaauugcuggaauuguucauuaauuucugucuuugaaaugccaugucaacccucuaaaggaauucgcagugccaguuucccuuggacagcugcucaccaugguccagugcgaauuucugaugaaauuacaggugcagggaaaugcagaauuagaaauauaucugauguugcaauacuugugaagcuauagcuuuguugaugacaggacaauuccauuuuugacaguuuaauuuacuguugccaguggacaagagcaagaggaggacgugggguuagccaccugcccccucguaccguguuucacaugcgagguugccaaaucaugacucccucaaccugucgggcucaaaugagaagguuuucagcugggaaaauggaauauaucagugcauguaauauugccugaccucauaaaacaaaagggaaaauugcagauucugacagccauuaugaaucuuguaucagcauccaaaacgacuuggagccaggguauaguacauguuuauaauagaaaaaaaacgggguugccacguugacuugcaauauggagcaaaaaaugacuugucauaauucguucucagauguuaaagaggcuguugaauuuacuaguauauacacagaagaaugcguagcccggagcagaguguggaaauagucccuacacagaggggucugcugaaguuagucaucgaguuagauuagaauggaaggcaggaggggaggaacuccggguuugcgccgcagcugcgucgguggggccagauuucucauuacaagauguacugaaccuuuccacuuucacccacuguaaaucuauaaguaaucaggcuucuaaaauaaagcaaacaaccuuguuuugagauuaugagaaucauuugaauugaauguauucuguuggaaaacugguguauugaggcauggcuuuuuaucuuacgcuuaaaaaguuuuauuuauauuaaaauaaggcauaaucucucugcguauaauuauacgcucuucgauuuaguuuuucuauuuaauagucuauuccuucaccuucuugcccauuucuuuauguuauuccuuaaaaaauaauuucuaaguacaauaauugucucagcugcuuuuggugauuucuuugggaggggagauguggagugacaguccaggaacuuucugcccaggggcaggaggcccagcgcgugcuccccagcugaggccccguccgccuuggccacucccuuucaucucccgggcugaaugcggaguguggugacuuuuauuuuuuccuuugcuauugguuuagaaugagauguagcaguugauuuaagugaaguaaagcaugcuuacgcaguacacugugucccugucggggccugcucucucaugucaccugccggcgguggcauggagacaaagccuucucuccucucuuacugcugcugggccucuccugggcagguccgggcucaguggcuugaacaggugaugcagggaggggcagugccuguggccacagugauggcacagguggacaugauccugagaguccagugggggcuguagcacaggaaaggagguugucuacagccuuucucaccacaccuuucccuccucaguggaaucucuggccccaucuggagucccuggaggcuggaugguagaacuggaaucguuggcccgaucuggagccccuggaggcugggugguagaaguggagucucuggccccauccggaugauggagguggaaucucuggccccauccggaugauagagguggaaucucuggccccaucuggagccccuggaggcuggaugguagaagugaaaucucuggccccaucuggagucccuggaggcuggaugguggagguuugcugggguaacccuaggcgguagguguugccacccaaggugaagaggaacucacagcagcgcuggcuuagcagcucuguggggcauaacccacuucuuugcaaacucuggugcugggagaugaugaaaugagcaccugguacauuagguuugggacuuaaagcugauacuuccauucgggagcaggaugaguaagaccuggugcuucuuugcucagagcucucugaggugggaggcuggaagcgcuucccugaacacuguaggaaguguugcaggagagcggaagagcaggaggaggaauggugcagaggaggaggagcagugcggagauuucaccuggggggacaccaccacgggaggcaggcggcaaugguggaggcguuggcugagcagggccuuuagaaaaaggcccgggagcuuggcagcagaaaggaggguggaagugcagaagcaucgagaugcccagugacgucugugcaguuuggauuuugcuguugaaaagcaaaggagaugaauagaaagcuuuaggcagacacugagaguuuuugcuuuggagguauuuugauauaugguaaacuauuguuuggauuauuuuggaguaugcuuuggucuauuauuaaauaucccagucaaagauagcagauauucaauauuugaguuaggauuuuucaaauacuuagaauauuugaaaauauuuuuaucauuagaauuuauugauuuuuugagacacuaucauauucuaacaauugcaccuuauucuuuggcgguaucacugucauuguauuaauggcaaaggcuucaaaauagccugucaggcccaugucaucugcaagucaacccucaacccuuucucucuaaacuccucuccuccaguuugccaaaccacugugcuccagccaugcugcccuccuugcuguucuggaacuugccaaguaugccccaccccagggccuuggcaugugccuggaacacuugagcccccacccugcacauggcuggccccuuguuuucuucagcucuccguccauaugcaauagcgauuccucaugccccucauagcacuucuggacuuuuuccuugcucuauuuuuuaccaacuaaaacagggguuggccaaccauggcucucaggcuggccaccuguuuugcaaauacaauuuuauuggaacacacuuauaaagacuugauuucuuauggcuguuuucccuaugauggcagaguugaauaguugcaauaaagucugaccugcaaaucuaaaauguguguaauaucuggcucauuaggcaaaaguuugcaaagcccucaucuaggauauagugcauucauuugccucugucccugacuggaaugcacccucccuuaagacagagccuaucucuguuuggcccacugcuguaucccuagagccuacaacagugucuagcacaaaguauguucucgugagauacuugaaugaauaaaugaacaaaagugaaaguuccagccaacaggaugaugggcaguaguuaacuaugccucuaauucuggcuuaaacuuugguauuucagccuuuauguauguucuauuuugcaguuuuuauggugcacaggaugaaagaacacaucaacuccuagggaguagaggaggccuggaaauagacucagaugcagaauugugugcagguggcuguuggggaguguauucauucauucucacacugcuauuagcaucugagacuggguaauuuaugaaagaaagagguuuaauuaacucagaguuaucugggcuggacagacuucugcuucuggagaggccucaggaaacuuacaaucauggccgaaagcaaagggggaagcaaacacauccucauggauggagcaggaagaagagagagagugaagggggaggugccacacacuuucaaacaaccagaucucuugagaacucacucacuaucaugagaauagcaagggggaaaucugccccugugauccagucaccuccuaccaggacccuucuccaagacugaagaucacaagucaacaugcaguuuggguguggacacagagccaaaccauaucagggaguauucccaggauacacucuguaaggaagugcauacugcaggaucgggcaagggagaagcaggggcuugcauuaugaccuaguugcaguugaggucucauccuguccugcagggaacucuggagagagaaugaccuguagagucaucccaaauugaggccgggggccuaagucuuggcucccgggugcgcucugggggggccauaaccuuggaugagaugcuucucccucgagagcagcggugaaguaugcaccugccucugagcuccuagagcuggggugugaugcacugguccugaaacaaggccugggcaaguacccagaauuucaguugucaauggaaagagucaaacucuguaaaauacuuauagggauuuauucugagccaaauaugagugaccauggccagugacacagcccucaggagauccugagaacaugugccuaagguggucggggugcagcuugguuuuauacauuuagggagacaugagacaucaaucaaauacauuaagaaauacauugguuugguccagaaaggcgggacaccuugaaguccaggggacuuccagcuuauagguagauuuaaaaaucuccugguugauaauugguugaguuucucuaaagaccugagaucaauagaaaggaaugucuggguuaagauaaaggauuguggagaugcaaguucuuauuuguggaggaagccuucagguagcaggcuucagagagaauaacuuguaaaauguuucuuaucagacuucaagucuguguggauguuagugccggagagguauagcgaagcauauccaacccccacuucccgucaugccugaaacagucucucagguuacauuuugaaagagcccuggcugcggaggaaguccauuugaugguugggguuagaauuuuauauuugguuuacaaagucuugaauuaaaauauuuuaucauuaccuaguuuuauacccgggaauguuaguuguugcacgugaggacaugaagugaguuaaugcagggcuugggccguccagugucuucuuuccccacagccuugcuggcagugaccccauauaaauaggaacaauuaccggaagaaacugugcuccuccuaaagccuagcuagugacuuccaccuuugaaccauaggcgaggcagcacuuaaccagggcacuguuugauaggauguuacaggugguuccagagaaaaacgaaacaugucaucuuguuaagggaggucuucguuucggcaucucuguaaaauauuuaaagagguauuuuuauuucuuuaaacaggcucugccucuuccgucccccucgcccaauguggacucugcccguccuuccugagcagugagacucuguccccaugugcuucuggucacagcugcggugacauccuguaacauuguuugguccuugcuuaaaucaguuacucaccauguuauagccgaguucagacccacuacacagaccuccuaaggugcuggccugucuaaaacauuauuuccauuauucauuccuguucacucugggauagggaagccaugcuccaagcuguauuggaauaucagguccaggguaauuagccagggccuaaagggucuguuuuggaaaauucaaguacaaguagaaucuucuuuaguaucuuggauccaccagggaagagauggucucugaggccugcuaugcagaauaaaaccaagagagucacugugaaggaauccaagagaugcaagugcucuuugcuguccagugauuaaaaugaaagcaaagacgggaagcguccuugauccacauuuugccugugauuugaauaucacaugcuugguccgggcacuuaggugggcuucagugauuugggccggaaggaaauggugccccuuuccucgaguuucuagauuguuuugucacagacaggggaagcccucaucugacuugcccuguaggacccuagucugucgggaggucucuguccccaccccucccuggagucugggguguaguugggcugacccucaaaauaugcugugucaucaaagguucaucaucuaucuggucuguuuuuuaacgcaacuugauaaaauaccaguguuuuaauaaaaaggucuaaaacauuuaccauuuaaaugagccucccuuccugggaugcacacaggagucuuggcgggaggcugguggcgcaggcugauggguccugucccucugugccuugggcgccucugcccagcgucacgcagugucaugagaccccucagugcaagcgcaggucugccugagguccccccucccaccugcaaccuggaugccuuuugugccuauggaacacaacugaaagggccggucagugccauggcuuggcuaauucaugguggacaugcauuuugguuuuuaaaauuaugguaaaauauacauaaaauuucccaccuucaccauuuuuaagaguccagcucagcagcugucagugcauucacaccgucgugcagccaucaccaccacccauccucagagccccucaucuucccacagggaaacuccauccccauugagcacagacucccccuuccccagcccuggcacccacccuucuacugucucuaugagucugacuacaucacauaagugguacagccauugucuuuugugacuggcuuauuucauggaguaucauguccucaagguccauccguguuguagcacgugucaaaagguccuuccuuccucaggcuggauaugggcucuuuaaaagccuauuuucuuagagcaaaacccguuucccccacaccugaucgucacaagccgucuaagacacguggucuaggguuugcuagugaucgucugugggcuuuccgagccugcgcugguuuugcugccacaaccugagguccgcggacgucccugugcucgcuaugacuucuuugugugagacugucagaguguguuccuggcccugacacgugcucggcggcugguuuuucuccuucagaucagcggccuuggacagcuuucgcuucuuuggcagccguuucaagcugcuccgucuugucauuuuagaguucaauaucugcugcucugaaggaagaaacggggaugggcuggaccauugcacuuggucucuugaccucgauguugcccaugagcagugaaggaugacuuuugacgagccaugucagaugugacaggcaaucuaguuggcuugaguggaaaugugcuguacaaguuugaagccuugguugggggcauuuuucugguguucaaugcauuuaaauugacaccagacuucaguauguuguucauuucaggcccagcacuguaggcucccaucuuuaaaaugugugggugccgagcgcucccucgucagcuuuugcaaagcauuuugcauauucccaguacuguauuuacauuccuggcucacauugguuuuuguuuuuuguuuuuccuaucuuaaagcuuauuuuugaagugaauuuuuaaugcuuucaguugaguagggauuuguggaauuuugagggguggggaggugcaguggagaaaagggggaaaaugguuguuucuuggcucucagcauaagcuacauuuuccaucauauggagugagaugccuauauugggcagcugugauuuuaagugaaagucauuuccaguuguuucuaaugucuagaaauuagguuuguuuugauuuuaauugucaaaggaagggacugugggugaggaagagcccuugccgccgccuccccugacgugccccugcuugggcagacgccucccuggugaggugugggcugcgcuggacagcacccaggaccacggccucguucuuuuccuucucacuguguuuuccucuuggguaggggugagggugguuauuuuacucagaucucugagccuuaaaguggaucuucugcagaucaucuccagagucaucugacggcgccgggcagaagucuguauguugggagcuguccccagcuccucuccuuaggacuucugaaucugcuucaaccaagcauauuccugccucauccggaacauuccucacccucugccccagugcaggcgguguccacaucucagggaugcagcgugguggaauuuuuaagguuuugguuggcguggaugagagcaucucugcugaggcugccgugcgggugugggcugggugcaucugugucucugggcaccauauaccaaguggcacucaucccugugagaacauggccugggcauuagaggauaggauccuuagugugagggaggccucaaccauaaagggacugaggggagagacaggaaggguccagguauaagaagagcugcccacggcaggggguguggcagugggaccaggaugaaugggucucaguaauguggcuccuuccccaagcuggggagcaagggaggcuucugcuguuggguguugaagaggaaucuuugguuugcagauggggguggggugggucuuugcccauccucugaucguauguguagaaguuugcaacaugaagggcagacugugguggaguucuuuggcaguuaggaaagcaagccagggcacagacguguucucugaaaggcagggugugggcaccacagggucagcccugcaaacaagagcacugagcagagggagcggcgauuggauuggagaacggaggcucccaccuggcucacauacuccuacauacaugccacacgcaugccacggugcuuaggaaucuugaaagcugcaggcucaggggagcugcgaugcucaucgugaagaugcagagccggagaggccgcccaggcaggaaggccagugcuggucgccuccagguggucucaggaucccagagcaggaggcagccauguggugcugaaggggaagcgagggcauagaagcugugcccuggagcuggaaugguagacagggcuuucuuagugccagggccugcaaauucccaacaagggcucacuggaauccuccucccgccauccucccaggccccccauuggccggccaggccccuggauuaccucucuggugcccuguccuccuccaugcucuccucuaagggcccucacuggcaccuuugcccuccuuaaccagguaacacuaaaccaggagacaucuagaauccuguuugagacaucuucgagagucaccuuguuaacuagacagaaguggaucucuacagguuagagccuggggaaccucuguuuucuuugugauauucucuagugaguguuccaggaaagaacaugccccacugucuccuuucuacuugcagauagcggugaggugggagaggggccugggagugugcucuucauucuccaccuccucccccgaggagguggucauggucacucgcuugacgagcccagacucugagcuucugccccuuuauugagcaaauucauaaagucaaccaugcucuuuuauuauguaacuuguuuuuuagauucagggguacaugugcauguuuguuguauagguaacuugccuaucacagggguuuuguguguggauuauuucuucauccacaugauaagcacaugauaagcauaguacccaauagguaggucuucaauccucacccuccucccacccucaaguaggcaccguugucugcuguucccuucuuuguggccauguguacucagugguuagcacccaccucuaagugagaacacauccauguugcugcaaaggacaacauggaugcaaaugaucucauucuuuuauuauggcugcauaguauucugugguguauauuuaccacauguucuuuauccagucuccuauugaugggccuuuagguuuaguccaugucuuuacuauuaugaauagugcugcagugaauauacgcgugcauguaucuuuaugguagaaccguuuauauuccuuugggugugugcccaauaauaggauuguggauugaacaguaauuguguuuuaaguucuuugagaagucaccaaacugcuuuccacaguggcugaacuaauuuacauucccaccaagagcguauaagcauuccguuuucucuacagccucaccggcaucuguuauuuuuugacuuuuuaauaaaaaccauucugacuagugugagauggugucucacugugguuuugauuugcauuucucuaaugauuagugauguugagcauuuuuuucauaugcuuguuggccauauguaugucuucuuuugaaaaguguuuguucauguccuuugcccacuuuuuuuuuacagaguugauuguuuuuugcuuguuaauuuguuuaaguucuuuaugguuucuggguauuagaccuuugggggaugcauagucugcaaagugugcuucuuaugcaagcacccagccuuccggcacugggacgggccacaugggaggagccaaaggaugggagaguuuacccccuccagcccaugaacuugcugugaggaccccuccugccauauacccuccugggugugaagaggccuccugugugggcugcaccacugucuccgggauucuuggccuggaggcaucucugaaauuucucagaaugcccaauuugcaccagagauagagccaggccccuugggauggaaaaggaaaagaaacuagauuuacuuuuuaaaguuucuagaacuucuuugguaucccuagaaaacuuuuuuuaaaaaggauuuucuuuuuaaguuggauuucuauccauuauuuaccugagacauaauuucagcugaucaaaguuuagagugcuggcaagugccaagccuuacgauagauguuguaccuuuugacaaaugaccauguaugcacagcucuguuucuggacucuguucuauccauuuuucugcuuguccucaugccaacauggccccgacuucauugcuguggcucuguaguaagucuuggugucuuguagaaguucuccaaauuucguuguuuuuuccacaauuguuuuggcucuucuuaguccuuugcauuuccauguagaauaaguggauuaauuaguauagaaaaaccugugauuuucauucaacugcauucaaucuauagaucuauuugcagagauauuucacaguuuugagucuugaucuuugauuguggcguauagcuccauauuuguuuucuuugauacaucucaacaugguuuuguaauuuuuugguauacaaaucuuuuaaauauauuccacauaaauuuauccauaaguuuuucauguguuuuuguuuuguccuuuaaaaaugcuauauuuuuaguuucaauucccaguauuucuuugcuaaugaugagaauuacaggagcuuucuguaaauuugucuaguaugcugugaguuugcugaacaaauuuauucuaguucuaguugcccaaggauucuuuaguaucuuccauguacgugaauaucuuguuugagaaugaagacaguuuuguuucuuccuuuauacuauguaugcuguuaguuucuuuuucuuacuuuauuguacuggcuagggucuccauacugcauucaacaggaguuggggaaguaaacauccucuguuccuaaucuuaggggugaagcacucaguauuuuacuguuaaauauaaauacacauucuuguaaauucccauugaaguucuauucuuguaggcugagaguuuuauuacggaagggugugucauuuugucaggugccuuuuugcaucuguuguaauguuuaugugguuucugucuuuuauucugaucauauggagaaaugcaguaauugauuuucuaaugcucaacaaaccuugcuugucuuugauaagugccacuugcuuugagaaaugcaugcauacaucucucuguauauauauguguauaauuccagcauuauuucuauauacauagaaauaauaaauauacaaauaaugcugguuauauuugcuaauauuuuacgaauuacgggauacuggucugcaguuuucacauuuugucuuuuuuaggcuuuauuaucgggguaaugcuggcuucauaaaaugaacugauguauucucucuuguacugcuuuuuaaaauuguuuaggauugguauuuuuuuuauuuaaguguuuaaaaacaucugggccuggaauuuucuuugugggaagguuauuacuuaauuuaaaaaauauaugcaauacuauuaagauuuugaauuucuucaugacucaguuuugguuaucugucuuucaaagaguuuguuuuaucuaagugguugaguuuauuggcauuaauuguucguaaucuucucuuauccaguuaucccucucaggucucuagggcacgccaugaugaugcuauuccacugcccuuuuuuccauuccuggaaugguacuucccaccuucuaaaucagucuuguuacagguuuauucauuuucucaguucuguauuuuauugauuuuuauuuuuuuguuauuuuguguauuuuacucucuuucuacuuucuaagauagaagcagugggucccacugaagaaaagcagauagcaggcacuaaauuucccuguaggguuaacuaugucagccugacagaccccaggcugugugucuuuggaggacagagacauuggaggccguucaugauccuuucuaagauuggucauugauaggaaacuuuguuuguuaaguaauauaaguauucaaaacuagacauuaacuucuaagcagugcuuaagcagcauucuacauguuuugauagggauuguuuuuuaauaucacucuguuaaauauuuauguacuguaauuauuguaaauggugauuacacuguuccaugugcauuugcgagaauauacccugccauugugugcagucuucuauaaauguacguugggucagguuguuuuggcguguugugcaggucuucccuaucuucugacuuugucucccuguucaaucagucgagaaaggagugucgaagucugcaacucgaauuauggauuugucucuuuuccccuuugguucugucaacucuugccuugugccuucuguacauuugcuaguaggugccuaaucacaugagaucaugacguccuccugaugugcuggcuccuuaacaguaugaaauguacucuuuaucuccagccauuuuucuuacucugaaguuacuuugauauuaauauugcuagcuuucuugugauuugccuaugcauguguuauacucuuuuccauccuuuugcuuuugaucuauuucuuuauauuuauaguguguuucuuggaaccaggauauagugauccaguaugcaagucuguacuuuuuauuugaaauguuuuaguuaauguacucaucaauagguauggguuuagucugccguuuugcugauuuuuucauuuguacuuuuuauucuucauuccuguuuuccuaauucccugccuucuuuuggauugaauccuuuuuugauuucauuuuauaauuacuauugcguuauuagugcuaccuuuuuuuaaguaguuuguuuaguacaguacuuuuuguuagaaauuccagaaaugauggaaugcgcuguauccacacuguccaguauggcaggcacuggccaccuguagcuguugagcacuugacaugugacucgggcaacugaaggaacuggguaugcaauuacguuuaauuuuaaauaauuuaaauauaaauagccacuuggggauaccugcuaccacacugggcagggugacuguaggguuucuaauauuauuguuaacuucucaugaucuacauugaaaaugguguucugugacgucacaugcaaugcaagaccuucaccacagugaacuuccauuugccccuugaagucccauguacacggccauugaucuuacuucuacauguuauagacucucaaauacaugguugugacuuuuuccuuuaaacagucauuugucgagaaauaaucauuuagaauugaaauugaaagugagaaaguacucuuuucacguacgcauuuugauguucuaaauauguugaaagggcgcagggggguuuaaugcccuucaucagaucugugcuaccuuguggacaguaauuggaaaggauggggaacagggacgcacgaguggguagaugaaugcgaggcuguugaaaugguuccauggugagcagugcaugguugcuuggaacaggaaggagcggagguguuaagaagugguugaauuugggaucucuuuggaaguaugaugcuccagcuguuaucagcagagcuguaagugaaauguacuuugauuguuuguugaacauccuugccaccuuuccuaucgaauuugcuuuucaaaaauaguguggacauuaaaaagccauccccaugugccuaauuucaauuagaaaauguugaaucacugugaauuuggugagucauccugcauguaaguagagcuauccaucuaacucuuagaauuuguuaacuauuaagagaggaagacagaagguaauauagagaugacuauuuaugagucauuuuauuuauucauuauccaucuaaagaguagcaauugauuguaucacagaacgguguuuguuuuacaucuuuugauuaggagcagugguuuauggcauagacuugcuuaauuuccuccuguuucuuccucuggaguggauaacuguuucacaacagaaggcgauaaaagauuucugguuuauucauuaauuuugcuuugagacggaauaccugaucucaaggauaagaugcugauugguaugaccugaaucgaaugauuagcaguauguugcccuuacucugaucuccccacagugugagagauuuucucaucuucgcaucaguuuuuagccauguuuugguguuuaagcagagauacgauuccacuuugaaagcucuggaaguaauucucagaucacauauauucaucucaaauuugaaaucuggaguguuugucuugaaauuaaauugugguauuguaagcugucaguggcaugaucugugcuggaaccugaugcggucuaguuuacacgguauugaaucauguaaguaucucaucuuuccucuuugaauucaguaugacuucacauaggugagguuagcuuuuaaguguacacagagguaugguuaacuaucagcagacuucaguuaucaauugcugaucucagaaagcuaauuuaucuuuaguguccaauaacauuacauggcuuucuuucuuuguuuuauguuuuguguauaugugcuuaacuguuuaaauaaguucuggauugcauccaaauaagguuugauaugcucucauuaagaauaugauauugugaauaaauguaauccugacuuucaauaaauggccuguaaaaaaaaaaagaaaguauuuagaguuagugaguugaggggcuucgucacauggcuaaaggagauuugaguagccccuggaauguugagugacucugacuuguggaaugcauggagccccguuucguuggcuggcaggaucuacgugggccgagcauacagcccuagaugaaugacuuaugucucugaauucuguuccuaaucucugcugcucaaucuguggccaccugcagaggagccagccggauggcaucguccuuaccgagcucucugguugucagauccuucacuacuccuuaguggcugauuacucugcguaguguagggugcuguagggugcauaacugauuagugccuugcagauauaagcaaaguuuacaaugaagcccuugcgcuuaggagcauacagucuaguuaugaagagaagacacaaaacacccagucacaucacugugaacagacaaguuugccaggagucuguucagaccuggugcucccugagccgcgcugagcagcaguucagcggggauaccaaguuggggaagaugccaagugguaggaaggaggcuggggcucuggucugcacaugccagcugauggaguuuggaguuggggggauauggccaguucccaaugcacuggaccagccaccauccagaauuaggaaguagaucagcccgugccuggcaugcauugcuuucuuuucaguuucuaacauauauauaaccuuuuuaaguauauauauauguauguauauauauaacuuuaguuauagagucucgcuguuuugcccaggauggaguacaguggugcaaucauagcuugcuguagccucaagugaucccucccaccucagccucccaaguagcugggacuacauacgugcaccaccacgccuggcuaauuuuuuugaaaggacaagucuugcuauguugcccagacuagucaccaacuccuggucucaagcagucuuccugccuuggccuccaaaggaguuaggauuacaggcauaagccacugugcccagccuaaucuauauaaccuuucaaacagguaucuccauuuguauacuaggggagaauguagaccccacacccucuuccucaagaaacaacuugaacgcaugccauucugccaucucagccaaggcgauugccugugcccuucccaagggcuuggagacacccucucccugcuagccccgugcaggggucuucccauguguacccugcagcaccguccaccugucugaguucgauggggccuccaggcccccugccuuggugaggcaacacgcucagcgccugcgcgaaucuucuugcccaucaguuccuuuuccuuuuauccaggauuucacacacugggacauuuugugccaacaauuauuaaucaguuuuaagauugacuggguuuguggacugugcccaggguuugugcaccucacucacggcagauuuccuggcagcccuggggaugguccugcucccccggggacaguuuccaucucaugguguagcuuugggaguggggcccacugaagaaaagcagauagcaggcacugaaguuccugcagccuguuggaccccgggccgugugucuuuggaggacagagacauuggccuacaguaaaauaaagucagaugagaaaggguggggaggcuuuccugcuguaaagggauuauguauucauacucgaaauagggauacauuaggggaauagauuguaaucucuacauccccaauccaugaaaacaaaacagaaauggagggccaagaaaccuacacagggaagacacgaaauagcaaacauaccugauuuauccaagggaaggcagaggagggaaacgaaaggaugaauaacaggugaggcaagcaggacauaacucguaggauggucagcaugcccagugcggcggcgaggacuucggaagucaguggacccaguggagacucagaugaaaaucagagauggucucacugugggaacauggugugcaaccauagacuaaggcggcacaccuuaaacauagccuaagagaugcaccgugcagggcaggcacccacaugaagcggcuauguaaacgugacaaaguagauauuaagaaaaguaggaaggaacaguaaaaauaagaucagauaucagcaaagcagaaaaugguauuacagagauguuaacaaaggcagaaauuauguccuuggaaagagucguaaaaauuuucaaaauucccagccaaaccugaugaagaaaaaugaaaugacaaauaauauaaaugaaaaggaaagaucacuacagaaucuacaaauauucaaagauaaugaggauguuauuuaaaacuuuauguugacaaauuugacaguuuagauacaaugagcuaaguuuuugucagagcuuaacaauuuaaucuaaagaaaucaaaaauugaaaauuaaaaaucuucccucaaagaaaaaucuaggcccauacagcuucacuguucaguuuuaucaaauaguuaaggaagaaguaauuccaaucuuauauuagcccuuucaaggaauagcagaagagagaauaauuccuagcuuguuucauaagaccaacacaaccaugacaccaagaugccaagaugugucaaggauguuugagaaaugguaaccacagaccaaugucucucaugaacccaaauuuuaaaauccuaauaaaauauuagaaugucaauuuuacaauauagaaaaauauguauauuuccagugggguuuauuccauucaaaaaucaaucgguguaauucuccacauucacagaggaaaagaaaagaacuuuaugaugauaaugaucauaguaaccaaaaaaagcauuugacaaauuucaacauccauucacgaugaaaaugcacugcaaaguaagaauauaaaggaaauucucuuacaugacagcguguauacgagugugcacacgugugugugcgugugugugcaugcauguauguguguguacacgugugcaccugugguuuucucuccauguuucuuccaguacugaucaggguugcuuguuuucaggaguuuucaagugcucuaccuucaaguuuuccccagcuaaaucuuucccauuucuuucucuaaaucccuuuuugauauuugcaguucuuuucaacuuaccaccaauauuuuagucuugauuagaaucuucccagaaaagacaaguuuuccuucugauucccacaugucccuucagcucgugauggcgcagaauauguuugcuugccaguuaggggaaccugaggcugccuuccugggcagaguggcgauuuguacugggccaacggggcagccacuguuacuuauggacagguggacuaggcucuuuuucauccugaggaacugcuccgcgcuugggaagagccacuggaguuuaucagccugcguguaagcaugugggaagggggaucaggaacauuuaguagaauaguccgugcuccaggugaucaguccccacccacccgcaugccucuccuucuccaucccacccgcauuuugggucauugggggauuaauuuauucgugucucguaagcacuggcagaacaccacccgugugaacagcauuggugaagccuggggaguucuuuuugagacuuccuugagcuuccggcagcacgugugaguuucgggggugauuggaauguuucucccuggagggaggccugaugcccuggagcuggcuccagcccgagccccgcggcauguucugccugcugccgccuaccugcagggagacgccugagcugggaagguucugaggguuggcagggugcucugcugugcucuuugggaggauccccuuggcuguucugcaugcccagggccgugcucuccguggaaaucuauguuggagacgacaggcuccgguuccagcuacaccagccugacuuccacuggacagugccauuuucugccucugauaacaccguggugaagcgccuuacguaaagcaacagauuuuuuguuuuaagaugcacuauaauuacucuuuucagaaccaauaauauuaacccagugaagucaaaacugaauuguuuuauaaacugacuauggagcugguguaaggagaugcagggaaggcuucucaucugagucgguagcagaguacauagugcaagaagcgugggcaggcucccagcgcacccagagaucaaggagagugaugggugcugcccgccucugaggggacggaggcagcugccacccgccgugucccucacgcuggcuuucagaaggcuucacgcaagugggcucacaggcaagaagaaaagcugugggccgugugucucccuuggcuauggcucaguuuuaauguaauuagaagcucaacuugaaagugagauaucaaaggaagccuucaguugcugaagaugggugugcugggggaugagggcguggguugaaaaguauccaguuacuguuuuucucacguggaucagucuaacauaugugacucugguaauugaagauggugacaggcuaaacuaagcugggauuccccagggagagacuaggauuucuggaaccagucuaacaaaaacagaaacuugaaggagaaaacagaauaugccucccucucuucccugcuucccuccucuacucaaaaaaaagaaagaaagaaaaaagcagcuuuugcaaugaagaauucaguuuuucgcccccgaguguaugaugguagugacuuugguguuccuggugcagaccuguauuuuuuugugaugucuucaucuggccccucgcccuccacucuucaugaugaauaugagaccugugcacugaggguccucaccaacacuuccuuccucacagccguaugauuucauccggaagcggccucuaaaaauaaacacccucauguuagccuuuuuccaccaugcuucauauuuggcucuuguauaaauaucugccacguuuccacugggaauuauugcuguuauauauuuuauagacacucgacugucaucuaaguggcuuauuuuauucccauagcuagaagaaaaauacaaaaauaauuuuguaaugugagugugauugugggccaggaguuauguucugagaaggagcugagaguaaauuauauuccugcuuuauuguguugauauugucuucccuguuguguccugaguuagccuuuguuguuccaaguuauuaaccagagguggcuugauaaugacgccacuuuggaagcgucuggcugguguuuaaaacucuagcuggugauaaauauauuuuaguccuauuaaugaagaauuguaacauuuuaguccuauuaaugaagaauuuuaacauccaugcagaugagcggcauccuaaaagcagcuucagaugcuuugggguguuuucuaccgaagaugcuuuuguagaaauaccgccuuccuuuucauuuuuuacacuggucuguucaucaaaaaccauaacuucauggaacuugcuucuguggaaugaacuaaauguaaauuauuuuuccaaaagcuuuaugaguuuaucauacauguuuuggaaaaaguggaaaaacacuaggaagaaguuccagugagcaaauguuucccgacauguuucacguuuugcucugguuugaagcagggcguuuuguggaagguagggcugguggaucgcucggucgcugggcagugcuggucacugccuuucuuugguugagcuggucuugaguccugguaccugugucugcccuggcauugaccccguggugcuuucugugcaucuccgugcucaccuuucuggaacacagccccugaacagaaucauuuggcaaaacaucccaguacaaaaaccaguggguuuuacauggggaaagaacucaaugaguccacaguucgugucgaugaaggaggcacugcguguugggcucaaacgcaucuguaacugugggugccaagagacaaguagagcucagacugcugggagcguuggcuggaauaaagcuggcccucacggggcuguuaaaauacuugaacuugaauucaaagucagauuuaagcugacuucaccccucuucccuugcuucugaagauucugguuuuucacgagacagaaaaaaggguggaaccaggagcuuauccccuuccuuccuuccuugcaagcagcagcaacagccauugaaacucaaagacagcaagagcucucuucccgcccacucccagcgccacucccgggggaacccaugugggaagggcucuuccugacaccucuccugcagcacacagcacacgucagccuugcccugcaugcagccuucccagcuggagcaggucccaccagcgcccugccaggcggcaauggucuacaccgccauuuuaccuuccccaggucuguggcauuaggucuucccuugugaguggcucguauucuuuucaagauacuguaaauaauuuggcaucauauggaccacuugaugcuucuauaugaaacaugccuuauaaacccuuaguacugcaugauuucagauuacggaaauaucugcaugaguauuggcugcgauaucucuguacuagaaauuucagugcuaccucuacacaaacagacacacuggggaugugcuguguguauuguaugaguguaucauagaauauuucauuguccgugguaguacauuucacaucauaggcugucuguggcuacuuuuaaaccuuagacauuugaauuuucccucaagcuuuauucuggugaagcgugggauggggucuuagcucacuuuggaaggauggaacaguuaagcagcguaccuggugacuggcacugugugugagugaugccaccucggcaccuucgcguugaucaucuuuaggaucuuuaggaucacugagaauuaaucauucuuugcaugcauaaaccuguguaaggguugcuccacguuucugccauugcucacagauaaaacacauucaugaucucagcuuaaucccaagaggauguuuccccauccaucaaaaccacagugcagguuuucacugaugggacauagggaagguauggcaagcuggguggagguguguuuccuggacuuuuccggaauaacccaacccaucccuccuagugagcacagaauuacccagaaaguugaaaaggaaaacacaguuuauuggaacaaauaugcaaagugauuuguucuuuucacagagaagguaaauagcaugucagccgccaaggcccucacacacacggaucugcccguggagugaugaacuuguaaaagaacgucagguggaagcggugagagggccuggacaguuguucugcagcuguguucuuugucugguuaaucgcgugcgucuccagucuguggcuggccagccgcguccaccugcgugcuccgggcacccaaggugcuugguuaauaugcagcucucucaacaucucccccuuaggagcaacagguacccggugcugguguuguccguccagaugaaagggccuggccacucugauugcacuucucuuugaucucccuguagaaggucggcuugucugccuagagauuccucugaagggcaauuuaaaaguuggauuugagcaacaucaagugaaaugucuucccaucucacgccgugaggagcucuuugguguggcucauggcuggaugugaggaaagauauuaacccuuccuuugaaacaaacugucucacaggcugaacuugccagcuaccuuucuccucugcuuuuagaaaagaaaauauuuucuuucucauaaugcucuuggcccuugaagauaaacucauugcaguguuuaaaauuuguccugagacccuauugccuuuacuuuguuagugugugugagacugaaggccuguggaugggugagaugcuucgaacugauagaaaaagaaaacagaaggaagauuuuugugggcagagccgagacgccgucucucaagguguugugaucaguaaaagaauccauuuuuaauggugaacuggcaaaggcugcuaaauaccaauuacugaguaaagugccaugagaagguaaagccacuuuuugugaauuauuucauugcacuaacgugcuccuacugaaaaacauggccaggcugcuuccgauacaguucacuuaaagaaaaauggcucacguuaaaaauaguugcuuuauuuuguaaauguuuuagaaaagugcauugcuguccagaaaucuagauguacacuuguuuuguguuuaaugaaaaagggaaggaaaaauaucucgaaaucccaaaucucaucgguaucaauaggaucauaaaaguaaaggcaggaaaaggaauuugcugcucguguuucccauccauguuuccagguuauguauuuuguuucucaacuuuuauuuauguuaaugaaaccagucugcuuuuuuuuuuuguuauuuuugaugacuaagaucccauuuauuaggaauuuguaacucagcugugacaacguagccugagauuuacacaguccccguuaaggguagaaaauagagggagggcuuagcucucuguuuucauagcuguguuaaagagccaaauaguaauuuguugaccgaauguauuaucuguccugccauauguuguucaaaugaugagacagaagaaugaaggacucuuacaauguaaacuucuggaaaucauacuguuucaggguuguuuacauuaauaacaaugauggcuuacauguauguaugguuuuauaauuuuuugagauuauaaaagguauacauggucaguguugaaaauaaaguauaaagaaauuaaaaauuuggacggugugguggcucacgccgguaaucccaacacuuugguaggccaaggugggcagaucgcuugagugcaggaguucaggaccagccugggcaacaaggcaaaaccccgucuccaccaaaaauacaaaaaauuagcugggugagauggugugcaccuguggucccagcugcucaggaggcugagguaggaaaaucucuugagccugggaguuggaggcugcaaugagcugagaucacagcacuguaccccagccuggaugacagagugagacccugucucaauuuaauaaauaaauaaaauaaaaaauguauauuucuauugcauaauuaacuauuauuuauguuuuaucaguccuucuaauuucuuuuuuucuuaggagacaggggcucccuauguugcccagguuggucuugaacuccugggcuguagcaguccucccaccuuggccuccugaagugcugggauugcaggcguaagccaccgcgcccagcuuucuaguuuguuuuuaugccuacagcguacaaauguuacuaaaguuuggauugcgucacacugcauguguuguagugggauaugccuuuuuaugcaccagcguaugcauugugccacauccuuagacaugacuuuuauuggauaugcaguagccuggcuuacggauguuucauaauuuauuuaacacccugugauugguuauuuagcuuacuuucauuuuuaacuguaccaaauugugcugucaugccauccuggaaguggauugcaugugggcgccuuguacuugauagagcacuuucuuaaacuguaucucagucauuagcacaagugcuccaugaggcagugaggccacugaguagugauccgggucacaagggaagaacuggggcccagcgagacugaagcggguauuuucacgugagacuucgccaguacggggcaaaagcacacgguagaggauuuugaaaucacccugauugaagaccaagcugguuuuugucccaacaauagugauuccuucauuuaucccacaaauauuuaaaugcugcguacgugucaggcacuguccuugguucuggugaauagagcagacccugccugcugcuccgggggaugucggcccgauucuuugguaacucuggaaggcuugugcaccugcuggaguuugggggagagagggaggguuguggacccagucacauaccacaguggguucaaagucucaucuuuauucugggagugacugggugucuuuaaaagucaaguucggaagauucucauuuaaugauauuugauuccaugucucaugcagaggaauacuuagauacgacggaaugaguuaaguaaaggguaaaguauuacuuaaauauaucaucugaaaauaacugcuucauaucucuuguaucuuaaaauauuuucuggacaaaaauuuuauguaaauuaaaacaaaaugcuguuuuucaucauuguauuaggaaaaaauguaaauacaaaauauuugguguuuugaaggaugggccggaaauggggauguuuuuguaugaugcugcugauaacaguaaguugcuaucagucuugugaccauauacauacagacauaaaaauguuaaaacccuucucaguacucccacuuugaaaaaguauacucuagaaaaauaucuaaauuauagaaaaaacguuauaccuugcagcuucucuuaucaugguggaaaggaaaccaaccuagacguccaacacuagugagaucguuuagauaauacugacacaugcucucaccaaaccgagucagcaucuaaugccuaugagacugcguagucagggauaaaugcuuccguuaagugaaaaagcagagugcuaaagagcaggcacauuagaguuacaacugugccaugugagaaaaagcuugaagugaauacucucaaaugaugauaauggcuguuuuagggaugaagaucaaggaauuuccuguuuuuucuugucuguauuucaaauuuuuuauaguauaguuauauuacuuuuuaaaacuagcgacuucauuuuauaaaaugacuuuuacuuauuuuuaaaauuuaagcaauacaggaaagcaaaagaaauaacaauuaccucccaucucacagcccccagauaaguagugcugauacuuggugagccuccuuguaaaagucacucuuugcuugcauaaacaugugguuauaugcauaaaagacaguaacauaaacacagauaaaacgacaaauauuuucaaaugacaauaguuuuguuuaauacaagguucuuaaauauugucuguaaagaaccagauaguaaauauauuagucucugucucaguuauucugccguuuugugacagcaaucauagacaaaauguaaaugaauuaaugcagccguguuccaauaaaguuuuauugcucuucauucuguuuagauccauuuccaccuggcaucauuuucuucuuccugacaguuuccuucacccuuucucauugcacuggucuacugcaggugacuucuuacaguuuuuuagugcccaaaaugucuuuauugcuucuugauuguugaaagguauuuucacuggguguagaauucuagauugacaggguuuuuuuccucccaauacuuuacagauuuugcuacacugcccucuugcaugcauuguuuccauuaagaauucugcugucauccucaucuuuuugugccucugugugacaugauuuuuuccucugguagguuguaaggccccuuaucaauuuuuugaacaauuuuauugugaugcaucuuggugcaguucuucaugugucuuuuacuugguuucacuguccaucuuguaucugugcauuugcaguuugcaucaaauuggaaaauauuuuggcuauuucuucaaauauauuuuuuuccuuuuccuuucagaaacuccaacuacagauauguacgauuuccugaaguuuuucaaaaccucacugauaauccuuccuuccuuucuuccuuccuuuugauuuccuuucucuguccucauuuuguguaguuucuauaggaauauauucaaguucacuaauuuuuucuuuugcagugucuaaucuauuauuuucauuugauguauuuuuccauuguagguuuuuuuaguuuuuaauucugaaaguucucuuuggaucuuuuuuuuacuauauucuauaauucuaauuaacuuuuugaaugucuggaauacaguuacauuaacuuuuugcauccucgucugcuaaucuuaacaucugaguuaguuuuagguccauuucaauugacugguguauuucuucguaauggaucauauuuuccugcuucuuugugugccugguaaucuuugauugcauguccaguauugugaauuuuaccuuguugaguucugguuauuucugcauucugauagauuuccuugagcuuuguucugggauacagucacaguuaaauuacuugggaauaguuugacucuuuugggucuugcuuuuaagauucguuagguagaaccagagcaguguacugaggccagcccccuuuucagcucgccccggauggucugugaauaggaggcauuccaguguggcugucaggaaaagucaugcucccagcccugcaagagcagcgguuaccacccugucauccucacagauagcucuuuuccugccugggggagcuuccugacauggcggugcccaucaguacucugaugaauaugugagggugaccuguugcagaucucaggauuccucuuucugagaugugucucugucccuccaguucuguccugcaaacucugccuguccugguuuccgggcucacagcuccauccccucaguuugggagcuggccaggcccuuccugugugccccuccgggugcccggaacucucagggcagucgcagccuuuucuuccuugguuuucugucacucaucugucucuguacuuugcucuccaguuucuugaaaaguguguucuauuuaauuuauuuuuucuuuuugguucuuuuuggugagagggucaaucuugucucuuacuuauuuuaucuugccuggaaacagaagugcugggguguuuuuuaaaaaauaauuguaagauacauaauuuaaagcugugcuauuauaguauuuacaugaaguuuuaaaaagaaauuugcuuccccuaaacuuucugaucaucgauagcacuuuuugaggcagggagccacuaguggucaccuaugucuguuagcaauagacagacaugucuguuacuuccaaaggacucucacaguguaaacugaggacccucuuacaagcugguacgggaagaccaggccugcaucugucagagaugagaauaagacagauucuccuaaucaagcugcaaggagcuccugcuguaaucacuccagaauauauaucaagaguggauguguguucucuauggcaaaaaacaggcacuggaaaauuuacauauuuuuaguuuaaaauaugcaugcucuuggccaauauguuugaacugaaaaaagauagaaugugguuuucugaguuaucuucuuuuucuuuuuucucaaguuaguuaagauuuauaaggugcuuacucagaaauucauggaugaaguacaacguucaccuucacaacacuuugcucugguuacaaauuuuugugguguagaaacccccaaagugccucguauuuucucacccgaguccagccggagauacugaccuuggucuagaucgucaccucugaaccauuccugaagaaguggguagacacccccucaggacugcuguaagaguggaacacauucacguauaaccagcacagagguuaguauucaguaagcacucaauaaauguuggcucugaagagauucuucucauuugcaucauugaaaaggggucuuugcaaugaugcuuauagcccaguuuggggugaaucauaccucuaagcaacugucauugaaagaaggccuuaaugcugauagucauuguuucaguuuuacuuuuuauuucuuugucuuggcucucuggcuaggccuuuaauacaguuuugaauagaagucgugauaaugggcauucuugucuuguuacuaaauuuagaggaaaagcuuucagcauuccacuguugauuuccugugaacucuauagauuguuuuguggauacccauuuucccccagaaugaaagaucuuuuugaaauuauauuauucuuucuuuaaugaggccauuuucauauuugcauuuaugagaaaauguuuaaaaaaguaugugaacauaaauuauauaaucuuuugagucaaucagaauuauacaauugaaaaauagucuacaauuaaugauauucaaguaucuuuagauuuuaaacucauuaaaugaacauugaaaguucuguuuucuaauuauagagccgaguuuaaauugacaagagcagccacacucgaguugucuaagucagaggcuuuauaaaccuguuggauuuuccaaggguugcuucucuugaauaaagguguuuuuguuucucacauauuuuacauuuucaaugaccuguuuaggcagaagcaccuuuugucacuaauuaguguggugugacaaguaacauaaugcguaucugaaaagcuccacuggguguaaguggaguucacaccucuuaaugagugccuucaagaguguuuuugucauucccagggagaacuagugccccuugaauagaaaacugcuguaaauggaaaaaggaugugucuuaggagccugguguaagugcagaugggcccacccuguccucugacuuuagggccuuccucaaagccaaggcccucuugugcgauggggcucuucuccuucuuagaauuccuacauccagaguaauggagacgacuugggaucaugcuucaggauauauguaggugcucaacacaggcugguuucuguuuuuaauuucuggcagaaugaaccacuugaaaaugaauuuucauuacgauuuuaggagggcugagaguagaugagguaagagaucugccuagggggcaggaucgaaggaggcugucacucucagauuugugcaagugacuuguguuccccaaauucacauguuggagcccuagcccucaguacgucggagcgugacuguauuuggagauggggccuuuaagcagguacuuaaaguuaaauugggguuguuagaauaggcccuaauucagccugacuaguguccuuauaagaagaggagauuagggcacagauauaccauaggcuucugugcacagagaugaccaugugaaguggcagcaagggguggccguccgcaagccaagaagagaggcgucagagaaaaucaacucugccaacaccuugaaccuagacuugcagcauccagagcugugagaaaauaaaugucuguucuuuaaaccacccggucuaugguauuuuguuauggcagccugagcaaauucauucagcaagugccagccuugcacucgcgggagagugagugccuccugcagugcucagucuggucucaggcugaaauucuagguagaugcacauuuucccaguuggcaggugcuggcucaugcugaaggggaacauaugcucaggauuccugcuuuauguacuucaaaaggagacaugugacauguuucacuuaacuucaucuaaauuuccuagacacaccaaucuguaacgguuuagaacucaacccggugguuauacagcuuuccugaaguggagaggugggcuacuuaucuuguaugagucccaugagaacuaaagaacaaugguucaaaaaacagauggaugucucccaucuuacauucccuccaggaagaaguaguugaagaaauaauggauauaaauuuccuugaauuaagaacacaugaaagacuuaagaauaagaaguccaagagaggaccaaagaggcaaaaaaaaaaaaaaaagaaaaaaaaaagaaaaauaacugacgucuaucuagaagagcacagugaaauuuaagaauagagagaaaaaucuaaaacauuagcaagaacaaacaacacauauaaagaaccaguggucauauuggcuucagauuugucaacagcaauauugaauguaagaagagaauggaggcauguuuucagcguauuaaaggaaaauaacuuagaacagaguuuuauaugcagcuaaaacuuuaaaauaugagggcuuggcaaaacuauucucacaaggccucaaaaguuacaccuuaacaauuauaauaaauguaaaugaacuaaacucaccaguaagaaaaagacugaaaaauggaauaaaauauaaaauccaaauauacgccacucaaagguuauccaaaguauaaggacuuucaaacuuugaggguaaauggauggaaagaagcaugucaggaaaauacccaaagaaaacuggcauagcuauaaugauauguaaaauagauucuaagacuaacagccuuguuagagauagaaaaggugaauacacaauaacaaaacaaguaaaauagauuaacagaguaaaacauaaaugacaaaaauaauuuguauucuugaaaauauauagccauggaaguauacauuuuaaguuagaaaaugaacagaauaaaccuuuuaaaaagcagaagaaaagaucauuggaaauuaguggaaaaaauacaaagaucuuaaaaaaccaugaauuguuuguuuaagagaaaaaaauagauuaaagguaagauaucugaaauggcuauauuagcauuagaugauguauauucuacaaaaaaaguuacuaggguuaaagagagauguuacauagcgauaaaguauucaguucaccaaaaagaccuaacagucuuaaauggcuauguaccugacaacagaauuccaaaauacaugaagcaaaaacggaaaggagaaauagauaaguccacaauuauaaauggagauuucaccauuucuuacugaucaacagauccuaaaaucaguaaggauauagacaauuugaacagcauuaucuacuaacuugauguaauuaacauuucuggaauacacuuaacaaaggccaagauguggaaaauccagaauauuugaaaguucuuaguaacccaucauucaaagaagucacagggaaacuuagaaaauguuuugaauuaaaugaacaugaaagcacaaccuaucaaaagcuguggguugcggcuaaaagugugcuuugagggaaauuuauaacauuaaguuuuuauaauagcaaaaggucucaaaacaaugaucuaagcugcugcuuuaagaaaacagaaaaguaagagcaagucaaacccaagacaaacagaaggaaggagauaauaaagauaaaaacaaagaugaauaaacauggaaaacagaaaaacaguggaaaauaucaaugagucaaagaacugguucuuuggaaaaauauuaauuaaacugauaaaucgguggcuagacugaccaaaaaaaaaaaaaaagagagugaagucauauauuaacaauguuaugaugagaggggccauugcuacaaaacauacugacacugaaaaaaaaagugcauagcaggacaguuucgcuacccauauguuugacugcuuagauaaaugaauaacuuuuuuuuuuuuuuuuuggagacagagucuagcucuuucucccagccuggaguucagaggcacgaucuuggcucacugcauccuucuccucccggguucaagugauucuucugccucagccuccugaguagcugggacuacaggugagcaccaccaugcccaccuaauuuuuguauuuuuaguagagacaggauuuuaccauauuggccaggcuggucucaaacuccuggccucaucauccacccaccucggccucccaaaaugcugagauuauaggcgugagccacugugcccagccugaauaacuuuuuugaaaggcacagacuaccaagcucauucaagaagaaauagucuuaaaucuaucauaauaauugaauuuauaauuuaagccuuuccauaaugaaaauuucagacguaguugucuucauuggggaauucuacaaaacauuuauggaagaaauaaugucuguucuagaaaauucuuccagaaaauacacgaggaaauacuuuccaacucuuuuuaugauggcagcauuaccuugauaccacaaccaaauaaagggauuagaagaaaaauacagaccaauauuccuaauguacauaaaaugcaaaaguccucaggaauauuaccaacuugaaaccaggaaauauauaaaggaugauggaacaugaccaacuugaguuuaucuuaugaauguaagacuguucaguauuucacaauuaaucaguuuaccauaucaauaggaaaaaugaagauaaaccuguguuaaucucgaagaaauuuccugauuugauaaaaaggaaucuaucaaauacuuauugcugacauaauuccuaaugauaaaagauugaauguuuuccuccuaaaaucagaaauaagacaaagaugucuguccacucuuccuacagcuauucaguggaagguccuagccaguccaguacaucaagggaaaaaaugauuuuggaaaaguaagaaauaaaacuuuauuuauagaaggcaugauugucuauacagaaaauucccaaaaaccuacaaaacuacgcaacauacaaaaaccaauugccuuucuauauacuagcaaugaauauuggauacuaaaauuuuaaauauaguuccauuuauaauagaugaaaaugugcaguaguucauguccaaugauauuugcaggauauauauacugaaaacuacaaaaccuuaaauaaaauaacauuuaaagaaauggagagauauacuguguucuuagauuggaagacucaauauucuccccaaacugauggauuuaacaugauuccagucaaaaucacagcaggucuuuuccuagaaacugauaagccauucugaaaucuauguggaaauuuacaguuguacaaguuuuccaaaauuauuuuugacaacccaucacuagagaauguuaaaguaacugaucauauaauuccuucaagaauggucauuaaauucuggauuucacaguuucuuuuaguucguauuucacaagauagaagcuuuacauuuuucagauuaagguaguuuucaccuuugugcaugcuacaucuuggggaaaauacugagacaaaaugacucauuggaauuauuuuugauuuuuugauacucggcugacaauuauagucuguguuaugacaguuauagccugugucauacguacucagaauuaacuaacauagucuuccuccuaacuucccugcauauuggaacauuagaauucuuuugguugguugaagaaacauccuagaauuuuaaaauauuuuguaucuaauguaaugcugaaaacaugaaauccacauaauguaugcggcauagcuaauauuagaagcauguucaaggagcagccucugggguuaauagaguuuaauuugcaagacaaaugaaagcuuauuuucuccuaggcucucugcucauaauucuaguagggccacuuuugaagaauaguaccuucaacagacacagagaacccuuguuggacagcaacagaacuugcucacagugagacccgacauccccuccgcucagugggcauuuccuacagugcagaguugugcguugaaaagugccucuucacucccuacaugagguuccucacacaaccccgcaccugggcgggcgggcgggcguagggggcauaaauggcuuaucccuaugaacuucaucauuaugaaauguaaaaauggacagucccauugccccagaaacagugggggagcuucuaaguaaauccagguuuaucugcauuugggaauauucugcauuuuuugaaaaugauguucccaggaaucuuuauaaccaaggagaauccuuacuguaaacauuccaccugaauuuuuccaaaaaaaaaauagaucauuaagaacaauagacaaaggaauaugcuuuuaaaaauagugauuaucucugaaggugggauuguggcuaauuuuuaacuacccuggugugaccuuaugugacccugugugagucaacaugucuggccucagggguguguguggagggggcacccuuugccauugcauuacacaagucuuugaacugacuguccuucuuacuaaaugcuauuagcaucucuuagucacuguggcagccaaaaaugcuuccacguuuucuaagcauuccacagguguauguuccuggccugauucaggauagaccaguaacuccugaaaguaaucaaaggggccggguauuguggcucacgucuguagucacagcuacuugggaggcugaggcgggaagaccaccugagccccgaaguucaagacugcagugagccgcgaucccaccaaggcauuccagccugggcugcagaauaagaaccugucucuuaagaaaaaaaaaagaaaaaaagguaauaaaagagcaccaggaagcauaggugaugcaccucccauguagagaaggcugggcgagcgaauguguagugguuucugcggcuccauuguuagugaugacuuacggauggaaaagggaguuuuguagcugagugaaaacuguuagaaaaccaaaugccgcugucauguuuuugucucgugcgcuuccccuucaccuucauccuugggcccaugcuguggccaacugaggaguacccugagguuaagcgucccccauggcaggugaggcuguggggugggaggagggcugggagauagcagauuagagaucuacaagagaauagaaaguuugauucaaggagaaaaacuggaguaagcaguuuggagaagucagauguuuaaaacaugaaaagaaauguaacuuugaguugcagugguuuugaguuuccugaucuugaugugccaguaacucccugggggcugacaaauccagggggaagguucaaaggcagagagccuguuugagcugggccagggcacagaggcuugcucagaagacguggacggcagcagagccugggcuugagagucgagcuccaccuucuucaggcucuuuccagcggggcgggacaaggacccacacaugcuaagcgagcagggacccucaagccugugacuguucgugccagugaaaagggcaccagugcacugauuucuuccguucacccagaaacaacgauuucuucaauguucacaguagucuguuaaccaccucuucguggugcaucuuugagccuguguuuacagcaguccucucuuuggucuuaacaacccaacgugaauuuuguggcaugcuacaaauugaggcaucaaagcuaugcuuuuuacauugacuuuugagaaauucgacagaguucugaaacccaaaucuugaccuuucauggauaugaugguaaccuggcuugagguuuuuuuucaucucuuucccaaacuaccuguucuuuccaucggcauuuuaaguagcuugagcacuugguuucacucuucaauacuuugaugaugcgaauaucugcagaugccuacuguaugcccagcccagccucucuacagagagaccuucccagccagccccggucuaacccaucaugcuguugaguguucuuccuagcagacaucauuauauuacucaugcauucauuuuaggggguuauggucuauuccauugcuccccucucccagagcagugcuuuaggggagccaggucugucuuacucccgguacacccagcaccuguaacucucuagcaaauccuagaugcuuggugagugagugaguacauugaaguacauugaguacagugaggccacacaauuuaaaaagugacaauggcaguacacugcggcaugugcuggaaaaugaaguccagggugcuggguggccucauggcagggaggcuccccuaggcuggcgucggggccaggcagccugaggaugugaaauucaagaggacacagcaagaggcuggaaggaaacuaguuggggacaggggugagaggacucgauugaaggggucccacugcaaagggccccaugagcccauccagagugcuuggguucccccccugaggccuggugagagcccguggaagggccgagccuggggagcucacaccgaggccucaauuccugcuucccuuucagacacgcauucauccuuaacucuuuaucagaagggaaauaaaaccucccagauagcuugguugugaggauuaaauuaggaaaaaaaauaaagcuauagcuguuauuggccuugcccggugcuccuggaccgugguuaguggauggagccuuuccucauccuccagcuucuugccuguguuuguagggcucacgacagcuuguaauuauuucauuugugugggucuuacuuuuugcacaucucuucacugcguggcagguccuguggaggcagagcuugggucuguuuuguccacuuuguucccaguccaggcagaaggaugggcagggaguggacguccagauaaugaaccugaagugagugaaugaaugcacuaagcucaagucaggguuuucuuuacauagaaauucucccacgcuccuuuuugcuuuuagucuugaggaucaacaguguucauguacuaaaucaagccugaaagcccuuuuuuuuuuuuuuuuuuugagauggagucuugcucugucacccaugcuggagugcaguagcaugaucuuggcucacugcaaccuccgccuccuggguucaagcgauucugcugccucagccuccugagcagcuggguuuauaggcgcccaccaccaugccuagcugauuuuuguauuuuuuugguagagaugagguuuuaccauguuaaucaggcuggucucgaacuccugaccucaggugauccacccaccucagccucccaaagugcugggauuacaggcaugaaccacuguaccuggccaaaagcccacguuuggcaggguggcuggcagccuuggggccucauccacggugagguuguguuuggccucucuuugcagguugauggcuggaagggggaaggguucuguggucaggccugugcuucauggagaugucugaccguugggacuguaccuuucauccuuuggaugagaugcucugccuugaggcagaagcauggaaagccgguggauuugugcgugucggugguuuuccacugggucuccaauccggacucagcauugugggaccaccaguggcucccccugccacuucuuguggacacguucuuucuccuuagagcaucuguuccaggccagcggcgguguuacuuuccagccuggggaugacuuuauggcgugaugucuaaucuccagugggcaaguggugaagguacucuagcauccauccaguggccagucggccgagggccugucugcucauggggaaguguccucugauggcagcccagugucuugcuaaccagcagaccacugcagaaggcaacgcuggccuccuagagguguggcuuguuugcaucucuauguuugugaccaagucguuuccuuccuuggucucagaaucugcuuggcacuuacuaauagcauuuguucaacaugcaugaucccgguaugugaaguacagauaugacauuuauaagccagacacugcguuugacuaauguuggcaaagucacacuaagagccucccaguguucagauggcggaagggaaggcagauaggaguccaguccccaggacucugaggccccaccuugugccuugguagaagugaagacagaucgccuggggaaguuggaagaaguagccgagacauuucuccuggcucagagcagagggggauuuacguuggccuaugaaggaagaguaaguauguagaaccuucacuuguagagagcugagacuuuacugucacccuuguuuuagggagccuacauggcaccuaagacucaaauuuacauuuuuaacuaacugaagccaaauaaaagaccuuuuaucccaacuggguacacucuaaagucucgacaugauuaugccugugauccugcacaaaucgucucaaagaucuuggaaaauugguuagugucggggcacgguggcaguuaguacuggggcauuggaagcaccagagcuuaccuuagcuagacguuuccaucccguggcagcuuaacacguggcauccucacuggucuuacagcauuauggggaaugcaaaauaaggacuugucuccuuccagaagccugcugcccaucagaaauauauauauauauauauauauauauauauauauauuuucagggaaugguagagaacaguggagaaguagaugcuugucaggcgucuugucugcugggccaaggugaaucaggaggugagagcggcggcuuuccucuuguuugggcagcgggugaaggacaggcguggcaggcuguauggugagugugggcauggccgccccuccguccucuuuccccucuggcccgucucgcaucugaacaccugggagucugugauuagaccugagaagaggaaaugaggggcaguucccuuccauuuuccucccagccgcucaguccaggugugugucaguuugcacgccucccucuggaaguccgugucucugcgaggcuccucagccccgguagcccccacgccaagucccauuuacucaggguuucugcuggugacggcucuaauaggcacuucaccugcucugcggaggcgccugcggaaugguggucgcucucauuagcucugcucacccgcccagcguuacaggcagcuggggagggauucaggggcugcuguguucagcaguaaucagagcccuucugugcacauucgacgcucaaguguguaguuuaccacgggagaucaagaaauacguuaaaugcauaaaauuaaaggcagcggccugcaggauccccagguggcgugugcugggaauuggaugcacuuggcugugugugucacuuaggaaaugcgcuagggggucagcagcuuucccaucgaagcguugguuaguuugugaaaaguaaaauuccaaauauuugaaauaauaaggggccagauacguuuggagcuugagaagaacuauuucaccagccaagagauccuaaacauuuuuuggcuuaauagaaaauaauagccuauuuugaacaauaaucuuuguaaauccaagaagaaaaaacaguucaucucccuuuauagggucugauuugugucuguucaauuuaaauagcggcaacagaaauacaagugucuuugggugauuuuguucugcucuuaccaacagaugacaaucacgucuuaugguuuuugauuugacagaacgguucauuucaucagcuuucuagcagcccauuugauucaauuucccucugcaguguuuuacugaaaaugacaaaaauguucuuuuacauaaagccugcgagucugugaaggaacauaaaugugcugugcuguuuacauacuaacuuaauuguaauuuaaaugcccuuuucauuccauaaauauagccauaggcuuuucauuuccuucaagccuucagcucacagagcaguuuauauguaaacuggagucaguugcuucauaaagugaauuucuggaggaaauaauauaguauauaucaaaaucuagauagguaaugggaaauugauugugacaauacaauauuagaaacacaucuccauaauauuuuauuuauuacacuuuccaccuuuugcugucaagggaaaauauuucaucuugcaccgcgaacuccagucuguagagauuuugaccucaauauucucacacaaaugaauauaguguguaagguagcacaauuuucccuguguaaaaucaugcauaaaaaacaauucauuuaaagcaucuaaauguuuccaaauuacugcagguaauuuuuacagcuuaauuccuccgagacaccauuuuaaaugaacccauaauucaauuuucagacuuugcauuucaaauuuuuauguugaaaguaauuuccuuucuugcuuaaguugugcucagaaccagauucauaaaauguguaugauguaugucuguagaaucagugacuguuagaagcuuaauaacaaauaugcaaggaagaaauuaaaugauuuuucucuucaguaguucaguuuaacauugauuucuaaaagaaaugauucugacuuugccgcuaaguuucuuucuuucacuuuuuuucuuuucuuuuuucuucuugcaguguuccaggggauaaaacuguccuuguaucuguauuuugaaugauuuggaaucuuuuaucuuugcauauuccuuuagaccagaaaagaaguugaauaauguucagacuggcucccauguuaagguagcacuuagagauucucugaauaucaucccugaagcuauggcuuccuaaagacuuuugaccucuuaaauuagugaagaguggacaccaccgcuuaagcccugcuaagaccaguuaaaagcaucuguggucugggcggagggagcuuugaguacaauggaaaauggcaccaccguguucaugcuugcgagcuuuccauccugauggcucuccucugccuuuuccuguggcugugggauuuuucaaaacccuuuuccaugucugcccuucaauagaacacuccaaguauccaguuuuauuaauguccagaagcguaaaucacagcccccuguuuugucauuccagucauuuuagucacuaaaggauuacuucaagugacugaacucggcuguuaucuguuugaguuuuugcagccaggucaucucaggggacugggaacaagcuuucugcccccuuaacuaugucgaguggauggcuuuagcuggaccacuuuuugugauugauguacauucugugucgcuguaucuucccgcgacgugguaaugcaaacuuagaaaaaaaaauaagauggaaauggugcugcaaguuuuuaaaaucaaggguugggcagugcagggggagcuauuguuuaaaaaauaaaaguugggaggaagauauaauggauuuugucagugguauuagggcgaugaggcauucuugaguucagcaaauauuggcagauaauucugcuuuauggaaacuauuaaauguaauuggucacaucagagacacaauuggcaucuguacuuugaagcugaaucuccucagguugagagagagaaagagagauuaagacggacucuucagagaccauggacuacagggcccaaaguuauaaaucuggaagauguaaauaaaggaauauuuuaggcuaacguugcuccaagaagcaguauuugccuguaagaaauguaauaauagaggugccaauacaagauagcaaaaguuacccaggaaagauguuaagugacaugcugucuucauuuuuaaacaggacaaauuauuuaauugggaauuuugccgacacuguugaagcaauuaucauauuuaaacuguuuaucuucuccacauucugccuguauuuuuuuucuucuuugcauuaaucuuuuuccucuuuagcaucuagagagggucccuuucucguggagaucggcauuguagaccuuaaaaggucucacuugagaaauauuuuugauauuauugaauaauuauuaauucaugcaagaaacaaaaggaagggcacucaccggcucguggccagagcagacucucauucuuuacuucugaguguuugggggcuucuagcgaauaaucccuggaugacggguccuagugguuuugagaccaccaguggguagccucgcccugggaggggcuugagcagccuugaggugcuuuugugcuuugcacguucguaauugugaaccucaacgcaaagcagguguuguuguaaaucuggugucucuguggaagcaaugccaguccucuaauucaucuucgccaagcuagaggacgcgagcacaugugcaggucugugaccuaaagcccuugcuggccagggugcuauucuuaccuuugggcuuccagaaagagccagcuccugguggagugaagguccuaccuccagaugccuccgaaggugccgguacgugauuggaauaggaaugcgcaugaacggagaaaacccucaccauugcguccuuuuguucuuuuugcgaggaagagauccauggguuggcucuuacugaacaugaaauguuggaaguggaacacugcaguguuaccagugagcuguguaaucgccaccucugacagggauccugcucgaggagcacgucuuuccuugguguggccgucuccaaguacuuuggguggugguaaauuuacccuucucggucacacacugugaagaugugaguuucccaauuucagcauuuggagccauguccuuggugagggcaggaggaauuugucacccuuucucgaugugccugggacuagggcagagacgguuagucucaggagagccaggugugccagcugccccugccugccauggcucccgcauuguggccaggacuuuuucuggcagugguacugcccgagggccgcaguccuggucacauuccacuuggggacagagugugcaaggggcugaucugaagauccggcuggaaccugggagccacaggauccuggggacccucuuuggcuguaccccguaccucuguauuugcucccacaugcugucugauuucucuggauggccuggaugccucuguucccagcaucuccucggcaugcucccugcagcccuuggccuguguccagugggccccgacccggaggcuccugccccguagcucaggucccgucuuggccucagccuucccuuaggugcucguuucuccaguaccugcagcaccggcgcuuuuagauugcauucuuuaugcauuaauuaguaaugugguggucccaggugacuaauaagcuaaagaaagaacuagugugagugaauuucuuuaaaggucauuuggcucuaggaaaaccuuuuuuuuaagaaaaaaaaaagcauuuuauagaaauguucaauggcaaagugaaauguaaaguauuacauguuuuuuacuauagcgaacaaauugccccuuuuuauuccguuuaugucuucaucugcuacauuuagccagauauauuugucuaccuaauuuucugcaaacuggaagacauaaucccccaaugugaaaacaccaagaguuacaugaugauaauuauaacucaugaggggaaaagugucgccuauagaauccauaccggucguuugccugagagaacgugcucauccuggcccuguuggauugucuccacagauguuuuucauuucguauuugguuugauuaaagacaaaauucacccaucaaaaggaagaacggcccugcagagugugaguucuucauucgagagcaugugcuaguuaaaaagaaagaaaaaagauaucuuaauccaauuucugagcugcacugaucccaaauugaacugaauuuccauuaauaacucaaccuaaaaauccuuuagguguucucugggggcuggaaacagaggccgguggcguggugugauguucagcguuggccaggaucacuugcuucacccagguguugggccugcacacugagugcccgagaggaaagguuccgggaaagcugcugucggaagccgggguuugugggaucguguguaggaguagauguggaggggcuugugugaaugggggaguuaugaaaccaggacugaagacaacagaaaggcccccugggagacaggucccuggcuugcccugugcuuccccgccacucggggggccggccaugcggagaacacucuccucucccagccaggcuucagaacuggggggcucggccuccuuccucuggccccagcagcccccgagcggagacgcuggaguuccaguagaguggagggaaaagugucuuugacagcgaggugagcugccugccugcacgguggguccccugggugacucaggcccccuuccuggaaggcaaagggaggggcacguuucugacccuccugagggaacggaggagacuggagagggaacauucuaguaugugcgugcgcccaugcgaaggcuuucaaaggccugagagcagacuucagagcugaucacaaaguugaaggugggaggaggggagcaagaaagcaucggcacucagaguccccaggcaugggcaccugacacggugcugucccccgcaguggcugcugcuguuggugugccuacugugugggggcuucugugggagaggacccuguccuccgcacgucagcugccggagagucagcuggugccagauggccggccggccugccugccucugggaggccucagugccuguuggauucccugccaugcagggcgcacccacggggugacgugugggacccucccaagcgugcccgugcacccaugcagcuguggccgcagucuccacuguuuugaauauuuguuguguuccuccugguaggaugcaugauguuuugggacugugcuggcagcucugucuuccaguuccuucccaagcagugugggcugagggugccagcagaaugcccgccccaggacacgauccaguggcucucgggaucccuccaggguuggcugagaauauaucaguggcacugaucuugucccagaaugcuuggucguccggucggcugugacaaaagagaaacaugguccggguuauacacagccuuuccuugucuuuauuucuagacacccuuuauuucaagacucuacuccacuggacuucauguccgguuauuaauaagcaguucucguucugucaucgagccugcucuggaguuaacugucaaauaaucugaacuaaaaaguuaaaucauauaggcuuugaaaauuagcaucccuaagucucuguccuuuuguauuugaaaacauugaucauuuuccacccccucaggauggccaguauccucuggauuuauugcuaacaguaacugcucaguuucacacccauccugaaaccauuugaggugauccuguaauugccauguguguguauuacuaaucaaggcugcucccucuacaaaacacugaguggcccccaggccgaggugcugcagagauggcccgugugggagggguaacgccugcaaacccgacccugaucaccaauggaguggccucacguggccucccugaugguggcccuugacuguggucagcacuggacuggcccacccuaugagaugucucaggcagcuugcaagauuacaucaugugauggccaaugcuucugcuaaacaagaggcagggagccgaauggacaggccucaggaagcacagcgugguggccgucacagccuucugggaaggcuauuucugcaucacugaggccccacagcccaggguguuuaggaugaagggcacagauuuccagaugugaagagugucaggugggcuaggggcaggagaagcaugaggaggacccugugcuggggaugagaggagagcggcccugcagucaaggggccagguggagccaccuuuggggaugcggggagaacuugguggcccucagagaccccugcuuggagaccccaccucccccuugacaagacugcggccugugcugggcacagcuggcccagagcgagggccacacccuacuacugcacccuccacgccugucuguccuugcccaccucgguggcugccucgccgacccccgccuugcagcuggaguagcugugcugauaaagaugcaggugggaagcuggauggugagguagcccaucugugguuugggauccgagaagacggcaagaccucagcuucaugagaagagagaccugaagauccaugcuggggaagggcgaggauggaaaggggugcagggcguggagcaggugcccaggucggguacagagacaggccugggaccuggaggaccugcacgcggggucgggcaccugccacacucucccaugucuuugaagccucuugugguagaagagaaggugcucauauuuuaccuucugugccuuaguauguaguuugguauuguguuaaguggacagaaaucacauaccccugcucacucugagccugcauccuuugaccgucacugugaaccucagaucgagacaccagccucagcgggggcugagauagggcauuccccauucccacuggcugcuuggagggcugugagggaccugcugccuggagcacagggccuguauggguggguaagucccuggagagacaggaggaggcaggggugugcaagccucuugagguaugaggaagguggccggggucucgggaagcuugucuggcccuggcaggcaggacaagggcccccuccugcccauaccucuaccuuaggccccuugucaugacacgugauaccugaggguggggggcuguaugggcauuuggaaugugacggcacaagccacagugggucacuuguuucuacaaaugccugagaagaaaacuauucuucuaacucagagaagugggauuucccacugaaaaucaguggaaaucacuuauaauggucuuugcaaauuccuugcaucuaaggaagugccuguggagcagcagugggaggaaaccauucaggcucgauggagagggugaccgcugcacccucaucccuggugucagcacacuaccgaggugcuccugguuuaaggacguuugugcacccacccggagguaugcauggaaagaaagcacugcagccauuccccagccaguguaggggugggacacagucccgugggggccccgcggagggccugggcagaugcagggcugcgcacugccgugguuuccugugugucugccaggagugaagaccugagcagccucacuggccugguguggaggggccgccuccgagcaugcggagaagugguuugcauggcuggaagucaauguuuaucugucuuuagacucaguugaagacacauuucuuucacacauuaccauuuuuaaaacccauuaaggucugauuuuccaaggcgcugacccugacgcuucuagagggccucaucccggaagcugguggggagagcaggaaaaucuuccccguugaguuuuaaacguccagaccuuuguugucuccuugugacccuugcaggagagcucucguggcuucugugcauguucgugugugacucgcccggcugagggacuggcauaaacaaacagggaugaguuuguaaaacacuuuguaaucccuugaaaaggagaaaaauauaaaugaaaaucacuguuuaacagugaaggcaggaagggagcuguuccucaguauagcuguggguugucguuacgugagcaggagggaauuucacuuuggauggauuuggauuuucucuucaugcucaugcucucuaaaucuugcaaaagcacaugguaaacacacagcgcauguguuucuggaggaaacgcacaguguccauauagagcaggcacugauuuugcacugaaagaacguggaugagaaguuccacguguuuaaauaaacuggcaacagcggucccagauagcuuagccgggcagcagucagaggugcccuggccuggggacugagcuaaggucucagaagggucagcuagccaagcucuucaccggacaaccccugaauuaaccagacacaucacagaugcagacuguugauuccagggaacccaggugaaaggccaaggagaggugagguaguuggugcggugccccuccuggagucccuucaggacuauggcacuacaguucuauguaagcugucacccaggacucaucuucaguggagucuggacugcagucgggaggugacaaacauccauggcaugagggcagcaagagccccucucuugggaaccaguuguggccacuaucugcccagugaacaugggcuucagccccgagcaugggagggcuccugguugggcaucucccugggaguuccuugguacugccuccugcagggugaggagggguggggccuacuuccaggccucuggaagcagcaucggcauguccuuucuggugugaacuccaaauaucugagauggucucaguuaauuuagaaaguuuauuuugccaagauuaaggacaugcgccugugacccagccucaggagguccugaugacacgugccccagguggucggggcaccgcuugguuuuauagauuuuagagagacaugauacaucaauuaauauauguaagaaguacauugguucuguccagaaaggcagggacaacucgaagcagggaaggggcuuccaggucacagguaggugagagucaagugguugcaccgaguuucugauaagccucuccaaaggaggcaaucagagaugucuuucucucugugagcagagggaugacugaauacaacgggaggcagguuggcccugagcaguuuccagcuugacuuuccccuuuagauuaguaauuugggggccccaagguucuccuuucaugcugggaggaggguuuuuccacacgucucagacccaacucucgggcuucuuaacccaaaagaacuuccacgcagaaggcagcgaaaauagugcacuucauuuucuaagacaucuaaagcugccacaaugacugugaguuaggugagcucuaugaauuaggcuagggauuugcaaccacuuagcaaguucuaaguaacuguaaaagaucccauagacugcaaauuguguuucauuuggggacagauacccugucuuggggauuuaaguguguuuaccugcccagaguugacacagacgacugucccuuagcuuccuuuccucaugcugguuuuaagugcuucgaaucgggauuuuccuacccaucugaugcauuccauugaaaauucaggaauacacauguaugugacuguuuauuggcaaguaauugugaaauaggccagaaaucuaccagcuuccuuuaauuaauguaacaaauacuuagcaaggaccuccugcauucuagggauugugggggugggggggggagcaacaaacaaaacagauaaacccugcccugaggcgccccuugucuugucuggggguggagguggggcaggcgugagacagaagaaacagguaaaauacaguucaaagucaggugcuggucagugucuuggagaauucuaaagcagggaggagggauggggugaguuuuaaauguggugacugcugaagaaauggccucugacagccuggaggaggagcuggagcugggggggggacaggcuggccagcuccuccaacacacacacacacacacacacacacacacacgcacacacacacacacacacacccccucucccccaaggacccacaaggacugcggccucuuagcguguguggagucaucacacugacccuuagcaguguggccugacuucaugaggcccccguugucauggagaugcugggaaugggaggauuugccacccuccagugaggagcccccaucccaugagugcaaagccugaaccggcccuucccuaauuggcaccucuauccuauuuucuuuggcugaggaaauucucguaaauguauauuuaaugugguguugagauugguaguucucccccaucccccaaagaucaucaaaucucugggggucuuucaaaaccuaaaggugaucucccugguccuauuaugcuguuuuguuuuugcuucuuuucuuuuucuugaaagaccuaauuguggaguuuuuucccccuucuaugaaucccaaguaaggaacuaaaauggaagacgggcuucuggcucccgcugcagcagaugggauaauucuacaggugauugcccuggaggucugcaagggagggagagcggcaccauuagacuaacacagcucuauuauugacuaaugacgaacagcgucgccuugccuugccaccuuaaaacagacacagggauuugcuacucuauuuguuuuauaaaauaugcauugagagcaacaccaaaaugcugaaugacaggugacccucagagcacgccugguaugcacugcguuagcuugccaguauuucuuagagacuuauuugauucuaauucaguaggauuuuuaaccccaacauuuugaaaucuugcuuugaaaguccauguuauucccauuaacgucagugaguuuuucacauaucuaaauaucuaauaucaugcuuugagaauugaagcccagccugcucuuuaaaagcaagggagcucaccacauccuggaguucugcagugauuugacauguccuggaagaaauuaucuucgcaagaaaguaaguuuaguugauugaaaugaaauuaacaccacauuucugugucauaauguauuaaccugauuggcuagcuggauuccagccuguuuacaaacauccugaagccuagauggccccuuccucaguguccuuaacugcuguucucgcccuuagcucgcgugcccaacccuaaggcugaaaacgcccccuguaggcuacuguaagcuguagcauucaaggccucccaggugucgcuguaauuucuuguauacauuuuagcuccaucuguggcauagguaccauucaauguuaucuuaauacacuagcuuuggauuuuguggcugcaacaauaacaaaaaaaaauccuugguucugaugacuucauguuguuucagaagauacucaaggccgggugcaguggcucacaccuguaaucccaacacuuugggaggccgaggcagguggauuaccuaaggucaggaguucgagaccagccuggccaacacagugaaaccccaucucuacuaaaaauacaaaacuuaccugggcaugguggugcacacccguagucucagcuacucgggaggcugaggcaggagaauugcuugaaccugggaggcggagguugcagugagccaagaucgcaccacugcgcuccagccuggguggcagagcgagacucccuguguggaaaaaaaaaaaaaagauacucagauguagcugucucugccuggguuguuuucuaaaugcguuuggcuggagauagaacagauccugccucuauccacggcguaagggaguuagcuucauggcaagcucucuggagaacacaggccauuguaccugcucaugagaacagaagugaaagucacacagcaugcauauuaguuccgaggcuacuggcauuauuauuuaaugaugaguuagugcaaauugaggggugaggaaguagcauguacaaaggcccugaagaugaaugacugugugaaauuuugaagagcaguuuagcccgaaaauauuccaugaguagcugccaggagagcuuuucuggaacaguauuaaacuuuagaaaaaguguucugacauuuauagacugacacgaaaacagaaguaaaagucuaaauugaaccaaaguccuccuuaaagauugccuuugaaauugaguaauggcggaugcccagcaccugauguuugggcacgggcgacaggacguaggguggucauccgaauaucccugccccacuccccagcucucuauggcauuaguagaugcuggaagaugaggccguguuuucucuuucaucacccgugcagugaaggauuugcguggucuuuggugcuuuucuucuaaauaaugaacaauuauuucuugcgacauuuugguuuuuuacugccaauuccaacagccauuugucuuuucagagcuaaguuuauaacuuccuccuuucucuccugucacuuuuaccccauucugauuuuucaucucccugccaauugugguuucguuucugagcacucauuuauuaauccuucuuuuucauuucccagaacacgugcugguguaaaucuuuuugcaguuaaaguauuacauuaaccuuuuugauagcauggggugguaucucggcggaugggcgagugcuguucgccuguggucugucucagggguucuaguuggaaggcguccugcagccauuucuucagaggcuaaggugugggggagcaccuuggggaagaagaaaacauaguuucugcccuuacaaagcugauaccccaucaaacuugagauuaaaacagacaaaaaacccaagaaccuacagagcacugcagagaggccuugggacccucugacagagucaguggggagucggcugggaagggcagcuuuucugucccagcagccuugcuuccucuucagcaugcugagggacauggagcccuccaccauuaucugaauugauuccaucuuucucuccugccucugcuguggguuuccauaaugugaaauuaaugcaugugcuuagguugcggggggccaaccccucagaaauaugcaaagacuucaagggagaccuuuucuuuucacaaagaggaagaucccccacccccaacacacacacacacacacacacacgcacacacaugcacaguuugcauagccggaguagggaguaucucuuucuggggaauguucguaugucacuguugauuuuacauuguuuuuccuuucuuugacuugaaaauuuuuaaaguaacacaaauuuauuauuuuaaaaacuucaacucuggaaguacagccguaaaauccucuuuccagaagcaaucagucuuaguccuuuggaaugcaaccuuauaaaucuguuucuguuguaaauauacuucccuguucuuaccugccuuuaccuggagaguacauaguauauucuuuugugaguaggacuuuaacuuccuaauauaucauaggcuuuccgcagcugguucuguauuauggauuacuguaauuuauuaacuuuucccacuuugaguggaaauuuaguuuauuuccaacuuuuuuuuuuugcuuuuaugguguuaugaacauuuguguaugucuguauuucugugcugugugcaaguauuucugugggauagacgucuaggagaggaauuguuuggccgaagggcauacacauuuaaauguucacggaugcagcccagaccccccucauaaggcuguaccaacucauacucucagcaguaauaaagacgcguccauuucucacaccucugcagaggauuucuaaaauggcuuuuuauuuuucaaaaagcuuacauuugacaacuauugauguugugcaacuuucuguguuuauuagccaauuauauuuuuuucuccuuugauuuacuuauacauauucuuugcuuuuuucgauuguuucuuuuaguaacucugcaguauggcuacuaguccuuugucuaacaaguuauacauauuuuauucuagucucuuuucuuagcaguuuaguggugucuuuuagucacgcuggaguuuuaaaguuuuccgcaauuuaaucugacgaucaauuuacuggaguuuccaguuuugaguccugcuuugaagcgccacuguaagauuucgaaaaaggacuaucuugacuuacgguuuuguuuuaauauuuuuaauuuacugguaauuugcuuucgugugaccugagaaugaucugacauaagguuuuucuacauagaugguuuugcuacacccuuuccauaggcuucacugucaucuacccucaucacugaaauguccccuucaucuuauucugaccuuuccugugugugggucuagauacaggcucuguucuguccauugcuauuccugggccagcucuucccugauaguaauguggcucugcagacaguuccacguguagaggauguguccuuuuucauucuuguuuguaaauaagaauggggguggggacacgggaggcagaaucauaaacaaauagccugacagaacagggauaauaaaaauuuaaagaaaaaggggguuaggggaaguagaguaagaucaugcccuacuguauaggucauagguaggaaucaaaggaaacuauuucaagcucacagaccaggaaguggaagauuaggcaaggaaaaaaaggaauuaaaauagggugaccagucaucccagcucgccugugacugaggggccucccaggacacggaacuuuccguuuuaacacugggaaaauccuggguaaacugcugggacaaguuggucacccuagauuacagacgcuauaaaagauauacacacaaagguaccacuagaauaaaaacacuuuacaaaauauuaaccuaaaagaaaaagcaaagaagacuaaagagacacaguaacccucacugcaauuccagcaucagccaacaggacaaagcggaagcugugucaggaacugucagggggcuuagcugcuucuggaaaugaaauuucacguuggcuugguaaggcagcccguagcucagcacaugugagcagcacaugugaaacacagugauucacaagggaagggcaaagggaugggcggugauuaaucaggcaaaugaaaccauagggaagcagggguugccaucuugggauuagaccaagcagaaaucaggcuaaaaaggcauuauaagagacagaugagaacaccuuaaaaugcuaaaagucacacucauaaugaagauaaaacccauguaacacagaaaccaccuguauaaagcagaaccuacagcauacgcaaagagaaauaaauagcaacacggaaauugucagagauguuaacacacuauucucaguacaagacaggucaaguggccacaaguaaggaaugauacaggagacccaaacaaccuaucccgucacagauacguauugaaaugcauucgcugaguagaaaauacgucuguuucucaacauacauggaauauuuacaaaagcuuaucaaaaauuagguuaugaagaaaaguuucauaaaagaauuguuacaaucaacauucucugaucacagugcaauaaaacuauaaauuguuaacaaaaacaaggcccauccaccuagagacuuaaaaccuauucuugaaugaaaguguaaauauaaaccaacguaauagaaugucuguaaaauaauaacucuguguaucaaaggcauaguuaaugcagugauuagagaauucaugacuguagacaccuauaucaguaaaaaugagggaagaaaaauaaauggaauuaauaccaaacucagaaaacuaugaaaaauuaaaagggaagccaaaaaaguauaggaaaggaaauaauagaagcagaaaauaacgaaguagagaaggaaaaagcauuuauuuaaucaguaaaucaaauucuagguccuuugaaaaaaauuuaaacagacaaaucauuaguuauuuuauucaaggaaaaaaauggggaaacacaaauauauaaaaugagaaugacaacagggaaauaaguauugauacagaaguuuuuaaaaagcacaagagacuaauuugcaaauaaauaugaaaacauuuuugaagugcauaauuaggaaaaauccaguuuuagcaaaauuaaccccaguagagauagaaagcuuaaauaaaccaauuuacauggaagaaacagagaacauuuucaaagaacuaccucacaaaaugggucugagcccaguugcuuucacaggggaauucuaguaaaucuuuuguguagaugauucuaaugauacauaaauuguuuaaaagcauaagaaaugaagggaaacgucccauauuuuuuaugcagcaaguacaaauugaaaccuaaaccugguaaagauaguauauuguaaggaaaauaaaaacuaauauaauauggaaauauugaugcagaaaucccaaugaauauuagugaauagauuccgacaccucauuaguaguauaauauaccucaacaaauauaaccuuucuaugcccaggaaugcaaggguaguuugguauuaggaaaucuguucauugcauugcagaugaauaauauaaucaugcaaaaaggaaggaaaaaaguaccaaugcaaguaacuuaaacacuguacucugaugacauguacucaauuguagggggaaaacuacaaauauucuucuuaauaacuuuguuuuucauagugauguggaauuauuucauguguauguggauugagaaaaugacuaaguguguugauguuugggagaacccccugugaagaagagggacacuuacauggaguaggcaucaaggaagaaguuggugcaguugacuuggaaucagcaucaucuauauggacucauuauuucucaaacaugcacauauguacacacuucuuccagcucuagcuagaacuaaaaaggccuagaggcaguaauaccccagucacaaagaacacaccuaguucccagucuuauuuucaaaauaccaugcaccacugaaaaggaucuugugcagcuuggagaaauggcugauuccaggaugggggcagcaaagacacaaaaggagccuagaacaagaagaaugauaagcaggaugagaaggaagaauacaaaaugagcccagaauuagcagggggaagagaagccaauuuuuaaaaugggcaaaacauuggaacaggcacuucaccaaagaaugcauauaaauggaagauaagcauaugaaaauaugcucaacaucuucacccuuagcaaaugaaaacuaaaaccacaaggagauuccacuacaugcuuauuagaauggcuaaagugaacugacagugccaagugcugaugaagaugcagagcagccagaguccauugcgggggaaaaugcugaauuacagccaccagggugacagucaggcagguuuaaaaaauagaguugaacauacacuuaccauauggcacagaaaucugacuuaaauguuuacucaagugaacaaaaacagauaccuacucacccacccauccacuccuucagucacccacccacuccaucacucucucucucuucacccacucacccacccccccaccuacccacucacccaccuacucacucccccacccaccccccaacucacuuacccccacacccgcucacccacccauccucuccccucucccaacucucucucucccaacucucucucucucucuaacucagaaaaguggcuuuacucagagucuccccaagccuuaaacagccauucccucacuuggagaacugaguaaguagauaagcuguaguucaucccuaccaugcaguucagaucagcccugagaaaggagcagacaauugauacauacaacaucaugaaugacucucaaggcauuaugcauuugauaguggaagaagccagacacugagaugacauuacuccacuuacaggacugacugugggaggcaaaaccacugggacagcaaaucagugguagcgagggaugggauugagggggaaagagguuuccuauaaaggaccacaggaagugcuuaggaugauggaacucuggcuugaucuuagugauggucaugugacuguagguguuugucaaaacuuacagaacuaaacaccaacaagggugaguuuuacuucauguaaaaaauguuaaugucaugaaagacaaaggcuguaaaacuguuccagcuugagggagacugaagagacauggcgacugaauacaacgugugccuguacuccagggaaaguguauugugggagagacuuaauugggacaauugaugaaauuggcuauggauuauauguuagauaaaagcacuguguugauguagaauuuccucaguuugacaacuguacuguauuaugguuaccuaagagaauauucuuaggaaauaagaugugugauauacccaaaguaacucucaaaugguucacacaaacaaauaauaauguuuguguggggagggagggggagagaaagaaaaaacaguggcaagaugguaaaaacaggugaaucuagguaaagaauauacugguguucucuguauucuuguaacuuuucugcaaguuuaacguuauuugaaacaaauuuuaacuauuucaguguucuagaucauauaucuuuuuccaugcuuuuagaaugcauuugucaacuuucacguuuuaaaaauccaguuacaguuuugauucagggugcauucacuauguagauuaauuugggaucacaaugaauuucuguuaauuuugagaaaauuuauauuucugauauuuuccuaucuaggaauaugcuguuuuuucacuuauucagcacuucuuuuaugucuuuccauaaaauuuuauacuaugagucauagaacucauauuuuuugcuaaguuuagccauauauauuuuuuaauguuuguuuuauaaaugagcucuuuucaccucauugaaauuacuaauuuauuauuucugacauacagaaaagcuguugacuuuuguacuuggccauucugcuaaauucucuuauuaguucuaacaucaauuuauucucuuuaacuuucucuaauaauaccuggaaauaaugauaauuuuguuuauuccuuccuaauauuuuuaucuguuauuucuuugucuugucaugcauugaccagaaccuagacaacaaugcugagaguagugauacuguugauggggugugccuacccaacaguuguagaaguuuuuguuucuaauguuugcugcuuaugaaacauaagaugguaauuaacaggugauugcuggaaguucuuggcuugguucccacaccugaaaagcauuugugauuuacugaaaaccagugcauguugaaggcuucccagccuuacauaauugagauucacuuugacugucauauugccaaaaauggacucaaacccugaaguuguauccauaccaucuugagaaucaguuguuugaagcgucacccauuguuucuaaccauuuuuguuauaaagauaauacacacagagagaagcgccugcagugaaucuuuguguaaccaucaugcagaucaggagacaaaccauggcggccccucagaacucugccacguguuucuucccaucuuuuccugcugcugcucccagaaguaacccuauuccgacuuuucuggguuuucuugguaaucaauuucugguuuuucuuuauagaguuguugccuaaguaugcacccuucaacacgauacuguuguuuugcuuguacuuuuuguuaacuguacauauaauaaauuauguuauauauuucuuuauugcaggcuccuuuaauccaguguuauguuugggagacgcacccauacaacugcaugucaccguagcuuguucauuuccagugucguguagugucccuucaugugaauuuaucacaguuuauuaguaucuuccacucugauggacauuugguaguuggaauuuucauuacuaaugaugccccugccuguggucauuccugccugccucuugaugcacacaggcacgcauuucugcuggguauguccuaguuccagacucacugguuauacgguauggauguaauuauuguuaguuuuccagugugauuaaacaucagauuagcgcccauuagcaaugucugaggcugccuguugcuccacucgggugcccguuugguauuaggagcuucuucagccauucuuguguuuguguucauguaucucauugugguuuuaauuuucauuucuauaaugacuaaugugguugaauauguuuuuguaugauuauuugccauuuguauuugcucuuuuuaaaguauuuguacaggacuuucacccauucucuuauuguguugccuuauauaggaauuauuucuauguucuagauauggauccuuugcuggccauauauguugaaaguaucuccacucuuuggcuugccuuucauuauuuuaauugugucuugcugaacagaagguuuuaaugucaagguaguuuuuagucaauccccucauuuaugauuggugcauuuugucagguuuaagaagucuuuucucucccauaagaacgugaagaaaacauauucuccuauguuuuauagaccauagguuggcaaacuuuuuucuguaaaggacuaaauaguaaacauuuuaagcuuuguggaccacagauagucucugcuacauauucaucuuaaaaaaaaaaaaagaauaaccuuuagaaguauaaaaaccauucuuagaugcugggccagagugggccaggcuguacuuugccuguuccuguucuagaagucacaguuauuugcucucaccuuuacaguuaugauuucaguugcaguugguuuuguuuuuuguuguuuggguuuacagcaugagacaugggacaucucuaaauggauauuuauucauguugagaaguccauuuauuccccaugucuaugcagugaccccuuugucacaagugaaaugagucuguuucucaguugucuauuccauuuuauuguccuauuugcuuauucucccaccauaccgcacuacuuuaauuauuguagcuuuauaacaaauuuucaaaucuaauagagaaaguacuucauuuguucuuuuuacaacugucuugguuauucuugguuaagacauuuccauuaguauauaaaugaaucaguuugucacauuucaguuucagaguaauuuuuaaaagaacuuuuucuuuuugaaauguagagaagguuuuuagaaaaucuuuuucuucuugaaauuguagagaaacaucucuacaauuuugagucaucaaaucuguaaacauauuauaguccuccauuuguugagguugucuuaaucuuucccaaucaugacuuaaagccuuucccuacagaagucuugcauacauuuuguuggauuuauuauuagguagaugaauauuuaaauauauauaaucuauuguaaguguuaugcauuuauuaauuggcagugcuuccuuaaguguuuguuggagcaugcugcugaaagcaucuuggcuuauacauuuccauagaagauuuaaaauuauaggacacuagguuuccugauauuuuuguuuuuuuaaaaaucaacuuauuuuguuuuacugcaauuuuuuuuuguuaagagacagagucucacuauguugcccagacuggcuucaaauuccuggacucaaacaauucucccaccucagccuccuaaaaagcuggaacuauggaugcacaccacugugcccaccucuaauuuccuuuuuuuccugaucuuucuggcugguugcuuaccaauuuuacucaccuuuuuaaugaccccacuucugguuuuacugcuuuuucuuauuuuuuuguuuguuuucuguuucaucaguuuccuauaugagaucaacccacagacauacaauuuuauuugagcauuuguauugcuuagaaagcauuuauaaaauuuuauuaaauucuucucgacauuuuucuuucagcauggcauuacacugcagauuaauaauuuccaauuaaagguuggguggaagcucuucaauugcacaguuaaaaagacuuugaaauauggagauuucuuuuuguacuugccuugggauccacaaaaaacaaaacacuaccagaacaguaauuugugcucagaaauuauauccacuguaaauuucugugggaauagaaaucuggagaaguaaaugaacagcugauguuucuuaugauucaguuguuacuuuucaucacaauaacuuuacugaauuuuaagcauauaauuacuguuuugccuuguaacuuuagguugaauuuauuuuuaaaaaauauaaaguccgauuuacaaagcuauuuaauguuugauaacaauaguugaaggaaauucuuuugauucagaaaaauuuuaauaucaaaccugaaccauaaaaauugcaguaaaacguuacuaccucugcuaagucauugaagugcuuugugauacaguaugucaggauauccagcuucaguuucugacuaaauuucauagaaaugauugucauuagguccgugagcaucaaugaaguacaccauugauuacacucuuuaaauaaugugcaauagauucagauucacauauuuuaugcagaguaccugcuaguagguaauauaguaaccauaggccuuaacauuuucauaaguuuuucaguuuagccaacuaauccuuuuuugcuucacacaauuucacaaccaccacuuauaacacaucuuagcagauuccacuucagguuguaccgaaguaguacuuucucauuuuucugaaaaucuuuucuuuggauuuaaaaauuuuuucuuugaaaauauucuugccauggccauaguuugccagcuguuaaucuagcuuucaaaauaagaaaccacaaagaagagaaaauugaaacauagaccuaguagaagaaaggcaauaaugaaaagcauaaauuaauguaauggaaauaaaaaaaauuuuugagaaaaucaaagaaaccaauagcuuauuucaguuuugaagacaucaauaaaaaugauaaaacucaaacugagaaagagauuacaaauuacccaaauugaugugguaagaggaaauaaguacagauccuacagacauuaaaagauuaugaaggacauauuauaaacaguuaugccaguaaaugugacaacagacaaaauggacagaaucauugaaagacacaaacuaucaaagcucucucaggaauucguaacuuaguugcuguggugccuguaugacuguacaugucaguacucauugaacuguauguaugaaaagauuuaauuuuucuguaugugaaaauuaucucaauuuacuugacuuuaaaauauuguuuaaugcugucagucauuugagcuacacguagauuuaccauuuuuauucuuuucauccuuucugugucuguagccuucuuuaugugauaauccuccuucugccugaagaauaccuuuucagcagcagcaagcugaagccagccagcuccgagagccaguucuuuaauuuacgagaauuuuaugagcuggcugucaaacacacccauuaguaaaaaucgaauuacauaaauuuacaguuaaauacauuauguuuggaaagagaacacacauucaaaacugauuccuuccaauuauuguacuaauugugcuguuauccauaccuuggaggccauuuuuaugaugcugugauacuccacauuuagugcugucaccuugguagcuugaagucaguccugguaggaauauuuacacagcagaaauuagcaaaugcuacuaauuagaaguuuauuugauuaucuagaccagagguugguaaacuauggccuggggcuggggcuggacaucuuuuuuuuuuugguaaauaaguauuugucaacacagccacacucauuuguuuaugucuugucuguggcugcuuucauagcucaguagcagucaagugggagcaacugagacuuccggcccacaaaacacaauauauuuacuaucuggcccuuugagaaaauguuugccaaccaaaaucuagauuucaaaaugugauggagaagauguuaguaaggugcauucauuuucagaugucuuguguguaacuguuacauuuugaauagcuccagaaauuuagccccucuuccagugguuaaaaguaucaucucauucaacaaagaaaucgcucacgucauugccgaacacgugaaguucugacauaacaucuucaucaccucugucucgucacuuugcagcauucauguagaacuguguguucaccaguugcaaccucagauuggcuauggacaugaguuuggcaaauaucaacaaagucaugcuauaagaaucagcuggcuauacagaauuuacaacaaagaguauuguguauugaauuauuuguaaauuguauacuucacauccuuuauaucaguagaguuuauucuuuaagaaaugcacaucuacaugaauacuuguuuuggaaugccagcuaaacauuuaucaguacaccauugccuuuauuucauuucacagggaauugcuggcaaguucugguuucaguuucuuuuuuagaaaaugucuuaauuguaucuguauuuuuauaucauuuguuauaggggucuagguuuccaguuauuuuauucagaauccagagauacugugacuuuuucuucaggcuuccaucauucuucuugagaagucagcucuucuuucaaguaaugucuuuucucuaaauugagaucugacuagguguggacaccuuuuauuuaucuugcuuugagaucacagggauuccugaaucuauagcucaaugucuuucaacaguuucagaauguucucaucucuuacuucuucagagguuauuuuugcuccauucccuugaauuuccuucuuugaacccauuuacgcaucgguacacuucccuguaucuucuaaaucucuuguucuccguuauuucccauuauuuuauauccgugggguccauuguguugauuucuucugaucgcucuaacaguucauuaguuuucuuugcuacugugccuaauuugguuuuaaacccauucauagaauacauuauuucaaugauuucucaauucuaguauuuucauuuuuuuaaauaguuggugauucuuuccugaauuugagaucuuagcuuuuuuccugcuugaagguaguaaagcauaguuauuuuacauuccaacaccuggaaucccugugaucuauuuuuugucuuuauuucugccauuuuuguucauauugucuuaucuccucaugggucuaguuguuuuuuauuuugugccauauuaguacauuggagaaacaguguguagaaaugacguauugcccgggaggauguuuucuuccucuagcagugcuuggggcaccggcagugugggaucagcucauucuaacccuagggauuaauacgaucagagcagggcuguggcucuuuugagguuugcucuagugacagcucacuuuuacuccuacaagguggccauucagauucuucccccaaguugagggugcucaaaggacccugcaagacacugucuguugccccagggcagucaccucgcaggaauggugcuucaucccaggguaggggcagcuccugugcugcuguuuccuccuguacgcuggcccaaaauugucgcugucugcucuuagaauaugacccacuccuuucauaaagcugaguucaaaucccacaucccaauuuaaaaaaaaaaaucauguuauaagcaacacuaacaacaaauccacuuuucugucagcccugcccaccuccccaucuuccuuucugagacaugcagcauuucucugcaacaagcaaaauuuuguaugugcaaacacacccucccaccccaaacuuuauuuuagucucugugucuugguuaaggugucuuccucgcagugccugccaccuugcggucgagcccagcuggcaaaugaagcugagcuccaguucugccugaugcaccaccccaugccuuggucuucugcuggaggcugggggaggugagcacuggccaaggaccagcccucugguucuguccacaucggcuugaugcccauucagggguugcaaguucuccuggucuggaucuauuaguugaagaaauugccaccucguaauuucaaauuagugggaauuaaaaauuuaaugggauguauguauuuuuuggaucauaugaaacuauguuuuaugugguauuuaaugugaguuuaaauaugcuuacuaaauaugacuuuuguuaauaucucaguugaugcucgugcgaaaaaagucugccuuucuaccuuucuuuccuaccuuucugccaaacccaguccuuuuacuaauauuuuaaaguauugauuugaagcagcagugugguugcuucugucuggguuugaacaaguaacugaauuuuaauuccugagaccucuuacauauagcaauugucuuggcuguuguaggaaggcagcacccucauuccucugauuuagcucucuuugauucuacaggaaguuguugccacugucucuuuuuauuaaacuaaaugccagaauucuuucaugucaucauaagauguuaaugcauauugcuuuggggaccaaagucauacaauuagaaaccacucaaaugcuuuuuuauucuaauucugagguuaccaauuccuuaaaauuaguaaauuuucacugauuuugcaagccaguuguaaaaaaaaaaaauaguauaaacuccucacugacgguaguuuggaagcugcauuguuuggaugugauguuucagugccacacacguuagcggugggaacuggaagccagucacgaaucggcuaucugcuucagggaucuggcuuugcacuccugccccugccccugaaguggcucuagggacagcugugguuugaguggacucuugcuccuuccugaccucuuaauggccacauggacccccuugcuuaucuuugagagcagggccuugauggaaaugcaaauguguuucucuuugguaacccagauaccaaaaccaagugcaguccuggaaggugaaaagaguuuccaaaggaaaaauaaaagacacauuucuaggaagcaugggaaaaccuugguggcuuuguccucuggugacagcagccugggggagguggaguagcugggaugcccccagcuuucgccuccccugggcucuauccugcauguucuugguccauagcccucugugggccauaucuuuccagcaucaguaccuguugggguccgugcuaggaacacagcagugagagaugaagauguggccucccugaccgccuggaguccacagugcaggggaggagggugacuuucaacaacuaaugaacaaagcguggcucagucguagcugagagaggcacugcccaggagaaguaugaggcaucgugggagcauuuaucagagucagaggaggcuucuuugagagguagcuuuuaaaugagaucugaaccacguggaacaaguaagagcucacgagugccugugaagaaggaccccaccuugcacuugggggacccgaggaggaccugugugcuugccgugcaaagcagcaggacagaggacccagcugagggccaggcgggagcaagggcccagcacacugggagguuugagagggugucaggaggccauuuggauggagaagccacgggcaaccagaggaguuucgucucgaguccucacccuggcuguaguguggugagcacauuggauuuggagagguuaggcagaugcaggcaggccaguuacuggaccaucaugguggucuaggcagggaaugacuggguuuagacuaguagaaggaugacagcagugacgucuguaaguggacagauugccggaagaguuaggagugaaaacgaggacuuugugauuaaauagggccaaagaggaggauaaggcaggcgugggcccguguugcuggcaugugugacuagcaggaggggaguccccaucagaaggggaaacagagcaggaagccaggaguggcgggaacaacgcuucaaccuugggccugcucuuguugagguccagggaaccagugggucggauccgugagcaugcaggcauggagcucagagaagcagcaugugucagagauauggccugagagccacacacccacugcugcugcugugaucuccuugggugagagcaucagggagaagagagaaagacccaguagguggugucgccaagggagcaggccguggugacagaggcugguggaaccaucgggaaaaagggugccagagcccauuucccuguggcagccaccacccccuccucacaacacccaccaggucccuuuuccuuaaaucaaaaccugguggauuucaggggcaggcgcugcucaguuguggccucugcaaggucccggccaugugucaccauugaguagcugcuaccuggcacugcgccgggcucucaugagcacaugugagugagggagggaaggggcuccauuggcugagcagggugcacccuaccucuccuguaacucccaggaguggccgucccacacccagauggggagucggggugaagccaccauccugugcgugaaucaauggaaggcaaggcuggacucacccccgccuuuccccagggcauugggccggauguuacugagccuccuucacuuccucuucccuguggccgccccccgaccuucauuuccuugguaaugggacacuuuggccgcugucaugguuggccaggcucggugugggcggcacccaccaguuccuucugugaacauacagguugauggcaacagcgcuggggccauggggaugacugcggggagaagggcucauggcagagcaagcgcaguggacccucucccucuggccaguguucuucugugaagaggugcaucucugcgucucugcggcguacucugcgagggucccuguggaaguggcugagaucagcaagacgacguguuugcagggguugggccacaccaggcucugcacgugacauggagccugcagcuggaagaacagucuguuuaauaaaaaauaaccauuugauaauuauaaucacuuuuaaauugauaaauggauucuuuuaaauaaaagaaaccauuaagaaugauuguucugcagaaaaagcacaugaggaaaugaaauuuucuaucucauugggaauuucuugguaaauaugcaagcagauacauacauuacauuuagauuuuagaaguaaaaugaccucauauacuuuacuuuuuuagcacagagaauucuguauagcauaaagcaguaaaucacagauacugggcauuaugaguguauuuuucuuuuggaaaaaaaaacauugaaaaagcagaguuauuaauuggaguccucaagguccuuauuucaguaaaucugaaauggugaccaucuuacccauagcuaaguugggaugccaaagccauuuccaccaucagcgugcuaguaguaaccauccaggggcaaagcggcugauucugcagccugggcaugugguaugugggugucucugaugggccaagggaaaugacaggcccuugugcugaagacugauaggaguugauuuacaugaaacacauguguuuuuuuuuuaaagacaauuuuaaugcacauauuuucauuuucagcuuuauaguguuuuaugucuuuugccuuugugauuuaaauugucuuauauuauuuauaagcauuuucuauuauuuauaauuauuuuuaaugauuuuauguaauaccauuuuauuucuagcuugaccugaguuggccuaugcuaacacauuuaagcuuuccuaauucccaagguuaccauaaaucagcaggucccuaacuucuguauucaucucugcccuguagagaauagccaaccucagguuuucgcagccaugccucaucucucuguuucucuaaagggaagccauagcaggugccuggguaauguccagaucugaaaaaucccauguaaccuggaguugagggccugucuuucacccagucuguuuguaagcagugccucugcccccaccauguccccaccugacaggccagcucaacaccugccugccuccucgucccugcucuaacacuagucagggcgcacagcccagcgaagugcucugucugcugggaggagguacuggcugugaucggacugccccccacaaagcccugagcaggugaagggugugggccagccgggggcgaaggaacaggucaccgaggccacugccagcaccaccaagaaucaggccagguuccgggggcaucucuguccccaccagcagcacugcccuucagcuuuuugaugaggccgguuguuggccauaagaggagcggugauaaguuuagauuguuuuggugucuguaggucauuacuggaauuacaccagccagccaugaggucauaaaguuaccuugacagauugugaaugccgaguccacaguaacucuggagggcugccuggcaucguccuucaucauuguccagaaacgcuccucucgggaaggcugggcguaaaacugaaaagaggaggcucaaggaaagaacgccucgguggcuccaugcaggaaacauuauuucugauuucaagcuggagagagaaaggacuuuggggccccuguuuuggaggccuggagugaugaguacugugucuccaagcucagaaugaagccaccagugguggcugccuuuguuucugcacuuucaguuccugcaggugcaggagcuugccagggcugcugucagggacacuuuuccaggccccgcugcccuggcuggguuuccuucucugagcaggaacaagugcccgaugcuguugcuggugcagauuggagggcugccagggcugggugacucccugccgcauuuugccaagcuuguguagcugcuucugccucuuggaggggcuguguuagaaagcaugcaucaccuccaguuaccucaggcagcaggaaagacuuuuaaccuacuaaacaagcgucuucccugggaaaauacauccuuugguugagacuguaggagacacacuguaaguuauuuaucuugaacccuaaacugcauguaaaaaauguaaccaaacccucagugccuggggcgaaauccacucccuaauguuuuaaugacacaggauccacuaugcuacgugugcaccggguguagacuugguccagugcauguggugcuaagccauaagggacuguuaggaagagccgggcaugguggcucaugccuguggucccagcacuuugggaggccgagguggguagaucacuugaagucgggaguucgagaccagucccggccaacauggcaaaacccugucucuacuaaaaauacaaaaacucgccgagcgugguggugcacaccuguaaucccagcuacucgggaggcugaggugggaggaucgcuugaacccaggaggcagagguugcagugagccaagaucaugccauugcucuccagccuggaugacagacugagacuccaucucaaaaaaaaaaaaaagaaucgugauauucuugauaggaaguaaauguuagucauaggauuacaagauuuuauucuaagcucuuacaagcaagcaguucagauuaauguguuuucuuagaaaacuugauuugauuaaauuucauacuuuuuaucuauuccccaaaauuuaugcgguccuugugugcuugaggguucuaggaacaaagugauuggggaaacaccgguccccucugcugugggacccugcgggcuuccagaacuggcgugagguccgagucgcugugggacccugcgggcuuccacaacuggcaugaggucugagucccgguguuucacaauauuacuugaccaaagagcguuuuuuucacaaacacaugaggcagcccaugugacuccagggacccgcaaagcacagcuugagaaauguugguauguuucaauggaaauguauguaauuaagaauauuaguacaauauuuauuaaaaguuucugucuugaaugaaguaauaggauauccuuuaggaagccugaugucgggacgugcugugggguauuuuuauguuagguguuaacauucagcaaacaaauccaggcucuacuuuuauccuuuaaugaaagauuuuauuuuuuauucagcauuggugcauugaggacuuacagccaucuuaucuuaccucgaugccauugaaacaaaaaaauuagucauagaaaacaaaccuaaugccuuccuuugcaaguuccagucagaagugucgcauauaccagacaacacaucauuuuuauaguuauagagagaacuccuauguacuucaugggaauacaaaaaugucacaaaauuaaaaggaauuuuuccaaaauuacugugacugaacagaucauuccacgcuccguuauaccauucugauccuaaucccauaguuuaaguguagaggcuggaaaaugucuucgauuuagaaaggaaagacaggcgagugcuguacaauggugcaauucaguggccaacgagcccagcagucgcagaccccauacauuccucucguucauauccuaucgauuugugacagcgaucacaugcuauuguaguacaaggaagagguuuuuuuaaccgacuguaugacuuguagacuuuucugugaauuuucauuaagguuggugaauuguacaagcugaggaaagccaagacaagcuaguuaaaaucuccuggcacacaggucagccugaguucagauuuuauuucgcgggcaugauuuuggggaucccgugcuagauuguaguuguguuguaauaaagcccccuuuccagcgcugcaguggguuguggaaauuguugagaggagaaaccaccuucuccuaggcaucuguauuugguuacccgccagcacugagacaugcaggcauggaaaggcagacucaggaagguucaggaauucuaccgacuuuggagcaugcucucccccggaucugaaacacuggcccccgucuuauccacccaccacuccuuaagacauccaggcguggaagggaagauucaggaagguucaggaauucuaccgacuuuggagcaugcucuccccuggaucugaaacacuggcccccgccuucuccgccucccgcuccuuuaaccagucgucagguauuuccucagguacccgcucugggaagccuucccugacccuccuuugcccccguggggacguggcugcugcuucccccgugugccuguggccccuugugcccagcgccaucgccacuccgugaggguagaugugggugccggccgugucugaugccuccccacaggggccuugggcacgcuguguggacgcugccugugcgugcuuccugagcgaccccaucaguaaagcgucgccaccaugcaaugcugcuggcaguccuuguacugagacaaugugguagcugccauccugaauuucccucugaaacugcucccaccaccagugcugccugugcuguggcccugcuuuguguccuguggccuaacacuggagcgccggcugcuaccugucugucuccugugcuggacaggaagcaccaugcaggcggcguugucguccgauggucuccaccuguggccguagcaccgggugcgcuguggacugggacacuuccaugucacuccacacgugugccccgcuguggcacuguaaauauucauuugagcugguaaggaaaaugacauuuuaaaugccaugaugauauauaguguauuucucaugugaaucacguuuuccuuaguauggcucagcagcacgccauguuuccgucccauagagaccaugcuuccuguggggacgcccaugguccuggcuaccucugcugaaagacggccaaggugacucuucagcuauaagagagaucacucauccuggaaacuugucagagcaggagaauuccagaaggaucaauauuuuuaaaaaauucuguuccuaaacuuuugcucugcaaaaggucuuguaaaaagagaacagagacaagucagcccaggagaaaauaccauugaccuuugaacaacacagacuugaacucuguggguccacuuacauguggauuuuuuucaaccaaauguggauggaaauauaguguucacaggauaugaaaaccguguauauggagggccagcuuuucauauacacagaaucuacagggcugauuguaggacuuguguaggugcagauuuuuguauccaugaaauccuggaggcacucaccagcauauaccgaggaacaacuguauuugcaaaucccauaucugacagaggaguuguauucagaacaugaaaccaacucucuaaacucaaaaauaagaaaauaaacauuccagcuagaaauuggacaaacaaucugaacagagacuucauccaagaggagauacguaggaccauaagcacaggaaacaauguuuauuguuagccaacagagaaaugcaaaucagagccucagugagguuccacgcagagaccacacacuccuacagccacucggagaccacguggccacuucccagaaaguuaagcaucuguuuccacaggaaccggaaguuguacuucugcucuuguauccuaaagaaaggaaaacuuauguccacacaaaaacuguacacaaguguccaugucaacuuuauuuguagugacccccaaauuggaagcaauucagauguccuuccaaagaugaaagaaaaagcaaacuguggucuauccauacaauggaauacuuaugaaaacagaauaaaaagcagccaacuauugauacacgguacaauuuggauggaucuaaagggcauuagguggaguaaaggaagcuaauccuaaaagauaggauuuuuuuuguauguaacacucuugaaaugacaagcagugauggggaagagauaaggguuaacagagacuggggacagaugacuucguagguguagccugacaggugucuuugugaugagacaguucaguauccugucugggguuuugugcauguaaaucuaaacacauuauaaaauuucauuuuaaaacauaauuuuuaaaaguccauuaaaaauaaaaauacauaagaauuuaaaauguuuguaaaaacuggugacaucaaauaagauagguaguuuaguuagauguauuguaucaaugccagcuuccugguuuugguaacgcaugauuauguagaaaguuaagcugaaugaaggugccugggaacugucacuaauauuuuucuugugaaucuucaauuucaaacuauaaaguuuaaaaaaauuugugccuuuuacauaccaguuuuuuguuguuuuugagacggaguuucacucugucacucaggcuggagugcaguggcgcagucuuggcucauugcaaacuucaucucccggguucaagcgauucuccugccucagccucccaaguagcugggauuauaggcgcacgccaccauguccggcuaauuuucauauuuuugguacagaugggguuucaccauguuggccaggcuggccucaaacuccugaccucaagugauccaccagccucggccucccuaagugccgggauuacaggcgugagccaccacgcccagcccauacccauuuuuaaaaagagaaaauggacaagagagcagggaauggcguuggcuuugcugcugugagucuuggaaaacccauuuccagugcaagugccugcguaggaguacgggggcagcauucuuguaaugaaagugagcccuaaagccaaaaggugauauucccccugaaauuuaggaaagaaaggaaacucuuaggcuggaaaaauguggcugaacuugauacuguucauuugaugguucuuugauuagccucauuaccuaguauuugaacaacauaaaaaauugguuaagaauagccaaagagaaaaugcccgggugagugcuaggcguccauacacauggcagcuuuuaacaacgugcagccaugaaauauggaaaacuuccugacguugaucacaguugaaacuucauacuuucuuaauucagccucuuauugacaguaauauauuuuaacucaagaauguguucauucaguguauauugacuuggcuuguugaaauguucacaguacaugugaacacuggguuuccugucaugaugacuuaagacaggaggacagcagugagugauuccugccagucaaggaacuuucccuggaaccccacuugaaugguaauaaucugcuccuauaauugcuguggaaaaggaaagcccucuggagauuuuacaucuaaucauuuauuuauaaaucuguagauggcagucugcagaagaugugucaggggucaacuuugugcucaaaacaguugccugauguuuacauuucacaguguauuuuuuuaacaguaccuccagcccccaucaucacaaaaggacccuggcuugcugguagcugcuccccacucaucccacagcccagacacuucauuacagaugccucggcagaggcugguccccucuguauuugcugaaauaugcauguuuuuccaucucauuaauucagucuacauacaauuaauuuuugccuauuaauaaaccccuugguguuagcgacagcuaucuaaaccacuucaccuaguguggaaugagcaaguguacuugcaaauuuccaucccuggucugcauuuuuuaguguuguauuuguggguuggagaguuugggugcauaaaucaagcauugugaagaaauauaacugccgaagacucuggguucagacuggcugaugggaaguuugaaauacgaauuaguuccacauuaauuggggauagagggagaugcaggggggccaucccagcacgugguagucagggagggucucuggcuaugggaaaauuugucagccuuguaugugcgugagaccaacuuucuuuuuccacaaauacaaauccucuccaaauuggacacuucucaaaagauaucuuuucuguguguuuucaaaucucauaauuucuuaaacaucuaauaaagucugugaauacacguaagugauuguguaugugguaacuacaccagccaacagcauugaaaggaaaaaggaagaaaacacaaaaaucagaauggagccuugaaguugagaugagcaccaccuagcucauuuagagacauccacaggaaaggagguuccccaagacuuuuguuaugcuccaaagcccugagacagauccaugucacaaggacaccuuucucaugguucaacaucaccagccaggaggaaaugcagaauucuguauaaauguuaggaauucuuagauuucucaccuggauuuguaaaaauugcaguucauggcgagagacauccgggagauccaaaugccauccuccuagaacuugcuggaggaaccagauucuuucuaagcgauuugcaucuugaugugaugcuacaguucuaugacaggcccgaguagcugaugaaauucuacgugggaaaagcuuuugagugccuguccugguaaaccugugacaguggcaucacauaaagguuuccagaauguucugugaggagauugagccaaugucguuggucagcuuaauuggaagcaggugauugaaagucagauaaacaugcaagauuugcugauuuuuaaauaugccauaugugucaaauguaugaauugugaugauggacaagaacacuuucgcagcuuuaaugggagcauguaaugacuugaacaagacugcuuaguuuugguuacugaugaucaaguacagaaucuugcuggugucuccaaaacuuccugccuggccugggcagcuguccuggcucccucuggccaguucucugccaggcagccagugugaaucuggaaggggcuaguccugucuuccccucccugucuagugccuuuaacgucuccgcugagccugccaccuccuggccuccucgacccuccaccuccccgagccguggaggugaguccuagaccuucuucugugggcuccucuccccggggcccuuucggcucagccccacuucucuuauucacccacuuguguucucuguagcuaaaugauacauaacaggaacucguuaaguagcuugugcagugaaugaguuaauccuagguguuuucagaacagugaauuucagguuccugacuccgcuuugagcucauucaaagaaagucauguaaauaagaccuaaucauugcaagaagucuaaugaagaaaccauucauuaucucuggagaugggcagguacaccucacagaaagugaagucuguugcugaugaauagucugcaugcccacaucuuccucuggguuucuaaguaauugaauaagaaacguuucuauuuauauucuuauuuaugugcaacuguauuuaauuauucccuaguuuugaggauuggccaauaaaccuuuucuucccuuuugccauugauuauucuuaaguuuaagacaaugcccaguggcagaugugcuuaaccgccauccuucaucuaguucaugugacuuuuuaaugucaauuauaaagaaaauuacuccuuuggcuucagaaguuuauuuaaaucucuucugagaaaauuggcagcucuucggaguuaauguccagagcagcagaaacagaaacuggagggcacagacugguggauaugugaacagaagcacuuuuuuuaaacaaaguuaaaaaaaaaauguuaugcuauugcuaauaaauugagucaggggaaagaaaaaaaaaagagaucccuaaaucagcuuccaagcugccauuaagaugggcaaguaagauaauuccacauaaauaagaccagaggccuugucucuguuuuuauuuauguauuuauuuuauuauuuuuuugagacagagucucgcuuuguugcccaggcuggaguacaguggugugaucuccucucacugcaaccucugccucccggguucaagggauuccccuaccuuagccucccaaguagcuaggauuacaggcgcccaccaccacauccgacuaauuuuuguauuuuugguagaaaugggguuuucugcugcucucaaacuccugaccucaagugauccacccaccugggccucccaaagugcugggauuauagacaugugccaccgugcccggccugccagggcuguuuuuaaaugaggauuucuccauuuaaggaggucaccuguccuggacgguauuuccuaaaugccuggcauaggugacaucaugcgaacaagugaugguucagaauacagaagucaugaguuugaaggcugugauagaggaaggccgggagagaagugagaacagaacgugcuugcccugggccugcagcuguugccagcaucuucugucagcugaucugggcagggcguggggguucuucucaggccuaccuccuaagaacaaaaacaugacugaccacgagccuguccucaggaugcagccuccauccuuggugggcacagcugagagaggaaguucugagcugcuuugggguagggcucuguugcacucacccucccaucuccuuagucgcugcaacccugugucacaaauaguagguucucagcaagugugcugaaccaagggguaagaacaacguuuuuauuuuuuuauuuaauuuauuuuuauuuuuuguuuuuacauuuauuuuuuaauccauuuggaauuuuucuuuuugagauauauauaauagggaugaacuuuuauuucauuuuucuagacagguguacaguuaccuuagguacauauauugaauuguuaugucucaccaaugcaccacaacguagcagucucucauagcccgacguaucacccaaaguucuuugucucacgaccaagaaaguuaaggagcgccgacgccaaggguaucacuggacugaaaauuuaauaagcaaaagaagaaagcucucuggugcacaggggggacccagaagaggguugcuguuuuuacaguugaaugcaaaggcuuuuauaggaaacugaugagagcugggcaucuuauuugcauacggugcaaaucugugguagcuccaccccguccuccuagugcacacguaggcccuuagcuugaguuacuccauauugcuuuguuucccuuacugugcaugugucaggggacaaaauuuuucauugugggcaugucugggaaacucacauguguagcccuuuuuuuuuuuuuuuauacuuuaaguucuaggguacaugugcacaacgugcagguuuguuacguauguauacaugugccauguuggugugcugcacccauuaacucaucacuuacauuagguauaucuccuaaugcuaucccucccccagccccccaccccacaacaggcccuggugugugauguuccccuuccuguguccaaguguucucauuguucaguucccaccuaugagugagaacacaugguguuugguuuucuguccuugcaauaguuugcugagaaugaugguuuccagcuucauccaugucccuauaaaagacaugaacucaucauuuuuuauggcugcauaguauuccaugguguauaugugccacauuuucuuaauccagucuaucauggauggacauuuggcuuggucuuugcuauugugaauagugccacaguaaacauacgugugcaugugccuuuauagcagcaugauuuauaauccuugggguauauguccaguaauggguuggcugggccaaaugguauuucuaguucuagauccuugaggaaucgccacacugacuuccacaaugguugaacuaguuuacagucccaccaacaguauuaaaguguuccuauuucuccacauccucuccagcaccuguuguuuccuggcuuuuuaaugaucgccauucuaacuggugugagaugguaucucauugugguuuugauuugcauuucucugauggccagugauggugagcauuuuuucaugugucuguuggcugcguaaaugucuucuuuugagaagucucuguucauauccuucacccacuuuuugaugguguuguuugauuuuuuucuuguaaauguguuuaaauucuuuguagauccuggauauuagcccuuugucagauggguagauugcaaaaauuuucucccauucuguaggucgccuguucccucugaugguaguuuauuuugaugugcagaagcucuuuaguuuaaagacuucaugucuaaaacaccaaaagcaauggcaacaaaagccaaaauugacaaaugguaucuaauuaaacuaaagaacaacguuuuuauucuguaucaucaaggagggaacccagcacgccucuauccuuuuaagagacacggcaagcaucagaccugagggacaucaucauuuccuugcagcucagaaugcacuuaagugucauguaguggguuuucuguuuauggguuuguuuuuuuuuuagaaaauguguucuuuucuaucuuuuguuuguuuuugagacagggucucgcugugucacccaggcuggauggaguacaguggcaagaucucagcucacugcaaccucagccuccuggguagcugagacuacaggugugcaccaccacgcccagcuaauuuuuguauuuuuuguagagaugggguuuagccacuuugcccagguuugucucaaauuccuggacucaaguuguccaccugccccagccuccaaagugcugggauuacaggugugugccacugcgcccagcccaacccuguccuuuguuucuuacaauauucaacagucagucacuucuagcuuucacuuugucccauaaaaauauuucauugaaaauugcaagccauggcaguuugcaguguuucuaagcugaggaguucagcuccacacccaacagagcuccagcuucugguuugauucuuagagauaggagugacuuuuuucaaucauguacaucauaauuaggaggaaggcauucagucuugaacauggggacaaaaaagugcuggagauaguagcuugagaguugcaaauauuuauuuugauucugacuuuaauucuuaaaaauguuugucaagaagacaguggugugauggagcagguccuucgguuaccacaagcacacacccuuucucuguagucuuauagcuuguuuucuuggucgauugugccagcucuuauaaaaauauuaugcucccaggcaaagggccauuucuguuggaauuguugagaagauucuuggcuuaacucuugauccaacucugaucagcuuggccaagacuagacuugacaaguuugcucugaauugccucaugcugcugugugggguuucaaaucauuggcuucccagugcuuucugggcuagaccaacaaaacaaugccugggaaaagagagaugauaggccgugauaaaacuaaaacugcguaauacuggaauuaacugaguuggccauguagauggcaagauauuaaaauugaguccuugugugccaaagucguaaacucauucagauaggcccuaggucugugaauguuuguuguugaauccuaggcucuggguggaaccgaaagcugaaaaacaugaaauucccccucuguccuuuggaucuuauucagacagucauuuccuagcuauuucaaguuuugaucaaaacagacacgcaguagaagcccagucuaaaacaucgguaguuuauaucacauauuuacuuccaugugucuuaagugguuaaguuguagaauuaugucuuuuagagaauggaugaagaagucuaggaguacaauaggcaagagaauauagcaaaguaguuauauuuugucaauuuuaaaguaaauucugaaucauuuuaaguauauucaguaacacccguuugcccccaccuuccuuccuuugagguuuucacuuauucacucauuaauaauucaucagucuuugcuguuuguggcaugaguauguacaaaaggcacugcggcguccauugcugugaguaauauagagauguccaaagguguggcuuuaccuguggaaaccacaggaccauacccagagcauuuggaggugccauaugcugcuuaaggguggcacauggaggggaggcugggcugcacgcaugcugguccugaggugacccucuggccgcaggagagcuggaaaggugccagccgugggugccaugcacuugucugaggccaggauggggagaccacauuccagguacagggauaagaggaggaaagucccaggagugggaaggccugggggaaaaggggagaaggucagggggaggcaaguuggccagaucggcuggagcuugggauucagccaggacagagccugagccccaggccagacugcagggcugugcccagcacuggaugcagaguuuggaucugauucugaguauguggugaugacucggggaggcuugugagcaggauggugacaaccaggcaggauuuuaggaagguuugucugguuuuggcagguucucuggaugugacuggagugugaagaggccaguuuagaggcucuggagguuguucagaaguggcaacaaaagggaauggaaauaagagauguugcaaagcagaaaccaacugacauggagugcgggagaacuugaaggcagcagugggaacugggagcuguucccggcguggggagaaggcugacguugauguugccuaaggaguuagaggugaugaccagguuccagguggcugaucuggauaggcagcugcauggggcaggagccccaguguggcacagcugugucuguccccugccgguccucagaaagugacaccuaacacugucccaguccacacagagccuuguccaguagucagggugaggugaguggaagcaagaagaggagcuggcaacaggacuugggagaggcggagagcacagcaggcagcugggcccagacgucagccccaggcaguguccugaagcagcgugugcaccugggcagugcaggcaucgcgaguaagaagaggguguuagcucggauaacuggggcuccugagcagccuucaagaggacagguuccuuggggcuguggguuucaaauaacaucauggaggagggagcagagaggcuugaaaauaaacggcgguggccggggggagcacaaagaagccaggccuggcaguggcacaggugucagggguuucaugaaggaggggcccgggagugugccugccacauggacacuggagcgaaggugcacccugaggcagcccacagugaggaauucaaacgcagcuuccugggcuggauccugcagggccugaguucucuguuccaggggcaucuucaucugaggauuugggguguccgugcccucuccugguugaaaguguuagaagccacguuggagaggccaccacucaggugcuaaaguuaaagcucuagaguuuggugccugccacuuagcugcauggccuugggaguuauucacuccucugcacuuugguuuucucguuaaucaaacuggaauccagauacucaccuccuaccuuguuaugggaacuagacgugggcggugcacgugggggcaccgagcacagugcccagcacccagugggugcucaggggauggcagcugccaugauuuuugggacugaaugcuuugauaccacccaaauauauggucugaggugguuguaaauagaauuagcagaggagaugauacagacucagaguugaauuaggguuugaagaagggcuuaggucuggagcguuacaggugggaggaccagcagagaguggucaggaaucaggaaugacaggacacaccuggggagccugagcggcggcuuccaggcagggaagaaaagcucggggcaguaugaguccagaccaggggccuaucaggcgccuucuaugcagggucaggugguaaagaauuaucucagccuuagugggcuagaagaucucugucauagcuauucagcuccguugcuuucugaguaaacaaaugggcguggcuguguuccaaugaaacuuuauuuacaaaaacagauggugggccaguuugguauguggaggcauguugacuauggacaccuugaaaaucccauguggcaacagauaugagccaaguggugacguggaaugccccaucguugagggauggggacgcaagggcagcgaggagguccuguggguccggguguggcgugggcccagcguggccauggcaucuggggccucagcugcaggguugcaguggaaggaaggggaaagaagcucagagugcauucugagggucaaacuggccuguaagugacaaacugaggucacuucacauguacauggagggagacaggcugucuuuggagcaguguccaugcaagccugccuggagggagcugccacccucagcugcagccccagaccucgcgguugcucucauccgucguucccagugugggcagugacgcagcaccacgguaaguucuguagaguggacgccacucgcuggcaaagcccagcagggcaaggaauaagugucacucagucuuuauccagaaaaauccaccaauguacuuuuagugcaguauuaacacaugguagaaaauggaauugccuagaggauuuuaaucucugauggauuauucuuguaccuguaccugucugauggucguguaaguccauguuaacaaaccugggaccacaggaaaggagaacugaugcgaauacaaacagguggaggauuuccaggcgucaguggggucugggagacuuuuccaagaaguguuuucauugcaguuaacauuuuuaaagaugaauaucucacuauuauaaaggucaaugccacuucuguaauauuaauuugcaauugaaagguauuuucuuuuaagaaguccccuuuuucaaguuucucaaacuggaauuuucuugagcaucuaagaauccuuuccuuucaaaagauccccaaguuaccccggucuaagcuaagaaggguucagcguuggccggaagcauaacucuagcucuccaaggccuugggcugcggcaggguuugcauguccaggcaguagguggaggcuucucuuggucagugugucugcucagggggaggccuggcuggggaagcggguagcaguuugggaccagagcuuaaaagagaaggagagaccggugcgguggcucaggccuauaaucccagcacuuugggaggauggggcagguagaucacaaggucgggaguucgagaccagacugaccaacauggugaaaccccaucuuuacuaaagauacaaaaauuagcagggugugguggcgcacgccuauaauaccagcuacucaggaggcugaggcaggagaaucacuugaacccgagagguggagguugcagugagccgacaucaugccgcugcacugcagcgugggcgacagagugagauuccaucuaaaaagaaaaaaaaaaaaagugagacuuugaaagugaugacaguuuccacaguucccaugggcagguggcucagaaugagguggccugaggcccacagucuguccuuggggacuggguggcccccacguccaggcagcagggagaggacgugcuggcugccaagauggggugggagaagcccagggcaucaagugccacggaaauaaagcugguugccuuaguugaauggcgccuuugaguucccagaagcucuucucagcgggaggcucccugucuuucaccucugcucuucugagguaccaguugaaggguuuggggggugaaaucaaggcauagggcuccuggcaacacuaccccuggcuccgggguuugcaugccggggcuucuuccuuguccuggcugucagagaacaccuggaaauaaaugcugcauuguuuugcuggaaaauccugacaccaccuccugccuuccccugggagggcugagaccuggccuaggcauggagcuuacgguccacagaccugccugccugcagcaugacagccucccagagggcuguauugauuuuugaagaggaggaaaaaggcauacaaaauuggacuugccagccuucuuugaguagaaauuggugcuuccuaaagggaaucuuaauuggcuagcuucgaagcuaaaauguuuucucccccuucccuucucagaacucuccagccccccuguuuguucuugugagacuuuuccaagccccaguuacuuuucuuuccugcuuuggaacauaauuggauucuucgcuggguagaguuuugcuuggaagaccugaggguguagcugaaccaaguuugagcacccuggaaggaagacagaagaugccgggagaccagccagcucaaaggagaaagggagggggacagcaucugaacucuggccuccagcaugauuucauccuuuaaacugaaaacccugaguuucagugccagcgacgacacuuguugaaaaaguacaaauguuuucugcuucuuguaaucuacuucuugcaaauauuaguacucuggaaaaaagauuuauuuuaauaaugugaguuucagauuuuuuucuguaguuaacguuguuuuauuacucuauauccuugccagaaagcguguuuuaagaguuucaauucaaaauuaaauaugaccucaguguuuuaaaauacaauuauauuaacuguccauuuaauaguugcugaggauuuuuuuggccacugauggauagucaagauacuugucugagauuaaaugcaguauucucaacucugcuaaccagcuaacuuguuccagcugcagcaaucaacaggaaaaacaagggcuuucuaugaagugagcuggagaaaguuguucccggauaaaauugcaguacuauucuauaagcugugcuuuucuuuuaaaaacuccacuguguuucauaauagggaacuaucuauuauuuauuuagaacuguacaaaccaauuuacaagacagguaauuuagugacagaauuauuuauuaaugagcccaaguauacaaguuaaugggaccgagccccguggaggucaauccucauauaauccaugccuuuuggaaagaaaaguauugucuucagaacauuuaguuaugauuguuaaauuuaaauuacgauauauucucuugcuaagacaaaaaauaauuuuuucugaauugcaugaugacagaguuagucuguaagcuguguggagaugaauugugucaauuagggguagguacaucuuagcccuguugguaccaaaaguauuauuucucauugcaugggcucacaggagaaagcaagccuguucuuuaauagagacgacaaaucagaaaccgcugccugccugggagauggaacagucgugcaggcgaggagcucagagggcgggcguggcuucccaagcucuggcacagccugcaggccuuaucaggugcucugcuucugggguacucggcacuuugcucuuccgguggaugggggaggggcgggcuguuccaugugacagcaugugggcuugucaugauucggggugaccacuggcuuccauuucccaggaguggcuuuguccucgcggucuuacgguauguuuccaguagaugagaaggcaugccuacagacagggccugcuggugucugcugugugucauggggggaggcaagguuuuccucacugggaccucuucacucccccuuuauuaaugacccccuggcuccuccccagaggcccagaagccuagaggagaaaugaggguacagcauagaugccuuaguguaacgaguggggcugcuggaacucaacagacuauuuacaguuacagcaugaagguggugcuugaaggauuugcugcuucguuucauuuuucucauuucaucucaucaugaagucgauugcauuauaucaggggguggggaauggaacagacacagaggagaacccaccaaguucugugucuucaaaccugcagcauuuccagguuccgacugcagaguccuaucaaaguaagcaaaauuggaagugaugcccauuuccugggcuuucacaaacuuuguuauucugcagucuaccacaaaaucugaaaaggcagagaaauguagcuuucacuguuuagaaaaucuuugugaguuuuucuucccccuagggaaugguuuucagcacauuauucauuggaaaaaugaaaucugaaauguagguguauuuucagugcacgugcuccggaggagccucagcacccuugugucuugucuacccauucgcucagugggcagggauugagcacugggaaugugcugggucggagccgagggcuggaggcagaguugggaccagccccaggauggugccuggcuguuugucccagggcucacuggaacagcccuccugggcagcccuugguuggacuucuuuacgcagcccaguccacaccucaccugugcauucgucaagccauugagugcaguguuguggccugaaucacuccaggccuugcuuuggaggguugacaguaggggacacggcaggccgggggcauucugggacccaggucuccugccuauguggaauacugauguguguuguguggacaggucacugauguguuuaaauguaaaucugaccuuccuuuaagagcaauugggcagcagucugggagcuugagacuguaugauguggacaccuaguaucucuuucuggaagcuucuaguguauaauagaaaguagguugguuacucauucccauugucuuugaauaauggggcagugggccuggauuguuguccuguggauuggggaagagaucauagagaucauagaaguaaccuuagaguaaaagaaaguaaaucaaaaugcuauucuauguagaauauaugccaucaagggcagagcaugugggcguguggacuugucaugaugaggagugaccacuggcuuccauuucaaagaggagagcuggagugcuucuauuccacggagaugccccagacuaaggucuuuggagucaggcuuucauuccauuccugggucugucccuuaugcguuugguaaguuguuauuacauaaccuccggaccucaguuuccuguuuuagaaauagagauaaugguaccucccccaagggucuuugggaggaauaaauagaacagcuuauaauggaaugccuggcacauguuaggcacucaguaaauagcagcugugcaguguugugcgagagcuuacaucgagcuguuuucccagagugcauugauccucaaccguguucauguaccccugcccaaggugccauauuguguaauggagaugugacgucgaggcgccauguugccuggaacuucuggagucagccaccuugccuguggcugaccuuggcuguguuccugagagagugaggaugugaaauugcaugacacaaagucggucaucuugugcccgucucaucuacucucacuggugguucaguucuucucugccccuaaauucuuacaucccagagcagguucuugguugagacacaggugcuugccucagguuuccuuggaaaacuccaguggcaccaagcggucaguagccuguagcggccacuugcacuguuguccccuuuuguggacguggacguugacucuccaugucuggucugugcaggaaagagugaguccucucuuucucacuccagagccugcagggguacccacccucagccgggcagggcaagccaggacagaggcuuugagggcaucugaggaggaaacugcaaggugugcaguuuggcccagcagagagagaccagaaugcagaggguacucagggcaggcgguugcuacucugggcugugugcgucauagcguuugcaugacagacaccagcgguugaccagaugccccauuugaagcccauguccaggcaugcaguguugaucucuguguauagaucgacguggcuucuucucuagggcuggggaagagaacuguuuaauaaugcacaguugccuagccucaaagauccuuugagaaauagcuacucugugcaaguuuucaacaauuuguuuagacuaauggaaugacucuuuaaaaguuuauaucuuuacagauauacaagcacuuuauuucuaagcaacuaauuuaagcugggaaagaagaacgugcccucauguguguguaaaacguuagaaagcagcucuguucacugccguggugguggaaggcaugugcaacacagacauaaggcuauuugaacucuuuauuugccacauuuacaauauuaauaauagcguuucuagaaguugucacaucaaguaaaagaucuucauuccaggcugucuuuaggggccaaauugagacuggaugcaugcauuuaauaaauuguagucucacguagucauuuuuguaaauaauuaguuucagugaaagaauaaguuagcauauuguaugcaucuaauguugcaaauguacauacagcaaacuuugcuauuaaucaacagucaggcaccgcaaguggggucucauacauaaugaauugugcuuaagccucaugggcuucuugauagaaaaauaaaagaaaacacaagugcaguaagcuuuugaauaaaauuuaacuagauugcucugcauccuguaauuguuuuggaaucuuuagggaccugaucauucaucuauaguuuugggguguuuuuaucuucaucugucaaauaguagagacuuuuaaugauauguuaaaauguugauaaaauacaauuuuccuuuuaaugauuugaacauuuggaggggggagguaaauaggcuuuuuaaggcuuucugaucugccaaguauacuauuuggguugucuuuuaaaaauauuuucauuauuuccuguauuuuuaagaaucaauuauuuuuaaaaagaaaaauauauauaguccuuauggggaagaguugaaaauuuacauaaaguguucucuguauuuuugguggguguuuuaaaauacuaugguaaauaccuuugcaguuuuguuuaggaucugacauuaauuugagccccagauauugagggcauagcgugccgguuaaaaaucgguauccaguuuuagcaagauaccuacgaccacccagaaaguaacuuggaaccuaacuuaauuuuaaauggccucuuucuccucuucacauuauugacauuaguacaugaacccguugguggccuauaauaggaucauaaacauaggauucauuuugggaugggguugaaggcauaaaagcaaggagugagauuuauguccaccuuuauuaugaaccacacaguaaaagugcaguaaagaucugcugacuugacagccagagcuccucacagcccuccugcaagcacucauggaacccguccuucuccaggaagaccuccuguuuacuucugcgcuaggaaugggcugugcucaucacuuacuucccugucuuauaugauguccuuuuguacagaaugcaucuuuaaaauaggcccuacaacuaaacacauaacagucaaucaguagacucaccugugauaagugggaggcccucuuguaccagaaaguuuuaaaaaaaaaauacauuacucauaccugucauuguuuguuacguaaacuuaagcauauuuuugauguuuugugcguguuuauucacuucuuccuuucauaguugaacacaucuuguucuugagguugcguuggaaaucaguaggguggcgcaugaaucacugagaacagcccacgguguguggucagugccaucgucaucaucgucaucagcaacggcagcucaagaccagcaaggccgcgguugugucugucaugagcccguuggcaugccguuuguuuuuuaucuuugccacaguugcacuguugagauccauguuuccuauuacuaacaucagcacuuuuaauuuuccguuucuacucaguuuccuaaaagaacuauagaauauucaaauaauugcaugcgcuuugucaaacguacauggucauagugcccaaacaguugcuggccaccacgcagagccacggagcagucacugccauguuccuucgcagccuccucggggccuccaugaaacaucggggccaauggaaggcggaagugcuguuucugauguugaccuguguguuugacccucaccuucccuuccugcgcagucggcugucaacuccagaggaagggacagcccugagucaguauucucaccacuaaccgcaugcauuucagauccucaguaaaugauugaaugaaauuaagccacugcauuugucugaaauacagagucaaaagguuuuauucagccuccuguuuaaaauaaaaugaucuuuauuaagagcagguagcauaguuuauuucuuuucuucagucuuaccccugaaagaaaacaucugagcuuuagcaggaaguuauaauuaaaugcaggacaaauccaucaaacacaagacacucugcuagagaucucuaaaugggacauaauugugcauuuaccagugauauuuagcaagagucuccaugcagcguggauaaucuuuggcugaaggcauguuccuuccuacaugagccccggagucugcugcucugcccuucagucccgaagccucuccuggcccuccacaccagguucuggaagccagaggagguggggugcucacuagcuggguuuggaaaauguugcucaucaccugagcaucugaagugcuguguguggcgaggccacuaaaagcuuuucagauccccaccaguuuccgugcaaccuccuucacagccucauggaagccuugcguccaagcucggcaccuugccagauuccagaggaacucagaggagcaccugucuuuggaacgaacucuuuccuugggugacccuccaggguggucagguagcauucccagaccauaagaugaaaacgucguccauggagagagagaggagguguucgggucacaggagaggcagaggguacacagcacuccccaucuggagugucccacggucagcccgauggugccucagaugugaguaacuuaugaaggacucuuggccgauuuucuuaaaucaaacaggauucaagccaaguacaucguguguuaaugucucuggggaguagaauucauucagaaauggacauuuagugauucucuacugccaguggaaucuuaaggcacccaaaaaucugaauacccaaaucucccagcuggcuggucaaguuuuagaauguugagcacucuaaacugggaagagccugguagccgugguaccaggaacacucacucuuccugcuugcugcuuuccucaugcugagcugggcugagaucaagacuccuggggcacuugcuuccucuacccuuugucuguggccaggugggauucccacacagucaaaggaagcccguguccaacaggggccauuucccuuaaauuucucucaucacccccagcucugcugugccucaggugggccgcugccacucuuccuucacguucuugauaauaucagugucuugaaaggaagcuucuugcagguagggaggacgcuuuucccuggaauagcugcugugcucauaugaguuugugcuggaacauucuaaccaccuuucugugcccugguuuggguugaagggaaggcgauuuaaaucaaaauaaaucugcaaggcaguucaucacugggacauuguuuuuccaagccggggaaggcgaauggguuagggcagcuucccacagacggcaacuccgggagaauaucaccggggccuuccagucugccgcagccccgggagcuucuacccagggcaggucaguguuguccgguuugauuuuaaggaaccccuggcauugccaacaguuguguuuuucuuaaagaaauccuugagccagguccacauggcucuagcuuugcuguguuaaggugcccgacgcccuguugucacauguacacacgcccagcaaagcugggcugcuucacccaccagccaccauccucucgugccaagucaaagaaagugaaagccaccagugucaugauauuugccucgggauuauucugugggugacacgugauguccuaggagaggccuaggggaggugcgacucugaugggcucugaguguuuccccaccaaugcugggagagggucuugucuccugcuggguucaagggaugggauaggaaggggcugaggugccaggcaaaagucuugucuccugcaggguuugagggaugggacaggaaggggcugagguaccaggugagggucuugucuccugcacuggcuccugcuggcaucaugagcuggcauccguggcagcccccggagcugcaggauuugggcuuccgagcaaaggugcucccccggcaaggauggggcggaccacagggccggcauuucaguggugggugaguugcagggccccuggggaagacugggacguggcauuuccaugagcgugggcuacggagcccguaauuguuaguguuucaggguuugccaguggggaagcuugaggaacucccccgugauaagcgccgccgugagagaggccaucaccccagcucuucuuccagggccgagcgcggcagggaaggaggagagggcagggcaggagaauaaauuucauuuuacuguagaaauggaaauuugugucauggcuuuaaaaaucugguuuuauguguguguuuaaugccauucauuuuaaauguaguaucauaaaucauugcuucagaaucaaagcuguuuaauuacauuucacccaugaauaguuaucuaaugccaauagagaaagaguuaaaaaggagaacuacagaguaaaucagagguugagaucuucagcacaagcauaaaaaaucaauuuaagaugaauuuuacuacuauaaaaauucuucaaauaucccuuuaagagugggaacugcuaggaaagccagcucacauuucaauucccucagcagcaugagagaaggacgcccgcgugggcagaggcuuggugugcaccccguuuugcucaggggugaugaaggaauccuaacucuggagucugagcaguugcugggggcacagaaccucccagcucucgugguagaaugcccccucucccacaguguacccucgcuucccugagaaaccccaucugcggggugugauggccagccagaccccgcuaguccugaagacuaacccugaccuugaggugcaugccucgccaaccaaucccacaucccagucuuacccggggaccguacaacucacccaccacugaaacggcagccccugugcuccacuccauccucgccgggggggcaccuuugcuucggagcccaaauccugcagccccaggugccaccacggacgccagcucaugacaccagcagagguagugcaggagacaagacccucacccagcgccucagccccuuccugucccaucccucgaacccugaaggagaugucagcugagcucuugcugcaggaggugccaggcccagguggcuugaucagggguuuuguuuccucaguugaaggucggggcacaugggccccaucacgcuugcucuuccugucugggcaguggugguugacagcagccagcucugcaucacucaggagggagccggggcuaacccucacugcacagggcuuccaccccucuguucggccgccuuccccagggaucaggacagcaaaguacauuacauauuucuccaucguucuucuuagauagcaucaguacacuguuuauucgguuagcaaagagcagagcaagaauugaaugacugaaggugugucucugaaauugaauaauauuuaagccaagcagaaguucuccuuuccguggccagaccucacuaacggggaaggaaauugggcagugaaaagacagcacucccaugcccuaaggaaacucugagagaggccacuucguugccugcucggcaggcccauucucugccugcagagugagcccggcuucccccagggccucuuugugacgggaccgacaaggguuuccaggcaguggcuugggcuguggagaccucagccuguguauuaaggguacugggcugaaugagggcacugucugcgugaguucccuugggcagggaucuggguaaggcggcaguuuggagaagaccggggcauguucugucuggccgcaguguccacggggucagcguaauuuagccggcucugcugggcuugguucacagguccgacugcuggucacaguuauccguggcugucggucauccuagugagcuuccuucuuuuucccuucauucucuggcuccuuccuuaaaaccgucaggauuugugugcuuggaaaccucugaccacccuccugcuccaccgugaaaaacaguguaugggggccccuaugugcaucucacccaaaaagguccauuuuuagaaagacccgaggaucucggcagagacuuuuacacccacaaaaugcuccagcccagagacccagccuccagcacaggacagcgugugagacuggcccgaggucuuccgucgccgccccugcugucggaugacaugcacauuucugcaccugcaggaccucaaagcgaaguaacccuggacacacccuucacugggucucuuucccccacaucucccccaacaauggaaggcaagcaccgcuccacacgaaaauaacaacacgggugcaguucugugccucuccuuagcuucucccugccgccccgugggcuuggucauggugucaccacgcacuguagaugucgcagacgcaggcccauggccgugugugccccugggcaugucugcugucuucuggggaaauggaaacgccaccauaggcauuuacucaggcagaagcuccagaacuuuagaucccagcuuugccguuuuuaauugucucuuguuaaaaugugaguaucccagauggaaugcaaaagagguucgugcugcugaggcccugguuucuuuucugaauggaugugccaggguauuuccgcccacaguacacuuuaagccaaaguaauuuguaucaucuuuaacacaaacccaaaacacgaaaggcuguguuuguuuaacuagacguguaagcuauaguuaucuuuauuuccgcuuuaacugcauaagagaggaaaccuuuuuaacuauaaggaagguguucggcuuccuuuuaucucuugccucauuauguacuuuugacuuuauucagauuuguacaagcuugguuuuuaccucacaggaaaagcgagaacuaaucgcuccagagaucaucugagcucuuugugugaagguguuuuaagaaguugugacuacaucuucuuuucuaaaacagccuccaauucugugauacaaagugaaaugccaguuguuugcagcuccggggcugugguccuccuggacaccagcgguagcaacaggccccauccacacagggcuggggagacagguccccuucugcacggggcccaggagacaggcccucauucauacaaggccagggagaccagcagaaucagcacggggccagggcaacagccccauccacacagggccgggcagacaggcugaauccgcacagagcugggguuggagcugagagucaucccugaccccagcuucaugguccuccagcucuucccugcaccauugccauguucuuacugcugcagcccugcgucagggcagcugcggugccuucugccucuugccaggggcccccagcccccaccagucacacugugggccgcacucauaggacaaagugcccuucccgcccugacacgcacaguccuugcccaccuuucugugagucucaguccccgaggccuccacucugcgucuacguucacacugucuguccuacguccgggauggcucuguugccuccucuccauggacuggccgugcauaccuuguguggacagaguugggacggugcucccggcugcaucggccgccugugcugggccacauguccaggcaagugaagccuucacugggacccucccagagcagcaugggugugucgaggagaaacauucuguagaucucagcgcacgccccccaaggcagcccaggaaggaagggugaagggcccgcgggagcugugcguccacagcauccacagugcagugacguuucccaccuuuucacagaagccugaggagcagcacugucugcagaaggaaacuagaaaacuuccgugcuccaagccugggaagucccggggaagcaugccguuugucuggggccucgagaggcagggaaggaaggaagggagucaccugaagaaaucggacccagggccagggcuucccacggggguccacagcacuugaaaucacaacgggaugugucaugcacuccacagccccagguggcagcgggagaccuccccuucagggccauguccucaguccguggaacacagccccagaaaauccaccccugcuggagauggggaauccuuuccaugagggcccaccaggucgaagccacagaugaaugaacaccccaaacagaagcagccacaaaacagucugaagcgacucccagagguacagguucaaacugcaggaaaucaaagggaggagaguguccagaaagaaccaagagggccgcgcaguagcucacaccuuuaaucccagcaguuuggggggcccacgcgggcggaucaccugaggucaggaguucgagaccagccuggccaacgugaugaagccaacauggagaaaccccaucucuacuaaagauacaaaaaguuagcuggccgugguggcagucgccuguaaucccagcuacuagggaagaugaggcagaagaaucacuugaacccgggauauggagguugcagugagccaagaucgagccauuguacuccagccacggcaacaagagcaaaacuccgucucaaaacaaacaaacaaacaccaggaagguuugagaaagaaccaaguagacacaggcacacgaggcacagggcugcccccgagaggacagacucaccgaugaaggaaacacagaguaggcccucuggagcgugggaaucaggggacugcagguaaacccugaggaauccccugaacacagcacacggccauggaggaggcagaacgcguggauguggccuugcguuguuggacucgggguggggugggccguguggugcagucuaaugacugugucgauauuucugggaacuguuuucaauagugagugcuugaugauuuaggugcagccgugccaucuguaagucuuacaaagggacacugucacuuggguugccuugcgcugugaugcagacucucagaacacacguccugggaggccugaagguggagagugguugcggggccucggugcguccuugccucaccagucccccuuucugcugcacagcuaguugagacgugugugcccaugaagcagccacagguguuugcccguuuagaugcaguagguguuugcuuuuccgauguguggaggcagggcccagagguuuacuaagccccuguucucacuuuugcagugccguggaggucccagcccccgcugcgguucucggagguccggagccccugaugcagugcacagccuggcugaaugccuauuuccaccagcccgaggcuaucgaagaguuccccgugccggcucuucaccaucccguuuuccagcaaggucgguaacuaagccaucugcgguguuuccuuuggggagcuugacuuauuaacgaucgcugacaucacaguucauuuuauugaguauaccaacuugguauuuuuacaucagcuaaacagaggcagcguuuggccgagcuggagggacggggguucgccgccuccacccacuccaacacuuguguuaguuuuggcacaggguugcauaauucuuggcaaaggcaauaaaaaugaagcaugcagaucgacucuugacucucgcuggcugaaagguuuaaauaggaacacaucugaauggcaguaaauuuuucaauaagcuuauugugaacuucaacuaucugcuugccaacagcacagaaaacgagacuugugcguggacauuuagcuauuuccauacacucuguuggugacacuuacaucauagcagguagcagcauuggagcuucucaaauaauuuuacauuuaauuucucaaacguaccagaguuagacauauucuuucuuaagagaugacuugagaacuuaccuguauguagccugcuuaaggcuugugauaaucuaaaacauuucccagacauuucuuuuaaagcuuguguuuggcucugcucaauacagaaauuaauuacagcaacuaaaaucauuccagacacaugccagaaauuuauuuugcauagugaguuuuucauaaucauuuuuguguauaaaugaacauauauucauauaugauguauauauggaguuguacacuuauauauccuuaaagggaaaaauuaccuugagauuuuagauguggugaauuuaaagcaauuuugaauuucagaucagauuugcuggguaagcuuaacaguauucuaauugcugcggugcuucucagcacaaaacaaacuugaaaauggagagaacuuuucaagggaagcagguaaagaaaccccugaagguugggcuaauaccugaguucacuaaccaagucagacaggcgaacauaugaagucaugagcacguuuugugcauaaugaacugaagcugugcagcuauaaugaaccaggcaccuugcuguccucugaaucauacagaacugucuccagaaggguucaguggggaucucuaggaugggcagauaggaagcuagagugggugggccuuuacauggaaccacaaacguccaagaaaccucucaucaucucugcccaccaaugggcugcugccaggacaaaggcacuaccaaagccuccugggcugccgccagcugggggccaccucuccccagcgccacaagccagugagccaauuagacggugugggggaccuugcucacugugcaccugaugggccgggcacagggcaggauguugcugaauggcccaaggaagucagagauugguuuuguuuauuaaaguuggggcuuggggaucuuagaguggugaacucuucucuauacgaucucuuuuuggggguucgccugccaggaggagcaaggcugaagagcuguccagaggcuuuucuucuccuuaagccugugaaauaugugagcugaaauguaaggucucaggacagaaaaguucucuuacaaaaccagggcaggagguaucugcauaaucauauggaggcugggagaaugagccugcaaaccccugaaguuuaccuaagguuuguugggcaacuucaugaaaaacauaggggcaaaaguuccaugaaaaucguuaguuuucuccaagucauaugguggcccuggccauggagcuagacccugcuggccuggucucaccaggguccagagaguggugugcucucaggcaggccaggaagaaccggaggaggaggccuccgcagcugcugacaggagcuccagggcaggaguggccagcaaggaagguggcaccggaaauaaucagacacucuccaaaccaccccugcaagcacugaacccccgcugagccuuuucccccucacuucugcccauggcaguguuugcugcuccuagagccgaggacaggcgggccccuggggcuucucagucaagucccuagugcuuaagcagaguugggauuggccacaccuaccccugccucccuggcuuucagcccacgccaggccaggcugcuuccugggcuggcaggucaugauaggucuuggugaccaggaagaccucagaguagccgccaggauacugguaaaggcugucuggcucccccguggcccugccccucuuggaaagcccuacagugcggguggauaccucuagcugggacgagguccacuccagccaaguuuugggaugguagugcgacagccgcucacauccuucucucuugguguucuagaacucugaggcuggcugcagacccagggugcugagcucagggccuucucucgaggguaggggcuggaguccccugggccaggccugccugcggaugguuagugguugcugugggggcugggauuccccaccacagcauguguaagccagguuuuuaacauuuagcucaaucguuuacuccugggcaggggccagguguauggauuuuacuguuugaagaaggggagguggaugguggaugguugcuaacagggaguuaauugguucucccagauguggauacgccccucucugucuggcaugaguuugguuugcucucuguccagguuguuaucuuguaacaucagugaaaucaacagugagggggcaggucuucuagaggaaaagucuuuugacaucucagagccgccuggaagcuguggaguaacagaaaucaaccugcuuugcagacugagaggagcggguccauuguaacauggaaugaacauuuccuugaccaauuccuuuuucugcacauuuuaauuucuguauauguuuaacauacuuuugcauaucauuuuucaccauagucucacuucugagauugagaccagguuuaucuauuucaaccugguuugucuaugucaacauuuuuaaaaaugugauuguauuugagcucauccuugaguuccagcacauugaccauuucuuucugaaggccuggcugguaaaacuucugacugcgcaguaccaagcccucaucccuuccucaggccuguccugcugcugaaagacccucucuccugcacacggccucuucgcgguaccaccucaccuuccaggauuccucucuggaacgaacaugcuguuugugauuugcuuuuuaaggcuaaccacaaaaauaugcauuacguugaaccauaugaaauugcuauuuuuuagguuaaaacuuaucaaauaccagaaauuucagaugguucaacuucuuaucuuggggaauuuccaaagacagguuaguagcuagguagcuguugaaguauuucugccaagggacagugaagcugccuuucccgaccggguguccggagguccccggggcugccucauugugagguugggacaggugggauuucccagugggagggcgcugaggcucuggaaggaagccucauuguucugcugaagggauuaagaggaaagcugagcuguccagugaagcauauucuaauuucucguucaaguguuguuuuagucaggucauuuccuaaaauaaaauuagucaaaguuuucuugguuugggguuuuuuggcuuuuuugguuugcuauucugguuuuuuuaaagugucaacaaaauccauuuucuagcuacugugugaccgagggcuagcaucuugucguacaacguagcuuuuuaaggagguaauuuuuucccauaagccucucgcaagggucagcuuuguauuuauuucuaauucauuuuuccucaagaaauacuuauuuaaugaagccauuauuuuugaaauacauuuuuacuuuuuucuuuuauaaugaaauaucauuuaaacuuugaacacucccugauuucuuaguguuuauuuaugaaaauguuuagcuucuuuauauaaugugccuucuggagaagcuguaggggucagcagccaaugcagcuacaagaaauccuuucuaccuuaguuugccaaaagcagcuuuuuacaaugaguucaagaaaagcagaccuacggaaagcgaggauggacuuucagauacagaacccaucugggcacguccucaggucccugagcccucccacccauggaaacccugccagcagguauggcugaccccaggcugcugagggagguccugccaaggcaggaccaggccuuggggcugcccacgcgagacuguggggagccuagcugggaccccagccuucucacaguugaagguguucaacggacgaguucugaguuuucuuuguaaagugacugcaauguucccuuuuaaaugaaauauuuaacacuuuaauaauuccuucgucacagcuauuggcuuacagcuaugaaauccaguugcaugacagcaguaaaaucucccuuuuuuaacaccugcugguagaaguaaguuuuuguaacuucuauuauagagccucagaaaggauucauauuuuuguauuuuugugucuccaucgaauuccucauuucaaaagcgccucuaacaaaagcccugccccagaguuaagggaaagggccuucagggugaauucguuaagguucccaccguguccuggaagaugggcccucuuugcuggugcuucuagugaggacugcuuggguccuggaaggggcaugucccgggagaggaugacgagggaggagaggagaagagaguggcgucauuacuuggguccucaccggagccagcccuuuaagauuagaaauccuucuugaagagccaagcaaaggcucauccagcccccuacaaccccauccugcugccuacucacauccaggaaagagcccaccccugaugggugcccaaguagauggccuccccuggaaagaggcauauuagcccuccucacccgaggguccuagggcccguuuggguguucuuaaaaugugccuuauaagucgugauccagccugaguuuuucuacagagacacugcagccaagaggggauguuuuucuuguagcuuccacauagaucacggcagcacgcaggcuuuguccuuucagcacuuuguaccgauauuuucccugaacuuaagaaaaaaauuaccaauugaaagagaagagaauagcuaaaauaggagaugcauuugccaccacguguggguggccaccgcuguuccccuugauuuuaaacgagggcucauaaauauuguugaccuugcugagauauuaccugguggagcuggaagguuuguaaaccuucuuccgaugcccguuuauugauuagaacaagcuaacaacacugcacuuaaguggaaaaaacagcugguaaaaauguaauucuuucagccuuagggcugcugugcuccuuuucuggagagcaaauguggaaaucaagaucuguggccuucuggaaccuucaccaggaaaggugaaaagaagaagaacccauccacagcugagaguggauggcaggcccgcggguuuccagguggccaguaggauuguccgaugucuggaaugaguaccggggccgccaccaggaacacuugucauuucuaccauggagaggaaagcccagugcauuucugugguucagaaacuugacacaaagagaaaagcuggaauguuuaaaagcaaaaauagggcagagaucagugaaagugcaggaugugugugaaacaaggguagagugagcacugguggggauggagguggugaggggucuucugagcuggggacguuuacuuacaccagcccugccucccaagaacccauccccuguggguccagaagaccagauccccgccaauguccuucccuuucagagcugucuggaggagcaugccacuaguucccagggucucaucugccggcacacggccugacuuucaugggaaguccccauugaugcuguucccuucccagugagugggcucccgucacccguccuggcucauuugaauaccugcaucaccuccagccccucagcagaacaagaaugucagauaauccagaaugcuguugagagcugcuccagguugggggcucgcagccccagcauccaaaagccugguuucagcagggcaugcccgcagagccccuaggcgccccgagcucuccugguuugcccgggcuuugccugcacgggcuggccccguggacugccuggccaggccagcccaguaacagcgaagcacaccacucucagcuccugagcuuggcugaccagcuauacucuggcauauuggugaauuucaugggccaaagaaccugagguucagauugugucuuaguucauuguuucauauuugaauaugcaguuuccuaccuagcaauugucaugaguacuuucuugcuguuuauacuaugaacaacaucuugggcuaggagagaguuuuuaaaguuucaacaaugauucauucaagcacuuuccuuuuucaaguuacucauaucucaguucauucaaugggguugggggauuuauaucagaauccucuagacauuucauuuauaauauucuaccuauaaauuuuuauacuucuuaccccuccucaagauacacuaaaaccuuagcaugggcacacgcacacacauacccuguuucugagaauuauuguucuaaaggaauuuaucaaaauggauguagcuccuaugaaugcuuuugcugugugcuuuacccucuacuaagccuaacauuccuaauuuaauagcuauuuuuguuugagacuuaaaaacugugcgcauugaaggaauguuuugccguugaggaaaugccagccccucuccuaggaaaggggugcucggcuccugguccacuggcaguggcuggaacagaaccacagccugcugaaucccaggaaauucaugaugucccugugcagagcccucugacuaaucagcgaucccacaaugccuguagcagaagcauaguuaggugagaguuuuauccugaauguaagagguggccagguccuuaguucccugagguuccgugagucggggguaaaggaagcagcccucacacagaguaauuuaccaagccugagagggaaccaagaggacuguuugagagucagccacuuccaaaccuugguggacauaacgagggucucuacuacaauaagcaggacuuguaauauguaaaauuauuaugagugcugcuuuuaugggaaaauauucacauuaaaauauaauuuaacucuggugaaguaauuaaacaguaaaucagugauggcuucuauuaaaaauuaagucaucguaauuaugugaaugccuuuagaaggauuuuccgcaguguccuggcguuggccuugaguggacuucucaaaaaguagaaguaaccagguuucugccugugaggaaauguaaauugcaucauugcuuccuuuaauaaauuuucauuuuaaaugggcuuugaaaaauaggaauuuucucucuguuuuaaaguaaaaaacacacuuuucacuuaaauauguuucuaaauuucuauuuccacuguagucauuagcuggacaugugccgcuccaaaagagaauguuaaccuucgucucuuuugucgucauaaaugcacauucauguuuuacagguaauguucgugcauuugaaauaauuccagcaauaauaaguagaauuaucuccacuaccuguguuuauagagaaaaugauguuuuaauaacgugugcauagaauuggacuauguuaucaauacguuaaauguguaaauauuaguauaaaauuaauagugauaaugcugaaaaacuauugcaggagcugaaaguguaagaacuaugacuuaauguaaaugcuuucacacauacgguuuuugccugcaauccuuauguucaggcugacucggaauauaagauucaugagucucugucccucuuuauauguuguuucaugugucagaauggaaaaagcaaauauuuacguagagggaacuccucccuccuguuggagguacgcggcggucaguguagcuucugaggccgcguggagaugggaacauccucaagacagagcagacuuccuggaggcucagccggaacgucuccagcucuguagcacguuuuaauuccauacaagaaguuacucccaaagaaguaaauugaagaacgaaaucgaggaaaagaaaguccuuuuuugaaagcucuuaaacacuugacuccguuuaguucggaucaggccuucucugcccuuccaaagauucagguuagguauugguaacgcccaggaagcacccacucuggcgagcccacccucuccgccaguaaauauauacaguguagcuguuacuaugacaacgacuuuuuuuucuugaguacuguuuuuaauuguugcacaaacacauauuguguaagaaaggggaauuguccauagucuuccacguguggaugugugugcccacacugucugcuuucuuuaaaaaugcacauuccuuucuggauugggcuccgcgaucccccgccugccaagcaaccugauuuucucuucagccuuuccucacuuagaugguuuuaguaagaccuagcaaccgagcucaagagacacgucaggacuuacugcuugcccaagacauauacuuuucauagaaaauucgcgucucuuccucuuuucagaauaaaauaugcaagaaccaacagaaauggcacauuccccugcuuuuccccaagaauugggccuuugauguucaagagcagcugauauuaaaggcuaucccuagaaggcuguagaaacuguaccuauuuaugacaaauguaaaacagcacaaaucuagcugaaugugaugguaucauuaguuugugaaucgcauccuugaaaauaacugugaaggagccaaaucgguuuaaaagaagauaacaaaaugguuuaagcuacuuagguugaaugccaauuauauuuuaauauucaacugagcauauuuuacuaagaaaaaaggccgcauugacgcaugcauaacucauuggcagcgucggccagcugugccgcuccacucuccgaaucacuuugugcauuuuaguagcaugguaauuuaguagaggacuaccugagugauggcauuuucaaugagcagguaaucuacagagaauuuuuauaugguuaugaguucugugcuucagcccggcaacacaaaaauacaucaagaccaauuacgguaucaacuuucagugugauacccuugccacgcaagugcauguauuucugccccaggcauuucaaauugcaucuaauuugaaaucuuugggguuuuaauuaaauuucagaauauauggaauucuucauuaguaccugcucugaauagcagaucauccuucucccagucucucguuaaagaaguaggcugugguaaauagcguguucaguagcugaucauuugugggaccuggguauuggaacagaaauagugaaaugcaaaauaauaucaaaaagauuauuaguccagggagagucucuugauuuguauuuuaauggaauuuuacauuucucuuaaugauuugcaaauuguccucugauuauaagaugcauuaagcuuuucauuuuaauggcaaagacacagccauuagcagaauuuuuuuuucugucuucuuuuuagagugcuucccugcagcagauaaauauugaaaccauuaacaccuuuugauguaugguacagucugcaucuuagacccacacauggcuggccggcuguggucccuccgugccgcacaccuggccggggacccugacucuucucugaggacagugagcagcaguaaugccuguuuccuuuucuggaaaacaggauucuuuuugaaaauuucaucagaaggugguguuuauuuguauuaaagcaaugcauuuaaauauuauucauggcccaauguguauuuaaaaagcuggucuuaccaguguuaggguugacggugcccacagcuccugccuugcucuggucugcggggcuggccuuggugauuuuggaaauggaaucuggccuugcccccaggauguuucucugucaacccaugugcugugagagacacacagagcucuuucuguguuagccagcugaccacagcacgaccccaacguggggacacuugacuuugguuuggccucugagauaaugucuugguuuuaaggccaggacuucuaaugcccuagaagaugaauaugauuuacacgaccagagcuacaaggcaaagcucaucucuucugcuucaucugcugaaugugcacagggagcuuuaggcuucgaccuggcaugcagugacagucugugaaggcaguggcgcuucgggcuaggugucuccuugugucggagaccuguggaauccagcagcuccgucugaucguauaguuaggaaaaccaaggggacuagagaauggcacugcugagugcgggcagugguggcugccccccacccccacccugggcaagugaggucaggccuggcccugcuugcccuccauuucgaagggcaauucuucacuccaggcuugcacagcugacccgagagugagugucucugagcagcuguggcucucagucacuuacccccucaccuucucacuucucuucaugggucuuccaggaucugagggaugaagccagacacaccuccugcccuuccuuuguccucuccuggugagugucaccuucccgggcugucaagagcuggaccaugugcccacucaggugugucaccuuccugggcugucuagagccagucugcaugccugcuaaggcgugucaccuuccgcucaggugugucaccuuucugagaugucuagagccaguccacgugccugcucaggcacaucaccuuccuaggcugucuagaggcagucuguaugcuugcucaggcaugucaccuucugcucaggcaugucaccuucccgggaugucuagagcuaguucguuugcccgcucaggugcaucaccuuccgcucagguguguccccuuucugagaugucuagagccgguccaugugcccgcucagguaugucaccuuccugagaugucuagagccgguccgucugccugcucaggcgugucaccgucccaggcuguccagagccgaucugugugcccauucagcugugucaccuucugcucaggcaugucaccuucccgaggugcccagagcuggucugugugcccgcucaggcgugucaccuucugcucaggcaugucaccuucccgggcugucuagagcugguccguguguccacucagguacgucaccuucccaggcugucuagagccaguccgugugccugcucagauauacugucaccaugugggcccuacucuugugucagggccauuagcuggcacaugcugugugguugccuggugcgcgcuggggcaaccucgggaaacacucuuagccuuuguauugaucugugcaggcugccaaaacaaagugaugccaacuggggucuuauacaacagaaaucuuucucagcucuggagccuggaaguccgagaccgaggugcggcagggugucagcuacucagaccaaggugcugaggcuguccugcuugcccugcagauggccgucuccuugcugcguccucacuaggccuuuccucugggcgugcaucgcucgggucucuauaucauaaucuccccuucuuagaaggacaccagucagaugggauuagggcuaccugaacaaccgaaugagaacuucuucaccucuuaaagaccccaucugcugauacaguugaaaugccgagggucagggcugcaacauacgaauuuuggcagaacauaguuuagcccauaacacccuuuccgagccucugauuaucugucuguaaaguggggacaguaguaacaauguguaaaaugucaugaggguaaaaugaggccaccaaacagucagcaaaagaaauaccugcuuauuucacagauagucuuuucuccaaaaucccagugguaguuagcaagucaggacagcugacuccaccugguccuuuggaacucagggaagauugggccguuauuaggaagugcugcucuuugcagccaacagaacuucccaaggacgcccgcccuccgcccuugcuugcuauguguacgaguuacaggaaguguggcugguauagccccgcagcuguucagaaggaguguuuugguuugucaucuccacaugaaaugaauggagccaauucauacuguaacugagaaaagaacauuuuucaaccauuauuucuucucccuacucacuguuaagcucuaggccacaauaaauggcugccugcugggacuccugcacucugggaugacacguucaaagcgugugcccauguaggcugcugcaagaggguaagcaugauuggaguggggucacuggggucuggggagccagccucggccccuccuggcucagcacagcccucgcggccuugggggcccacagggucacucucccccaacccucccacagcaccgggcugucugcucugugcuucacucugcacuagcugguuccugaguaccaggaggcauucucugauaugcuauggauacaguuauggacaaaauggacucuuaggaaggcagcaaguaaggggaauggaggggcaaagagcacacagcuaaagauugccugacucaacugugguagucacuggugcacugcagguuggcauuugcacccugcuagcaugugcuccugaaacuggggccggagagcuuucuucucugucugagcacucagagcagugccugccaaugcugugacaaugaacgaaugaauaagcaaaaugucaacccauuuucagaguuuuguuuaaugucccuggaccuggaucucucuugagagugagcauugaaugggccuucccugccccuacugagagcucagggcauggaccccaaacgcuugggucucuccucuucccucuucuguuguaaauuuaaaugucagggggaaaaaaaaaaaagcaagaaaaauauguaaauaaauacauuugcaaucauauguuaucggaugagaaggguagcgguuucaagaguuacauucagaguaaucguugagcacauugauggcaaguugauaguuucguuauuaugaaauauuuacuuuggacaaaggaguauucaaaacugacuuacgagguauaaauaauaaaggacaaagucauauauaugccacccaggugauguaauaauuuguuuucuucccuucugucaguagacauuuggguucugaaguuuuugccuuuaaaacuaaugauguuacagauauucuagguugugugcccuagugcuccagcuggcuggaauucaugggcggaguucgcgagaagagggaacuauacagagaaagaauuccagaggucugcaugguaucccauugagucuguugcagauuacaaagucauacaugcauuuguaaaccacaugaaaccagacaacuauuggggaacuauaaguugaacaaauuucagauaagugaaccucacuagaacuagaaaauauguggacaaguaugaaaauuuucuucuauuauuuuauuuaaaagaugauuaacuguucaugauaaaguuaauaaagauguauuuuguaguuuauaauacacguagaaggaaaacauaugacaacaauagcauagaagaugagacuggggaaauggaaauacauuguucuaaguuucuuacuuuaugaacaaguauaauauuuaagggcagacuuugauaaauuaugaaugcauauuaaaaauccuagaauaccaguaaaaauaaccagaaucuauagcucaugggccaacagaaaagauaaaauagaaugcuaauucuuuuauuagaauuagcauauuagaaugcuaaaauguaaaagaagauaggguaaagggggaacaaagaacagaugggaaaaauaacaaguuggcagacuuaaacccaaucauauuaauaauuacauuaaauguaaauguuuuaagauucaaauaaaaagacauagauuaguagacugguuuaaaaagccagagccuguuauauauuuucuacuagacaaaaauaauguaaaaugaugacagaguccuauguaaagauggaaggaaaaaaaaaggaauacauugacagaaagauauaaguaaaauuguauuuauuuucagaucacauaauuauuuacauagaauaucuugaauaauguugaaaauaacuauuaaaaccaauaagugaauuugagaaguuugaggauacaauuuuaacauaaaauguauucuauuuuuauauaauguaauuaaaaaguaaauuauaaaacaguugcuuuauguauuuaacauuagcauuauuaaagauuauuauuuaaagauaugcaaggccucucuacuaaacagcauaaaaacaugacugaaagaaauuaaagaagaccuaaguaaauggaucuuuauuaguuauuggaagaggcgguguuacggagaggucacaucuacacaaauugcccucugcauucaguucagucacacuuuuaaauuauuucaaaaugcaaagagccuagaauauuuaaaacaaucuugaaaaagaagaaugaauuuguaggacuuacauuaccugguuucaagacuuccuacaaaucugugguaaucaagacacugcaguaaggaucaaaacuuagaacagugcaacagagagagagaccaguguuuuuucaguucuuguaucuuugagaaagacacaaaguagaucaaugaggaaaguaaagucuuguuggccaggcaugguggcuuacgccuguaaccccagcacuuugugaggccauggcaggcggaucacuugaggccaggaguucaagaccagccuugcaaacauagcaagacccugucucuacuaaaaacacaaaaaacagccaagcaugguggugcacaccuguaaucccagcuacucgggaggcuaaggcauaugaaucacuugaacccaggagacagagguugcagugagcugagaucaugccacugcauuccaguuugggugacagaggaagacucuaucacaaaaaaaaaaaaaaaaaaaaaaaaaagucuugucaacuaauggugcugagcaacuggauauccauuuuuuuuuccauuccauuuucagaucacuuuaaugguuagaaauuuguuccauaacuuauuuauuuccauagguuuuuggggaacagaugguauuugguuacaugaguaaguucuuuaguggugguuugugagauuuugugcacccauuacacgagcaguauacacugaacgugauauguagucuuucaucccucacccacuucccaaccauucccccugaguccccaaagucuauugugucauucuuaugucuuuaccuccucauagcuuagcucccguggauaaccauuuucagauaaauauuauucaccaugaccuugaccucacaccauacacaaaaauuaaucugaacuauaucauauaccuaaaggagaagcugaaacucuaaagcucuuagaagaaaacaugaguauuuuucugauuuggguaggcacacauuucuuauaacaccaaaauaaaaaacaaugaaagaaauuauuaauaaauuaaacuuuauuaaaagacuucauuaaguaaaugaggaacaggccacagaaugagagaaauuuuuacaaaacacauaucugacaaaggacuucuaagaaggguauaugaagacucugauaacuccauaaaaggaccaacaacccaguaaauaacuggacaaaauaucucacauuuucaucgcaaagacacauaauacacagauuggccccugagcucaugagaaagugcucggcaucaucagucauuagggaaguacagguuaaaaccacagugaaagacaucugcauauaucccagggcagcucagaucagacaccaccaagugucgcagagacugccgcagccucgccucucguauacauugguggguguuaaaauguuguaaccucuuugcaaaaggucuagcagcugcuuauaaaacuaaguguucuccuaccccgcuacccaacaauuccacucuagggcauuuauccaggagaaauuaaaaccuacguccacaaaaacguauucaagaguguucacagcagcuuugcuugcuuuauuuauaauugcugcaauugggaauugcuuguauguccaucuguaggaaaguggauaaauuaccugagggauauccauguagagccuguuccuaucugugaacuuagcauugaaaaggaauaauccacagacacacacagccucguggaugagucucgguaacgucaugcugagcuuaaggagccggacacagcaagagccugccucugauuauauuuauugaagcucugcaguugccaaaaacaaucuggauagggaaaaguuagaagaggaacugcuucugggguugugcaggcagugagaaacugggaaggggcaugagggaauguucuagaccaugacggccauggucuauaucuuaacagguuaggucacauagguaucuaucuguguuugucagaauucaucaaaugauguugaagaugguacauuucacuguguguguaaauuccaccuuaaaggaaaaaagaaccauaaauggacauugaacucuuaaugguauaugugcugaaggacuuggagagaguacacugaugucugcagcuuauuuugaaaugcagcaaaaauaauaauaaaauggauaugggguggagagauggauagauauaugauaaaaacaaauacaggcuaaaaugucaauuauaucaucugagguauaaagcuauucauuguaaaacucuuccaacucuauguggcugggguuuuucauaauauguuggaggaaaauaguaaauauuauggauuuuuauuccuugaaagcaaauuugggggaaagaucaugaaaacuguggccuccuuaucccagauggugaagauacaaccuaguauggccucagcgagauacugagugcacucucaguuugcaccuggagggcagggugagucugggaggucugugaauugucaguggaccucccgguccucuccagagcccugcaggaucggguggauacacugaccugauggacaggaagaggaagccucugggccagaccuuuggacacuguugccuuacucuucuucucuccagccaagcgaguggccuugggaggugaguguggugucgccuugcagccuugcacucagcuuugcagccgucccuguccagccagcuuccacgcaaguggaagacacacagaauccacagcccaggcagcugcucucaccuguguguggagcacagggugcccauccucagagacccugcccagccccucgcugccauccccucugcuagaccaggcaugugggucagcgcugcccugucuggcccgaaguuccaugucaguagccguggaucaaaugaugaaggcagaguuaucuaauuacggaguguuuucucuaauauuuccacagccugcugcugucauggaacauggagauucauuacuuagaaugucaaauuaauagcguuccuggaccugaaacaucauugugucaacuucuccaccuuuuccagguggugguuugaguuugugcacauggcaugccuauugccccagcacggccacagcuuuccaaagugccgcccagggcuggggucugcccacuuccucggaggucuguccaugcucugggcaggcuacagccugcaggaugcagaugcccagauuggagcagcacccugugcccucaagaggagcacagcucacacauccacguaacucuuguccuuagcaguagugaggggcuucugcaggcagaggagucggcuccacgguccuccauguaaacuaccgggaucaggagccuaggguucaauucugcugucacgugucugcacuguagccuguucugccuucucaaccagccccuucuagcuccuggggcaguuucucuuuagcugaaacuucccuucaucuuccaccaauaccauguugcguuacaguuucccucuucucacagaacgagccuugggagaggaguguguucugucacacagccuggccauggcucagguccacaaggucagcuccagacucucagugcaaugagggaccaugaguagcuucugcuugcugagugcuuuccaaguggcggggccucugccaagugcuuugugauccucauauccaaguggaggaaacucaacuuuagacagugacugagcuccaacagcugauccuuggcacagaugagacuugaaccuggguccuucugacuccagaaugcaagcucauaggaagggguaaauuuacugggaagaucucugcuggccagguccuugauggcacagggccacgugcagguggaguccaggcgagacuuguccuugggaacacgagcugguuuugaagcuacuguaguccuggguugcccgcccauggguguugugaggacgcucuccagcaucacugcugcccacgugcccugaggggucuuagguuccaccccaggucacauucaguguuuugucugauucuucaccagaagggagcagccucacgcagacugagcaggaacaguggcauugguguuuuccacagaucuuuuggaagaauuugaacuucugaucauguauauaugacacuuuuuaaaguuuuaagugaugcauggaaacuugauauuguaaauuuaaauaucagucauuuucaguuuugucucuuugcugcucaaaaugaaaaaucuucucacucuuccccuacuccauaauauggucauggaguuuugaccuaauuaaaagcaucagaauuaaguugcuaaguuugaaugggaauguagugguguuuaaggggacuuaggagacccuguccucauguccuuucugucacuauagguuuuguuacuguuuaaaguccaucugcccagcuuuuagauaauuaauucuaauuuugagaacuugggagauguugcaaaaacuguuggagcugauuuuaagauugguguaauauaccugguauuacuagagucagucagugaagucauagaugaaguugugacauuuggcccaggguucccugcugaauucugaaauaccaugaugcuaucaagagaagagccauggguuagccagucuccaugugacacccagugagcuucacugcugguacucccacucuuguuccuucucggauggagucaggucuggccccaagcuacagcaggauauggaggaagugauggugugcgacuuccgaggcuaggucauaagaggccuugcagcucccaguguccucagucaccugcugugagggcagccaguaccaugucagaggacauacaggcagccccaggagaggcccauguggugaggagccagggaagucagcccuguuggaaauagauccuccagccccagucgagccuucggaugagugcagcuaugcagaagaccccaagugacaacugcugagcccgacccuucugaauucaaggccaugaaagaaaggucauuuguguuguuuggggccacgaaguuggggauuaucuguuaccugucuguagugacuggcacaagaugugaggcacuccccaguaguuacuuauucaucacacuuccuuucauagcugguccuuguccuuuccucugguguaaaguacagacugugaagacccgcccucuguuccuuccagcuguuuuuggcugucucuuguguacaaaugcuguaggagaugcaaaggugacucgcagcaucccccaagaaugccugggcuuggugcugccagaaagguauaugaggagccccggguaagccagcacugcaggcagcaagguagccuucagcugugugggcuggggagaacuucauggaggagguagcauuugcaccagacuuugagguagaugggauuugaacacauggaguaaggggaaacaacauagacugaggcugggccugugugugaaacagcaagcaaucccuucuggcuggagcaggggagggugugaggaggggcugccagccucccuccaggccaagaaggccaucaggucucacugggggacagugaggagcuacucaaggcaugaugggagccaggcuggacuugaacaggacucauuggacuguccaggugcugggugagagagggaggaggggacauggagccagcaccaggggacaagggggaccugaagcagcugugaccguggauggcagggaaaagaagaagaagggauucauuuuggcauagaguugggaauugcagcagucacuugagaaugacagagaugggaagguuagggauuagggucaguggcauggacgugagcgaugaacccauacaagugggugagaaaaaggcugaagaaggugaggcagcauagggagugggugacgccagugauggcugauguggugugaccagaggaaggggccaagggggcggaccccgcaggguccauaaugguggugauugccuugggggaguucaggggucgcagaagaggaccugauuaugccauccucacuuguaaauucugcuuggucuccugacgcuaucagggucagacccagcccucucauggcccgcuguguggcaugugcugcucccuggcucuugcccaugccccuccuccuggccaagccacacuccaccugcaucagccauaggcccucccgccacugcccgccugcaggucucagcaccagcguugccuccccagaagccucccugaccauggucccuguugugugccccaccacccccuguucucugucccccugguauugguucgucugcuugugguaacugcugaaugccagccccaaugcccccgccucccaucgccaucagcgucaccagcaucacaaaggucagcacgagguagcugcucacagaauauuuauuaagaauaagaaauuaauaaagggacuaauugguaaaucuuaacaugcccacacugggucuuuuccccaugucacgugagccugaacuuggaacauccauauuuccagaagacaucaggcucuuucucuagugaccuuagaaauccccgcauugaagggagauggcccuggcauggggccccugccacuggguggggagggguggggaccagacugugccagggaccccaaggaguuggagggugcagagcuucuugaccugaguggacagggagacccucugagcucauccucuguaacaggaugagcauggacucuucaggggacaaacuucgugccucgugugaaaaacgaaagggccccacgggcugugucugaugguguuacccacugcacagggaaggcaccuuugcaccccagucccagccaggagagcagcaggucgcaaugucuugcuagccuggccccucugcccucaaugacuuugcaagcaccuuggccucccugucccacuccccugccggcaccugcgugucccuguccugccgagcugccagccucaccugcgugccucucguccucauuugaauaggugagcaaccaaagucagcugugccguuggagccggauuccaucacucaaaauccaggcacagcuccuuuugaauuccucagcugccccgaggcaggggcucaauguugauacugagauuaauccccaaagagcuucucauuucucugcagagaaauuaaagcuugccaguuuccuuuugcccguccuucugacagcucugucaguaaugauaugccugccgcguggcauaauccgugucccgugguaaagaauaauucauuaagaaauuuagggcccagcuccuuuccguuggguuggucuucaaaaguuaacuaauggcggcagcagcacgaugaucaauggaaaauuauugaacagagcucagggcugcuucagaccagcucaaggagccaccuggguggagagcagucagacccacccacccccuuagauuugucagcauucccugaaacacagucagacgguguugauaugaggugucugcugggcguggacagugggguggaugggguacugcccuaguuugggaagcagcuuauuuuuagccuuguagaagcagcgugaagugucuacugguaaagccagcacgacuucuccucccuucugaacaccagcaagaagcuucuagauguuucugaugaacaaauaggaguuccuguacuggcugagaggggcagccuacauacuuagguucuuuggggaggucagugcguuuuuagcaaccauuggcgcauugagcaugaaauggcguggagcugaaacucacuaccaacugcagugaaaccaacaaauggaagacgugaacugaugcuggcccuaaugacucugggcaagacgagggacauuauuguuuugcaugcauugauaaugugucaucuggaaucagauuuucuacuuucauguuguucgauaacaagguugugcccugugagucugggauugugugaggcgagcgugcguauucauucuacugcagaggaggcuggggaggaaucagagcauccugugucugcaaggucuggcguguuucuaagggaaggcagagaaagccagugcuccaaagacagcagagcagacgcgagguuugcaggcaugaggaugacaaaugaaauucgcagaauuccucagacuugauuucccucccuucuauaauuaaccucagggauaccuugacugcgcugagguccaugugcuugagcacuugcuguccugcuugcccugcccuccucugauuuuuuuuugcacagcaugauucuauuucugcuauuguucagaaaccauuagcaccuauucagaagucaguuauucagcuuugagcugaaugacaauuauuugaaugguaaaggguguuaauguauaauuauucacauucauaccaggacagucacaguuuaaucauuucucuguaggcuuccuuaaguuugugcuuaaagucuuaggcauaauucuuuuguuaaauaaguuuaggaggcucuaaguauugggaaagugaguauaaauacgccucugggggagcuucaaggauguggugccucaccuccaggagcgagccuccuaggugaaacugucacuaggcgccccacacuucagccaggaggaagguccauuuccgagggcugguagcauaaucuggccuccaggugagcucugaggucguguucuggcgugcccaggacuagauggagccuaccggggcauuccuaugugugacacagagcccugccaggcccggucgggcucagagugggcuuaaauuaacccuucagacccucgauuccucuggaccccucuuuaagaugauugacgaccccaaagagcuuuugaugauaagggcuauauugugcacauuugccauauuggaaauuaaaccuaagacuuuuuuuuuuuuuuuuuuuuuuuugcgacggagucucgcucuguugcccaagcuugagugcagugacacgaucucggcuuacugcaacaucugccuccuggguucaagagauucuucugccucagcuucauacacccugcauaugccggcugccuccucaagcaguacagcugggauuacaggcacccgccaccacacccggcugauuuuaguguuuuuaguagaguugcgguuucaccauuuuggccaggcuggucuugaacuccugaucuugugauccaccugccucggccucccaaagugcugggauuacaggccugagccaccacgcccugcccugagacuuuuuaaauguauuaacuuauuuaaaaauaacaacaguaaaccuauggcaggauaucauagguaauaugcuucuggaaaugaguuuuccaagacagacacuugaggagaguggcacuguuguccauuuuugcagaauggaaugccuugaugccugccucaguggaagacagcuggguucucagaucugccucugcguuuaauccguuguguugucacaucacguagcccccagaaaacucuuuugucaccuguaagagaaugagaaucuaaaaggcaaauaacauccuaguauugcuauggaaaugauuuugaccucacaaacccccuaaaggggucucagugaccccugaugaucccuagaccacauuuugagaaucucuguucuaaaaaguccauuucuuuuacucuaaaauauuacucacauugccugauauguugugggcuccuccuuuuuuaaauuuuuuuuauuauacuuuaaguucuaggguacauguacacaaugugcagguuuguuacguagguauacaugugcuauguuggugugcugcacccaucuauucgucauuuauauuagguauuucuccuaaugcuaucccucccccaaccccccaccccccgacaggccccagugugugauguucccugcccuguguccauguguucucauuguucaguucccaccugugagugagaacaugcgguguuugguuuucuguccuugugauaguuugcuuagaaugaugguuuccaacuucauccaugucccugcaaaggacaugaacucauccuuuuuuauggcugcaugguauuccauaguguacacaugccacauuuucuuuuuuuuuggcauuuuuuuuaauuuauuauuauuauacuuuaaguuuuagggugcaugugcauaaugugcagguuaguuacauauguauacaugugccaugcuugugcacugcacccacuaacucgucaucuagcauuagguauaucucccaaugcuaucccucccccguccccccaccccacaacaguccccagaaugugauguucgccuuccuguguccauguguucucauuguucaguucccaccuaugagugagaauaugcaguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauuguaaauaaugccgcaauaaacauacgugugcacgugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagacgguaucucauugugguuuggauuugcauuucucugauggccagugauggugagcauuuuuucauguguuuuuuggcugcauaaaugucuacuuuugagaagugucuguucauguccuucgcccacuuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccauugcuuuuggugucuuagacaugaaguccuugcccaugccuauguccugaaugguaaugccuagguuuucuucuagguuuuuuaugguuuuaggucuaacguuuaagucuuuaauccaucuugaauugauuuuuguauaagguguaaggaagggauccaguuucaacuuucuacauauggcuagccaguuuucccagcaccauuuauuaaauagggaauacuuuccccauugcuuguuuuugucagguuugucaaagaucagauaguuguagauaugcggcguuauuucugaggacucuguucuguuccauuggucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauacgaacuuuaaaguaguuuuuuccaauucugugaagaaagucauugguagcuugauggggauggcacugaaucuguaaauuaccuugggcaguauggccauuuucacgauauugauucuuccuacccaugagcauggaauguucuuccauuuguuuguauccucuuuuauuucauugagcagugguuuguaguucuccuugaagagguccuucacaucccuuguaaguuggauuccuagguauuuuauucucuuugaagugauugugaaugggaguucacucaugauuuggcucucuguuugucuguuauugguguauaagaaugcuugugauuuuuguacauugauuuuguauccugagacuuugcugaaguugcuuuucagcuuaaggagauuuugggcugagacaguggggucuucuggauauacaaucaugucaucugcaaacagggacaauuuuacuuccucuuuuccuaauugaauacccuuuauuuccuucuccugccugauugcccuggccagaacuuccaacacuauguugaauaggaguggugagagaggguaucccugucuugugccaguuuucaaagggaaugcuuccaguuuuugcccauucaguaugauauuggcuguggguuugucauagauagcacuuauuauuuugagauacgucccaucaauaccuaauuuauugagaguuuuuagcaugaaggguuguugaauuuugucaaaggccuuuucugcaucuauugagauaaucauguaguuuuugucuuugguucuguuuauaugcuggauuacauuuauugauuugcauauauugaaccagccuugcaucccagggaugaagcccacuugaucaugguggaucagcuuuuugaugugcugcuggauucgguuugccaguauuuuauugaggauuuuugcaucaauguuaauuaaggauauuggucuaaaauucucuuuuuugguugugucucugcccagcuuugguaucaggaugaugcuggccucauaaaaugaguuagggaggauucccuccuuuucuauugauuggaauaguuucagaagcaaugguaccaguuccuccuuguaccucugguagaauucggcugugaauccaucugguccuggacucuuuuuguugauaagcuauugauuauugccacaauuucagcuccuguuauuggucuauucagagauucaacuucuuccugguuuagucuugggagaguguaugugucaaggaauuuauccauuucuucuagauuuucuaguuuauuuguguagagguguuuguaguauucucugaugguaguuuguauuucugugggauuggugaugauauccccuuuaucauuuuuuauugcgucuauuugauucuucucucucuuuuucuuuauuagucuugcuagcggucuaucaauuuuguugauccuuucaaaaagccaacuccuggauucguuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucauuauguacccaguagucauucaggagcagguuguucaguuuccauguaguugagcgguuuugagugagauucuuaauccugaguucuaguuugauugcacuguggucugagagauaguuuguuauaauuucuguucuuuuacauuugcugaggagagcuuuacuuccaaguauguggucaauuuuggaauaggugugguguggugcugaaaaaaauguauauucuguugauuugggguggagaguucuguagaugucuauuagguccucuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuacgaaucugggugcuccuguauugggugcauauauauuuaggauaguuagcucuucuuguugaauugaucccuuuaccauuaaguaauggccuucuuugucucuuuugaucuuuguugguuuaaaguguguuuuaucagagacuaggauugcaaccccugccuuuuuuuguuuuccauuugcuugguagaucuuccuccauccuuuuauuuugagccugugugugucucugcccgugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcugguuauuuugcucguuaguugaugcaguuuuuuccuagucuugauggucuacauuuuggcaugauuuugcagcggcugguaccgguuguuccuuuccauguuuagugcuuccuucaggagcucuuuuagggcaggccugguggugacaaaaucucucagcauuugcuugucuguaaaguauuuuauuucuccuucacuuaagaagcuuaguuuggcuggauaugaaauucuggguugaaaauucuuuucuuuaagaauguugaauauuggcccccauucucuucuggcuuguagaguuucugccaagagaucugcuguuagucugaugggcuucccuuugaggguaacccgaccuuucucucuggcugcccuuaacauuuuuccuucauuucaacuuuggugaaucugacaauuaugugucuuggaguugcucuucucgaggaguaucuuuguggcauucucuguauuuccugaaucugaauguuggccugccuugcuagauuggggaaguucuccuggauaauauccugcagaguguuuuccaacuugguuccauucucccugucacuuucagguacaccaaucagacauagauuugguauuuucacauagucccauauuucuuggaggcugugcgcguuucuuuuuauucuuuuuucucuaaacuucucgcuucauuucauucauuucaucuuccaucgcugauacccuuucuuccaguugauugcaucggcuccugaggcuucugcauucuucacguaguucucgagccuugguuuucagcuccaucagcuccuuuaagcacuucucuguauugguuacucuaguuauacauucuucuaaauuuuuuucaaaguuuucaacuucuuugccuuugguuugaauguccucccguagcucggaguaauuugaucgucugaagccuucuucucucaacucgucaaagucauucuccauccagcuuuguuccguugcuggugaggaacugcguuccuuuggaggaggagaggcgcucugcuuuuuagaguuuccaguuuuucugcucuguuuuuuccccaucuuugugguuuuaucuaccuuuggucuuugaugauggugauguacagauggguuuuugguguggauguccuuucuguuuguuaguuuuccuucuaacauacaggacccucagcugcaggucuguuggaguacccggccgugugaggugucagucuggcccugcuggggggugccucccaguuaggcugcuugagggucaggggucagggacccacuugaggaggcagucugcccguucucagaucuguagcugcgugcugggagaaccacugcucucuucaaagcugucagacagggacauuuaagucugcagagguuacugcugucuuuuuguuggucugugcccugcccccagagguggagccuacagaggcaggcaggccuccuugagcuguggugggcuccacccaguucgagcuucccggcugcguuguuaaccuaagcaagccugggcaauggcgggugccccuccccaagccucgcugccaccuugcaguuugaucucagacugcugugcuagcaaucagcgagacuccgugggcauaggacccuccaagccaggugcgggauauaaucuccuggugcgccguuuuuuaagcccgucggaaaagggcaguauucaggugggagugacccgauuuuccaggugccgucugucaccaauuucuuugacuaggaaagggaacucccugaccccuugcgcuuccggagugaggcaaugccucgcccugcuuuggcucgcgcacggugcacgcacccacugaccugcgcccacugucuggcacucccuagugagaugaauccgguaccucagauggaaaugcagaaaucacccaucuucugcgucgcucacacugggagcuguagaccagagcuguuccuauucggccaucuuggcuccuccccaugugccacauuuucuuaauccacaucauugaugggcauuuggguugguuccaagucuuugcuauugugaauagugccgcaguaaacauacaugugcaugugucuuuauaguagcaugauucacagcugaauucuaccagagguacaaagaagagcugguaccauuccuucugaaacuauuccaaugaauagaaaaagagggaauccucacuaacucauuuuaugaggccagcaucauccuaauaccaaaggcuggcagagacacaacaaaaaaagagaauuuuaggccaauaucccugaugaacauugaugugaaaaucuucaauaaaaugcuggcaaaccgaauccagcagcacaucaaaaaguuuauccaccaccaucaagucggcuucaucccugggauccaaggcugguucaacauacacaaaucaauaaacauguuccaucacguaaacagaaccaaagacaaaaaccauaugauuaucucaauagaugcagaaaaggccuucaacaaaauucagcagcgcuucaugcuaaaaacucucaguaaacuagguauugacggaacguaucucaaauaauaagagcuauuuaugacaaacccacagccaauaucauacugaaugggcaaaacuggaaacauucacuuugaaaaucggcacaagacaaggaugcagucucucaccacuccuguucaacauacugcuggaaguucuggcuagggcaaucaggcaagagaaagaaauaaaggguauucaauuaggaaaagaggaagucaguugucucuguuugcagaugacaugauucuauauuuagaaaaccccauugucucagcccaaaaucuccucuuuuuuauuuucgaaaaaauuacagcagaguucacucuucuuggugugcagcaggaggugcacgugcugugcuuguccaucagugucugcuuugugcaucucuguugaccugccucuaacacugggacgagcaucagccaaaucagaaccaggucagagccccuacgcccuggucagaucagaaccaggucagaacuccccuacaccacagucagaucagaaccaggucagaaccccuauaccaagcuuguccaauccucagccugcgagccaccugcagcccaggauagcuuugaauguggcccaacauaaauucauaaacuuucuuaacacauuaugaguuuuuuuaugauuuuuuuuaacuccucagcuaucauuaguguuaguuauuuuauauguggccuaagacaauucuuccaguauggcucagggaagccaaaagauuagacaccccugcccuacaccuuggucagaucagauccaggucagaggcccuacauccuguccccacaguggacagguuggaaauguaaggucguguggccacugggggcccaggaugggcucugccucagaggcacuuccuuccaccuggccuguuuuaaucaacagucauuaaagggaaaucuaaagauguuuaaaacguuguguauuuucucguuagcagagccaagaaucagucugcagggagcaaagagcuugaguguggaguuagaagucgggguccgggaaagggugcuuguuucugaggcuaacaugcaucaggugcuccaagugggcucucauugaccccaggaugccaucagcccccuugcccugccuggaguauaucacaugggcccugggugccugggccuguggagccacagcugcugagguccgguguuuuuaaagccugagagaggccaucuggggguagcacuacaggagaugggaagaggcccccaggaaaccagggagagcaagaaggucuucuaaggacucauguccucuuaccaacuaccauguaguuaagaaugccuuacgaagggggacgggagagucaagggauagaaaaucaguccuuaaaaucugcacuguccuuuccacauacaaagcaccuuucacacaggugagcucauuuacccucagauggcacuuacuguugugggaaccucauuuuaccaggaggaaacggaggggcgacaggacagcguucuaggaaguagcucagcuguggacauuuuguggugagcucucagggacagcagcaggcaugggaugccugcagagaggcuuucaggagagcgcuggccccaccugcaggcccccagggcgaccuuggauaggcugccgucugggccugggagacuucucaccugcagaguggaugaugggggaccuugaggacugaacaggagaaagcacacugaaccgagccugguaccuaguaagcacucaguaagucuuggcacuuacugugauaauugcauuuuaagcccagcuaccaaaauuuccagaccuacguuaccaucuucaaaugagugccccuacccguuucccuaacguugcucaaacuugcauuuucugaggagcgucuguuggaugccuuuggcccuugcaccacguacagcuuuccacgcuuauuggcuggccacuggguaccaaggaccauggcgggcacucuggaaugcucuguuuuggcaaacuuucuuccccaagaacagauuugacuuuugaaaaguggucugaaagucagccuccccagcccuggucacagcagaaauaguuuuggacccaggugaguugaguccacaaaauaacaggccgugucuacuugagcugaagccuuaucaguuggcccaguaggucccaucugaagaagcccuguauuuuugaaaaauguuaacucucccuaaaagguuacauugaacggcaacacccgggaggcugcuguuggccuugccagcaagcugaaccugcaguugaguggccacgcguguggugcgaggcgugcagcccaucccugagggcuccccugcaugggaaaggaggcugggagguucgccaggacugcauguggcccucgcaccaagaaccugacccaugguggagguggugagugcuguguggucggccuugauguuuauacgagagucucugagguguagacaucagugucuccauuuuggggagagggaggcgguuuucuucccagcuuaccauuaccacuguguucgaggagggacugauauuucgaguggggucaccaucacacucacaccaccaaggcugcuuuccaccacucagcuuucucaugcaucccguuucccagagguggccagugccugggcccugagucgguugagacucauccagagcagagcugcagaagcugggcuggcuccagacagagaugacccaaagccugugucagcauuugggugccugggcccaccguccaggccugagagagcaucagugaggcucggagcccccaucagccaggucaggccguggcucugagccuagugcuccuuucuaaaugggaguugcaacgccagcuuugcaaagugguugucagggcucacugaggggcucuggggagacuuugggggaaggauaaugauuggggaaguagaaauuggcucccaaaaugcuagagcaggacuuaagggacugauggccaggcaccugcccaguguggcauccucccaucguuggcucgagcgcugagcugcaccucugugucaggacuugcucucaguguucugucuggggaggucaugugccuacuggguggggcagguccuugugugggaggagccagaaacucccuuuuuucuuaaaaguuauugggccagaggucaugaauucacccuuagccuaugaucuccaguaacucuaccauccgcaggaaaaugacuucacaccaugcguagggcuggaaggagcacugggauggagucccaccucggugcgcgacccggggcguucagcagugccccaggaccgcagcagcccaugcucagagccagguccucagggccggggcauucagcagugccccacuaccauagcagcccaugcucagagccaggucaucagggccagggcauucagcagugccccacggcugcagcggcccaugcucagagccagguccucagggcuggggcguucagcagugccccacuaccacagcagcccaugcucagagccaggucaucagggccggggcauucagcagugccccacggcugcagcggcccaugcucagagccagguccucagggcuggggcguucagcagugccccacuaccauagcagcccaugcucagagccaggucaucagggccggggcauucagcagugccucacaacugcaacggcccaugcucagagccagguucucagggccggggcguucagcagugccgcacgacugcaguggcccaugcucagagccaggucuucagggccggggcauucagcacugccccaccaccgcagcugcccaugcucagagccaggucaucagggccggaagauggcaacuugaugcuuagccuucaaagaggugguaaacgauaaaaaaacggagccaugccuggauucaagagccucugaaauccuaccaccuaaucacugucuucccuaauuuccccuuggccgcuaugugggugguauauggugggcuguuggguggagcggggcgggucguuacugaucuaucuggaauacccgcuuuaucucuacccagcaaacugcuacccauccaagacccaggcccaccugucacuuccacucuggcaccucguucgccaucaccucacucaggaggguuccacuggugcuugccggcgaacgccaccauuuuuugcagcauaucucauagcuuguuggaaacccacguugaguuggggcuuuguucauccacaggugcugucacgcauccguuuucaggagacagagauguccucuguggcccuccguuggccgacccuguugggugcagcagcugucaguggacagaggugcaucagugcguugguugguggcaucguggccucaccggcccacaguucugacagaggugucuguguuucaccaacucagucugucccugcccauuguccgcacacucauucccuccaugccccagucuggcacccucaagugcaagugcgugcauuuaauucacguaguguguugguugggugcacuccuggaccuuuggggagacugucuucuuccauguuagcugcuuccuucuucccuguggggucauagaggucacagcugacaugcugaaacaaaugccauuguuuucacuuaaaccacauuguauuccauagccgcugugucauaugcguauauauaauaguguguaaggcguauggaaagaagagauuguguccagacuggcuacagauggucauccuaauggcggaagcagccaggccaguugggcuugacucuggagcuuuggagggccauccucaguguauuuguuuuuauuuguggaggccccgcagcgcucaugcuggccaugccuggcugggaugggaugaccuggugaggacagaggaggacagccucugcuuccaugaugaauaaaacagcaucuggcuggguaggaggaaagccugugcuuguucagccucaaguacguguuugaaagcuugccccaaagacauuccaaaaaccaggcaguggugguguccuguccuucuagaggccagguuguccaggcccaggggagucuugcuuaggggucagugagcgcugggacucagucuggcuccuggcaagcccagagaaccccacugcugagucucuacacaaggcauuggacggggcugcugugggugugcgccaggccaccuccaugccugggcagcugugcacaagcuggcuaugagcuccauggcauacagagcacguccaaacuaaccugguagcccagucccauggaaagugugugacaucgugucccugccuucggagugagcaagccacaagccagaugucaggggcuguuccuucugcaggucacccacuggcuggccaagcaccgugaagcugggcgcaccuccuccagggaccauacuaaagcagcuagcagcaccuucccccugcugugaaccccaugccugaccugagccugagcccucacaggccuggcaaaggcugccugcagaggccugggccacacaggcccuauggcuuuccugcgugccacggagagccagccaguggggcugcaggcaccuccucccgcucacucucagugugcgccuccacagggaccacagaccacaggagcuccuggcccgccacaucgccagccgugugcgcaagguuuaucagguuccucuuggccagguugaaguagaugccggguggggaucuguaggcccugguuguguuuacagaagaugcugcccuucacugucuuccagccucccaggaaaggaugguccccaggcuccaugcugacaccacccaccuugcuucacccaguaggcgcuuacuguaugucuacucuaggucauccacagugcugaguguugggauagagccccgggagguaggugccugguccuccgugagucugguggaggagcccuccguggugacagccuucugugagagcauggcaggugguggggccucguagagggaaagauuuugcagaaaaugugaccuagauucccuuuuaaauaggaaauacuggucccuagugucuugaacuuuggggagaaaacucccuuugauuaaagagaagguaacuuggaaauguguuuucccucaucuuuuuguuaauuuauuuuuuaaauuaacauguagugaaauuggcuuuuugugggguauacagucccgugaauguuaacgcguguguguguuucuguaaccacccccaaaaucagggugcagaggaguuccaccaccuggacacccccacgccgcccccuggcagccacggccucuccccacccccauuccagcucucagcaacugcgacguguucuccaacaccguggcuuuguguuuuugagaaugucuuauaaauggaaucagacaguauuuaaccuuuggagccuggcuuuuuucacucagguuaaugccuuugagauucauccaaguuguugcauguaucuacagcuuauucauuuuucuugcugaguguacgcuaccguguggguauaucuccauugaucuguuuuuuauuuuggccauucuaauagauauguaaugauaucucauuguuuucauuugcguuuccccgauggccaguuauguugaacaucuucuuuugugguuauugaccccuccuuauauccucuuuggggaagugucaauucaagucuuuugccuuuuuuuuaaguuaggugguuuguugaguuucaguuuggaacuguugaguuuggaaaaaucuuuauauauucuggauaggauaggacucuuguuggauuucuuauuuccaaauauuuucuccuagcuaguaguagcuagucuuuuauucucuuaacacugacuuucagccgggugcggaagcucaugccuguaaucccagcacuuugggaggccaagggggcggaucaugaggucaggagaucgacugcauccuggcugacacagugaaacccugucucuacuaaaaaaauacaaaaaaaauuagccaggcgugguggcaggcgccuguagucccagcuacucaggaggcugaagcaggagaauggcgugaacccgggaggcagagcuugcagugagccgagaucgcaccacuuugcuccagccuaggggacagagcgagacucugucucaaaaaaaaaaaaaaaaacaaacaaaaaaaaacaccugacuuucauagaccaaacuuuuucacaaacaaguuuuuuuucccuuuuuaaugaaguucaauuuaucucucucuuuuuuuuaucaugauuugaaggacauaucuaacaacuguuugccuaaccccaggucaugaagauuugucauauaguuucuuuuuuuuuuuaguuuaauguuuuacauuuaaaucuaugauauauuuugaguuaauuuguuuaaguaagucaugagauuuacaucacguuucacuauuugccuauggauauccaauuuuccagcaccucuuuuugaaaauaauaugcuuucuucauugaaaucccuuugcaccuuugucaauaaacauuuggucgugcuucaguaggucuauuuuggaaaucucucuucuauucuguuaacuccauccaguaacuccaucaauacuccaacaagcuggguauuuaucccuuugcaaauacauaauuauuauuauguauaguaagucuugaaaccugucagugugauuucucuaaccuuuuuugucucuuguaaaauauguuggcuagucucaauccuuugcccuuucaucuaaauuuuagagucaacaugucuaucugcaauaaauucuucuaggguuuuuuaauuggaaugauaauaaaccuauaggucaguuuguuagaauucaaauuuuaugauauugagauuuccaugaacaugauaugucuccucaguuauucagacauucuugugauuacuuuuucagcauuuuguaauuuccaacaaacagagccuauauacaaauuguuagauuuacaucuaaguauuuuauuugguuggagccauuaucagugguauauagaaaggugauugauuuuuauuuaguaaccuuguaucuagugacuuugcuaaacucacuuauuaguucuaagacuuuucuauuauuuccuggguauuuucccauagacaauuauguugucugcaaauagggagaguuuguuucuucuuuucuaaaacaauugucuucuauuuccucaucuugcuuuuuuugcacaguuagguaugauguuaacuguggguuuuuugcagauacaguugucagauugaggauguuaccuucuguucuuagguugcugagagcuuuuaucaugaauagguguuaaauuguauuaaauauuuuuucugacuggauauagauuauguguuuuucuaggauauuaauaugauagcuauuguucguuuuuaauagccuuuguuuuuagaauaguuucggauuuacagaaaaauugaaaaaucaguaggguucucugauacugcacaccuauuuucccaaauuauaccauugauucuuauuaugaugacauuuacacuugacaucuuacauuaguacgguacauguguuaugauucaugaaccauuguugguaccuuaauauuaacuaaaguccuaugaucuugaaguuuucuuaguuuuuaccuacugcccuucuuccauuccaggauccugccuuggauacugcauuccuagcuccuuuggccccucuuggcugugacagguccuuaguuuuagauggccuagacaguguuaaggaguacugauuaacuauuuuguagaauguuccucuuuuggaauguuuuaugcuuuucucaugauuugacuggaguuacagugugugaggagaaaaaccacauagguaagcugucauuuuccugagaucguaucaaggagucaugcugucagugucauuuaucauuguugaugucaacuuugauuaccuggcuggguagugguguuugucaggugacucuaugauaaaguuaccuucccccaucuccccugcguacugcacucgucccgaagaaguugcuguaccuaacacacuuaggaauggggaguuacgcuccuugaagacagaguaucuacauaaguuacugggaaugcuucugcaugggagaguucuucucccucaccuauuucuguauucagucauuuuuuuauguuaguauggacucagggauauugauauuuuggguugucuuccaauacuacuuuauuuuguugcugagauuaucccaguuuuggccauuugggagauugugcaguuugcuccugugucccuuugucguacucuccucaucgugguuugacuggaauguuugucuuuguucuuuugcuucauuucauuuuggaguguguccugacuuucugauacugcaagauucucaaggcucaucuuguguauuuccugucccaguccuagggaggaaaaggccaguucuugaaggagucuugugucuuuuauuauaaaaugcaugagaaaccauggacugggcacuagguuugcuccuugcuaugggggugguguuguuucuaagucuucucaguugacagaccacagaaguagcuuucuguauacuaacccacggacagauaaauauuguaaacauuucuguaugcaauuaucugugucuauauuaagcuaaacauuaguuccuauugauaucugcaacucuaauccauuaccacauggauucuucuagccuccucuccuuacuuaucuguaaaaucccacucacaaugagaaaccuggcucacacuuucugccauccauuuacuuaauuauucaagcccaguauacauauagaauaguaucagagaguuuaacaccugugcucaugggaaacaacuuuaucaacuagaguucaguauuuauguacaguuccuuuugccuuuagucuuacagacuccacucacuuucaaguuacuuuuggagaaaucagcuccccucccccauucagugaggacguuuuauaaguuuauaauacagucagauucucuugucacagucuguguuucuucccaggauccccugaucuccuaaauauuuuguuguuguuaauuuacauacauugcuuagauucacucuuugugcuguaagcuucuauggccuuugauagauguaugauaucauguuuucaccauuacaguaacaugcagaauaauuuuacacccuaaaaaucccccugugcuccaccuauucagucccccgcuccuucugaaagugccccggcaaccacuuaucuuuuuucugucuauauaguuuugcuucuuccagaaugucaucuaguugggaucauacaguauguagccuuuucggcuggcuuccuuugcuuagcaauauacauuuaguuuucuccgugucuucugcauagcucauuuuuuucacugaauaauauuccauuguauggauguaccauaguuguuuauccguucaccuaucgaacaacauuuuggucacuuacaacuuuuggcaguguuaauaaagcugcuauaaacauucacaggcagguuuuugugaggaugucaguuuucaaaucaguagaguaaauaccuaggugugcaauugccagaucacaugguaaggcucugucuuugaaagaaauugcaaaacagucuuccaaaguggcuuuaccauuuugcauucccaucagcaaugauuaagcauccuuuuugcuccacauccuugccagcaguuuuugguacugucacuguuuggauuuuuagccauucuaaaagccauuguaaucauauucauuauuuuagugugcagcuccuaaagacaaauuauguuaaauaucuuuccuugugcuuauuugucaccuauauauauucuuuggugaagugucuguuaagacuugcccauuuuuuaauuggguuguuugacuuuuuucuuguugaauuuuaagagucuuuuuauaauauauuuuagaugcaagucuuuuuucagauaugugucuuacauauaucuucuccuagucugccucucguuuucagagucucagcaucuuuuguaguaaagaaguuuuuaauuuuaauaaacuccagcuuauucauuuuuuucuuucaugaaucauguuguaucuaaaaacucuucucccaaccuaagguugcuuagauuuucuccuguguuauauucugaaaguuuaugauuuucccuuuuagauuuagguccaugauccauuuugaguucauuuuugagaaagguauaaagucuguaucuggauucacuucuuuuucgugugaugucuaauuguuccagggccauuuguuuaaaagacuaugcuuucuccauugaauugcuuuuugcuuuuuuuugucaaagaucuuugucaaagucuaaauuuggcccuuguauuuauggguuccacauccauguauucaaccaacugcagauaaaaaauguucaacaacaaggaaagaaugguugcaucuuuacugaaagcguacagacuuuuucuccuugucauuauccucucaacaauacaguauaacagcuauuuacauagcauuuacauuauucuagauauccuaaguaaucuagaaaugauuuaaagucuacaggaggaugugcaaggguuauaugcaaauacuaugccauuuuauaucaggaacuuaagcauccauggauuuugguauucuagaaggguccuggaaccaauacccaauggauaccaaggaaugacuguauaucugugugugccuguuucauugaccuuugugucuguucuuuuaccaaugccacccugucuugauuacuguaguuucauaauguagauuuauuuucaaauauugaaucagccuugcuuuccugggacaaaccccacuuaauuuugaugucuuguucuuuuuauauauugcuggauuugauuugccaauauuuuguugaggauuuuuacccuguguucauaagagauacugaacuguacucuuuugguuucugacuuuuucugguuuugaugguggaguaaugcuggucucauaaaacacuuuagaaaauguuccuuucucuggaaaaaauuaugucaaaucaaucuuauuuuuaaaacauuuuauagaauucacugguaaaaccaucuuggcccuagagguuucuuuuucagaagauuguaagcuaugaauucaacuucuuuaauaauuauaggaguauucaguuucaucuuggauaaguuugguaguuuguaguuuuugaugcauuggucuauucgcaguuguuggauuuuaguacacaguuauuuguaggaauaccuuauuaucucuuuaauaucugugggaucuguggcaauaucuucucuuuuauuccugauauugauuauuuguuucuucuuuucugucagucuuuuagagauuuauaaauuuuauugaucauuucauggaacucauuuuuaauuucuuggauuuuacucuuaucauuugucuguuuucaauuuuguugauuuucgccuuugccuuuauuauuuccuuucugguuguuuugaguuuauuuuucucuucuuuuucugguuucuuaaguuggaaguuuagauuauugagaccuuucuuuuuuaauauagacacuuaauacuauaaauuuuccucuaaauauuguuuuagcuuugucccauaaauuuuaauaugcuuuauuuucaguuucauucuguucaguauacucuuuuaauuuuccuucagacuuucucuuugaccuauugauuauuuagaagugauauguuuacuguucaaauguuuggagaauuuucuauuaugguuuuugucgauuucuagucuaauuccauuaugaucagaggauguaacuuauaugauugcagucauuuugcauguguuaagguuuauggcccagaagaauauggcauaucuuugucaauguuuuaugcacacuugaaaagaguauagauucuacuguuauuggguggaguguucuguaaauauccauuaaauccaaucgguugauaauauuuuuuauuuguguaucuuugcugauuuucugucaccuaguucuauugauuauugagaaagagguguuuaggucuccacauauaauucuagauuugucuaauuuuccuugaauuuuuucaugaguuuugaaaucuguuguaagacacauauacauuuagaauugaugauuucuuuuugugaauugacccucucacuauguaauauuccuuuuuacccucugggaauuuuauuuguucuuaagucugcuuugucuuuuauuaauuuuuuuuuacauuuguguuugcaugguauaucuuuuucuauccguuuacuuuuaaccuaccuacagguaucauuugaagugaauucuuuaugacggcauuuucuugugcauguuuuuaaaaaucuauugugacagucucuaucuuuuccuuggcaugguuagaucauuuacauuuaauguaauuauuaauguuucaauuuaggucuaacauuuuauuguuugugcccucuuuuuuuccuuuuucuuccuucuuuugggcuauuuuuaacuuguuuuaguguuuuguuuuauuuguugugguuuuuacuauaucucuucauauaguuuuucuagugacuguuuuagggauuauaauacuuucuuucacagucuaauuagaaucacuguuuuaccuuuuuaaguggaauauagaaaucuuaugacuauauagauccuuuuagcucucccauuauguuauaauaucaugcauuauguuuacauaaauugaaaaucucauuucauaugucauaauuuuugcuuuuggcuaauaaacauaucuugaaaaacuugaggaaaauagccuguaauaguuuuccauauacuuacauuuuucuuacucugccugcauuccugauguuccaagcuucuuuagaguaaguauauggauaacuauaaccaucauuucccuuuuuucuaaagaauuuccuuuagccauucuaaagaucagaucuacuggcacugaauuaccuuagauuuuccuuuuuaucagcaaaugucucuaacucuaacuucauuccugaaggauucuuaaacaucggauauagaauccugaguugucagguuuuuuucuuucuuucagcacuucaaaagugcuguuuuacuuccucuggacucaguaguuucugaugagaauuccacauucaaaugacuguugccuuguacauaaugcauuguuuguuucuaguggcuuucaagacuuucucugaagcuuucagcaguuugaucaugauuuaucugggaauggauuucuuugaauguguccuguuugcaguuuuuugggcaucuuaaaucuacaguuguguaucuuuugccaaauuugacaaaauuuuagcuaucguuuauuugaauuuuuucccguacuacacuuuuuuuccucuuuuucuguaacuccagugacauaaauagaucuguugaccuugucucacguguucucuuuuugucuauuuuaaauacuuuuuuuucuguuguuuggaugauuuuuuguuaacuuggcuucaguuuuauugacucuuuucucggcaucuccauucuacuauugauccuaugcaguacaguuuuuaauuuugguuauuguauuuuucaacacuaaauuuucuacuuuauuauucuugauagcuucuauuuguguuuuuucauuuguuucaagagugucuucccuugcagcauuuuuauaacagaucucuuaaacuuuuugucagaugauuucaacuuuugggucaucucagccuuggcaugaguugauuuuuucccuggugaguuuauuuuucugauuauuugcaugcuugguaauuuuggauuguauccuggucauuuugaauauuaugagacucuggguuuuauauaaauccuacagauaauguugauauuuuuguuuuaggagguagucaaccugguuggauuuaguuaguucauaaguucugaccagccuucaauauuuguucaauuuucaaacccuuuuccguccucuuaacaucaguucuuuugugcaccacucaccagccaguuugggaacuggcagugccgaauucuuacagcaguucucaaagucugugguuuagggucagauacacaugugcauaggcggggaaguagacagcucacccgaacaggugaguccagaaaucuaucaacagcuuuuugguuugcuuccaugaacuccuuuuccuccacaaucuuuuuggcacuuuuuaguucucagggcucccuccucaguccccuggacagacagcuggggcuuuuccccacuccgcuaaacucuuccuauuacuaaaccucaaucuggguccaagcauuaggaagacagagguaaagagcaaagacauuucgcccaccucuuagggggagcacaccucuucccaucagaaagggaccaucucccccucacugguuugggcuccugcggccccuguugucccccacaccacaggauugcuuagggaggagcugacguucaagggcucagagauaacaccaaaaagggaugauuccucacucgcccugaacauaguugucucagcccauuuucugcugcuauaacaacacugccaucuagguaauugauaaagaauaggaauuuauugggcucacagcucuggaggcugagaaguccaagagcaugacgccggcaucugcugagggccaccccgugguggaaggcauuccauggcgaggaagcaugccagacaggagaaaaggggccagagucccucaguaaccaauuccagcaguaacagcauucauccauuccugagggaggggcccucaugaccuaaucacaucuuaacacugucacaguggcaguuguuuccaacacaggaacacauugaaaccuuagcagcaggugaugcuuuuccuuccucaaaguggauuagagccgagccccuagggggcuccccagcugugccaggcuuugccuccagggcucaggcuguaguaaguucgggcugaggacaacagagggauaacccaggaagcccauucaucuuuuccaugguacuugaaauucuuaucuucuuuccaaggcugccaacuacuacugacucuucucagcccucacguagcugcucugugccuucugcccagguuuuauaaagacauucaguagaagaaacaaguauagagugcuugcuucauuuuaccuggaaccagaaucccccuuucccuccauuuguguuucagguuaguuuauucuggcugcuuuugauggccagggagcauuaggucaaauagcugugacuugugccagggacaccagcuccuggggauuccccuuccaggccaguggcugcugcacagggauguccugcaggagcugaggaccugcucuuucuugcucucuguugcucuuuguuggccauggccacagcacagcuacugagaugcucugcaagcaugacccggcagguagcaccuguguguaugggccugaguaugccccugcuagcugcagccuggcuaaggaaaagucccaaagccugggcugcugaaggaugccccuuccccccaggaagccacacggaccuugacaggucaccacccauggagcugugaugguugagggaaaggagacuccuccucaagaacuuggaagcacaauggccugccucccaggaaagagagccucagugcuugucggagcccugaucucagagagggccagcugccuggccagcucugcuguugccugugcucugagccuggccgugugcaguggacgcacagguguguuugcugagguggcucguagcagauuaucaccgaggagagauggacacccaggauaaggaagugaugagucugagcacagcgguggcagagccaggcuggucccggucuguguccuccugccgugcucugguguguguugucuuccuuauuggagcuggguuuggcugaguugguccagguucaggugucaggccugcucagagccuugagcuccacuccauggcguggcaugaaaacaccucgcauaaaaacccagugucugugacacaaaacgauuucucccgugaccagcaugagaaaagggcauccagacccuuggcggaggaugcacaaugcaggcagaggguuuagaaaacagucuucucugggugaggcaguuauggugcacacauuuaaauagcugcccaagccgaaaugaaaauagccauguccuucagaugcagagacuccaagaugcagguccucucccuugaccccagccacagaagcccagcccaagguacccagcaccacaggacaggcaggaggaagggcgagugugggaaggagacaagggaaguggagggguaagagaggaacauccagaauguggcguucggaggccgcgucacagagccccaaggucucggggcugcccucuggggaggcccauggugaaagagagaaggcugcugggguuuuuuuuguuuuguuuuuuguuuuuugagacggagucucgcucugucgcccaggcuggagcgcaguggcacaaucucagaucacugcaaccucugccucccggguucaagugauucuucugccucacccucccgaguagcugggacugcagacgagcaccaccacgccuggcuaauuuuuuuauuuuuaguagagaugggguuucaccauauuggcuaggauggucuugaacuccugaccucgugauccgcccgccucggccucccaaagugcugggauuacaggcgugagccaccgcgccuggaccagaaggcugcuguuuuaaugguugccccuuugggccaccugaagugauuguuccagcugcugaggacugauguggucaccucaaccucaagaacuucuauuuuccacaugaguuaaugucuaugaguggauuucacuccauuauagaauaugaugcuuaacagcaaggauugcccuucuucaagaacgggugucauucagccaugugauucugcacaggcuaggguucgaagcacugugcucuuugagagcugcuucaacuaauuacugcauucguucgcugcagggugaaacagaguuuucagauacauuuguaaaaucaggugccugauugcuaaauacuacauuguuugagcuauacuuccucauauguugccugguacggaccaguuaagaaaugguuucccaugagaaacugacaaugaagcugaacauguuugauaaacucugugcucaucuauggacauauaauuguuuuauuauacgauacuuuuacacuuggaaagaaaggugcuccguaauuuggcagcaauuugucagagcagcacucaaggcuggcgcucagaugaggcccuuggaaccaugccauuguuucucggaacugcucugugcuccgguuagguuugcacacaccucccucguuucauuccuacaaguuuaguaaaguuccaggccguucucccagaacaccuaacggaaagcacagaaaacaaaaccaccaacucuguguucgccgaggaaggcaggaaauuggccucugcuucuugcgguauugacgugcugcuuucauuguuucuuuuccaagacagcuguccccgaaaucucuuuaccuccaagucaacagcaggcuaccuugcuuugcuuugcuuuuuuuuaaaguuaggcauaacaacaacagcaaccaugauaaugauuaacaguuugauuucaaaacguuuucugaagaaaugacaguaaacagugcauuugcccagggaaauccaccaccccgccagccaucagccgguaauacaacugcaugugcuaaugaacccaaagcuguuaaugugguuucuucaguuaaauugauucaugaauuuugaagagaacauuaucuaaugaauuuucuuugaauagaaagcaauuaaaaggacaaaucagucugauuaaccccaaagucacccuccugccacaaaugguguacaguuugaaauuauaucauaaaaaacuagagcacauuugcuaucuuuuugcccucuacuaauccauguaaauuaaugaacaacaaaguuaauuucuuugaugacccuuuucuaguaucaccuggauuaugcugauguuuaauuugcuuaauguuauaauaaagacuaaacagauuuuuuucccagugaagugauuaucguucccuucaguuaagaagugauuuuuauuauuuaacacacauguaaggguguguuuccuuuaagaaccaaaucacacuuugccagcuuggcaccaaguguaauuaguguucuuguggacacacucagaacaucguuccugcccgcggaagccuucccuuuguugcugcuauucagaaacuccugccccuggaggggcuggagccccugcgauggaggacauggcucugucuccagugcuccugagcugcaugucccccuuggaaagacaauagguacugauucagacaggccuucuucgcgugccccaguuucucucccaccgacaccacucccagguaacaguucugaaaccuggaggcagagggagagaauguucuccugcagucaccuccucauuccugcagcaggaugcggcacaaaugcaguuggaugugguuagucaauuaaaaugggaaucaagucauuuuauuuuugcagcccuauucacuaaagaugccuguaaccaaggucaccgccagccccugcguacuguggugcuuggcacuccgagcaguagcugggggaauccugcacgcggcuggagguggacagccggcauaauaucgcagccuggccuguggcugcuuuugccuucuuugucccaguugaaguuggaaauuaaccagcaguacaaaagauuuccaagcaggcgggcaggcagggacuucuguguguauuaauugagccaugagcucacuuacacacgcccagucgcuagaagaguggcacacgcaaccccacgcggaacacgggaagauggaaagaaauugcaaaccuguggugccagcuccaaggaugccuuccaaggggccagccugcaugguggccugccacaugcuugcgucuccucgccuggugacaugguggcagcagugcauggaggccguguuuuaauugaguauaauaccucuauuuguguagaugcguuuccuguuuugggacuaguggcuauuuauaucagagcugcugaagccguuuguccaaauaacauuauccugcauucuuccuuucagagucguucaccagacagguguuauggaagcugcugaagguugugaaauucggagaagugauuucuuaccagcaauuagcagcccuggcaggcaaccccaaagccgcgcgagcagugggaggagcaaugagaggcaauccugugaguucucauggcgcaagcauggcuguggguggcgggugcgugcagguggcagggugucaucugaucccacguguuuccucggaaggcaggcugugcugcuggggugggcagaggggcgauaucugugauggggaccauuaugccagaugccuccagaagaggcaaggaggcuaccccagcacuacacuccuggaagcuccccccuaccgggagcacaucuccacugcaugagcuccugguugucacagugagcaggagaggagggagccuggaggaguggcaagcgggcagagggugccccaccugcucacucaggagguggacguguugggugccuguuuuauggcccacacucuucuaggugcccagaguacagcagcuaacagacagaaaggucuaccugcgaggugccugcauccuagcaggauggccaagcaagggugcacauccaaccccaucucucugugggcugcacucccccugaggcccagggcucccugggucccaagagcuaaagcaccacacgugagcacacgaggcaggaggccuugcagcaugggacaagggaccuagaccacacgcaccucgugucucaccagggauggcgcccuccccagagcccuucuguguccucguccuucccaugcgucugcagucagauuucacuaaacuccaggcucccaggcuaugcagccucaggccaugcuccccagaggacaaggcccaaccgggacacagcauggguggggcagcguggccuguggugccugggggccacgugggugccguugcucucccaucucacagcacccaggccuggcagcugggccgcgggccaucuggcaucuggcaugaggugguaagucacagcaugccaugugcgcccggccaaggccacacgugccugugugugugggggcagaaagggugccccgucugcguggcccauugggagaacccacacaaccucaagaaugccccuggaauauucacccagugaugguguguggucacguuggcagugucuucucccgaaagcucugugaaaguuucuagcaugauggaagcauaccaucugaucagggagcacaaauaugaucacuccaucaugggaugggaaauuacuaaaucagauagaccucacuuuuugaaaaauugcuguggcuuuacugucuauuuccaaaacuacuuauaucccugcucacaggggagaggccggcguguucauaccacagccugcugcuccugcugcccgcugcagcagccugggggcagagccuccguuucuaggagaugacaguuacguaggcuuuugcacaaaacugcauuguuaguccuuaaaaagcaacucugguagguuuguaguggauugcauugucguaauguacacccuaaucuaggcgagcuuucuacccuauuaaaauaucccaaauaucccaggagugagauaccacagggacagccaccauccccaccuccuccaucucuuccuguccucaguuuuggugacaguggcuggugggcgcaauugacccuuccuuuugcaccuguugcacauuaauugcaaugucuucagcuacauugucauaaaacaucugcaccacgcaguagggaucugauuuuuacggcgcguugggggauauuuccgaaucaaauuucugaggaugguuuuugacauuucccaauaaaacuuaaccuacaugccccucuggaaggcugcugucuucuccccgguugugagucaauuuugagguguucaaccugaugaaaaggcagcucagaugcuguuguguuguggcuccguguagggcccaugagaacuguggaugcgaaugggguuuugggggugcucuuccugcaucagugcagugacuguuucaggcagugucuacucuuugugccccccgaggagaguaaguccuugucuucuccccacugagguggauucugcucccuccgugcacacacaugaagaugggaguggccccgucagcgggcgccgacugcucgcucccuugugugugcagcuccccuuuugcuguaaggacaagcuccacuaacugacaugugcagcguggcagcacccucccccaccagccuuuggugaugccagcaguuucucacucugcaguggagaugccgucgcugguuagcaauccugcuuguggcgauauucggagacauuuauuguucugcaaaccagcgugacucucuucuccugcuauuaaucucuaugagugucucuguuccaguauggccucagucacugaaauguauaaaguaguaucacaugggauguaaaacccuaaugucuguaaaguccacacaucggcacccugucccauggcaaagccaagacuggaggugagcacagcaucaggcaggaggguucuacaggcaccaagucucgcccuucucggcguccacaugccuccugugccgagggcagccaggcggugguggcuucucguggccuuucugugggcuccaccgugugcagugaccuucagccugaggagggggcugcagcaggaccuguggcuacgguacccacagacgccucaaauuauagcacagauaugccagagauauuccugcaagaagccuucagcuacguaguuuacuaugguucagguugacagccucccaaguucccauuagaaaccucauuagaaugggcuaggaggaugaaaaggugacccagggacuugcuagaggaagggcgcuggccagcagugagccauugcugcugucaguguccucaggaauguuucccuuuggcgcugacagcagugucccagccggaaggcugcgcacauccacuccagcccagacggugcgucgcugagacucgcucauugaaaacaucccuuauauucaggaugaauagagugauugugcauuuaagggaggagagugaaaaauggacuuggaauguuagaaaacaucguaaagcucauugugcauuaauuccuuagguggcuugcaauaaacaggagcacgugcugguucauauuacugcauuugcugucggcaugaguuucucuuccccaaccggaguaagggauggcuuuugccaugcggagcuuuccucuauccuaggagcuugauuucuccagaauccuccaggaaggacucaccagccgguguaaggugguuggucagcauuccuggaaggcugucuccccaacucagcgggagaggauggucaguuucccaguauauugaguagaaaacuccucacgacccacccccuccacaaagcacccuuccucuucauccucagacagaauuugcuaaaugcaguucaaaggcaaucgauacauugcacagagagucuccccaccuuuuucugaacaaaugcauuccugaggaguuaguuuauucacggauugccaugagcguuaaugaccccccgaggcuuguucugcccgucacccggauggcugcugauaaagacuuagcaucauguucuaagugucaagguugucaguggagcugaaccauuugaccagaagaaaaaaacgcacagggagcuauugauuacagcuucucggugucacuuguucaccaggauuuagguauugaugaggcugcgagugaaaacaagcucuuucccuugugggcugcugcccagaagaacaaaggcgaaguuggaaaaaauauucagccgguaccagaaucagagggauuccaucauugacugaaaggccccuucauguuauuuuuguuggaaacaaaucuauggguuuggaaguuuuauagcguuugagaaaggggcugcauaagugauggauucacguauuggaugaauuagauuucacagcaugaagauuucaaugcagcugugauauuaugagcuucuugguuauugauaaaaauuacauuuuaugcagcacaugcuuuaaaggagagggcauagaggguacagauccuuugaaaauguccuuagggccccaauaaauuucagcagguuucauuaucuuaauagucugaaaccugccaccaaaauucacacaaacagaagcagcguucccuauuucuaacgguaaaaauagugccuauuugguaagucaccucuuccccaucacagcaugcuaaggugaggaccggucacagcugucggggucauuguuauuccgugccaucuguccuggccucugcauugauguacaggaagagggagagggagacauguuuauuuuacucauuuuuauaauuucauagcucauugagagggagagaagaaaaaccaaagcucugcugugaaaucugcuauuagguaggaaaauugaauuggugccuaaauguuuauaaaacuagauugaauuaaaugccuaccucuuuaucagucaaaaacgugaauuguguauuaucuaauaaugcccucacagcaauuauuaaugggacuguuguauuugauaaaaaucaucaaucaggguaaauauuccauccuggagauuuccugugacuccuucuggaagacugggauucucagcuguuccagaacuuggcaguuacuacaccucacucuaguaaacucaauguuaaaaacagucagcccuccgccaccugcauguucccaugucauagucgucagaagccucuuagacugcgucauuggugcacguuaccaaacucaucgucaaauuaggaugagcugugugaugugccggaagccagagucccaccuugcagccaugucaucugcuggcaccggcugucaccccacaaggucccaccucaacaguccacgucaaggaggagaaguguggugcguggagccaugcaggagagugguuagagccccuucuuugccacuuaacagcuuuaugaacuugggcacgagacuccauucggccggaggcugagacaggccugguggggccuugcggggugaugggggccauagauggggucgaagaugcagcagcaucaggcaugggcacacccgcucccaggggcuuuaagcaccuuuuccaaggggggcuggggcuucccccaccucccucggggacguguguagcugggccccacagagggccacacccaccaggugaaaucuguggcagguacauguguggcagugacacaagcugccugcaccaaaagccucaggggaugcaaaaguagcagucaccuccccaggaagcagaggugcccaagaaauagagcuuggagaugcugggcacacgcccccagcugcuuccucuaaaagcucaccugaccaguagcugguugcuuuguccaguucacuggcuuuggaggguggagcguggggaagcugggcaugggcagaaaucauuucucuguugagcuggggauacgcucagcuggagagaaaaagaagaguggagucggagugauacccggggguacccggagugauacccggagguagccuggacacgccccaaccuugggauccugcagaaacagcuguuuguucucaucagggcaggaugcugggagcagggcagccaugugugagggcccagggagaggccccgggucugcagcauccgugucugggccaucuagguugcggggaugaaugugcugcccuccagcucaggaggaagggaggaaggggggccaggcaguaagcgaucguuaggcaucucccaugugccuucuacgugucgugccagcugagaaccuuccagagcgagcuuggugcccuuccccauucuucuggagccugcccuggcuccuguggucaugcucauuggcaguuuaccuucuucacggagcagccacugugaugcuuugcacgaugaugaggcauguccccccacacgucccccgagauguccuggccccuuaguggcugcccacccauacaccugcuccccaggcgccaggagcuacuuagggaugaaggcuguugccugggaggcucuccagccaauucuuucuuuagaaaucugugcaagacuuccccacaugcuccugggaagccauucuggagcagaucuucacaguaacugcuuguugggaagcuuaagcaaauggcccuggagcccccagagcccccagaguccccugcgguggccaugcaggcuguguggccaucccugucugcccaggcagagggggacaaccagagagaugcccauauguuacugccuugucuuucaccuuucugagccagcugagaaauggauagcagaccucaagauuuuagcuuuauuaggguaaaagcgagauugaaggcaggggguggggggccaguggcauggccaugguggcuucccaguaauucccacaagaauuacauucgccaucacuguccccucuggcuaagcucuggccuccccagccaaggcaggggcugaccaucucagaagagaucagggcgccccgaacccuggggcaggcaggucaccugcaggagcccuaacagugcuaagcugggcauaccccucucuuccucccuugucgguggucagugacucauucucccuugugggugugagaguggaggaggccagcaccuacauggaaaccagaggcaggggccacagcaccugcccccacccaccacagguggcucucagagcuucagccagacaguggacccauggagcuccuccugucuacacagcucgggcaacgccaaaggaccaaagcagagucucccugaggacugcacugaaggaggcgcccgccccucuggagggaacagggauucccuuccccuggugggacuggccauaaagaagcaguugguaggcaggauccggggccuguguauggcugcgugguugugguccucacucuggaucagccccuaucagcacagggcauccugaggcagggguuggccaaguccuccugucaagggccagagaguaaauauguuaggcuuggcaaagcagccacagccaguauggagaaaaaggcauggcugcguuccaguaaagcuucauuugcaaaagcagguggugggcugcgugcgcccacagccacaguuggccggccaugggcuggagaggcccgugcagguacggucuucucugaugcguccugugaugccugcgugguaccuggggaguguuugagagcgucacauaccaccagaacucggaaacguaguuuucaguuuuguaagcgaacguuguauauuacucaccggaugaaauuaaguuuucuccucccaaaucgugggccuaaagcaauucucugaggaugccccacgucaccucaggacacucgucccucccccaacccgugcugagacccccagggacucaagggccucaggggaggggaaguccaugcugagacauagcugacacccacccaugccaacagccugccccuggcacaggccccugcuuggugggcacaggacuccugucagucagggccuuggccuugaccccaaagaccucguuguccagaucccugacugacaguggcugccccccugucuuccagguccccauccucaucccgugccacagaguggucugcagcagcggagccgugggcaacuacuccggaggacuggccgugaaggaauggcuucuggcccaugaaggccaccgguuggggaagccaggcuugggagggagcucaggucuggcaggggccuggcucaagggagcgggagcuaccucgggcuccccgccugcuggccgaaacugaguaugugcaguaggauggauguuugagcgacacacacguguaacacugcaucggaugcggggcguggaggcaccgcuguauuaaaggaaguggcaguguccugggaacaagcgugucugcccuuucuguuuccauauuuuacagcaggaugaguucagacgcccgcgguccugcacacauuuguuuccuucucuaacgcugcccuugcucuauuuuucauguccauuaaaacaggccaagugaguguggaaggccuggcucauguugggccacagcccaggauggggcagucuggcacccucaggccacagacggcugccauagccgcuguccagggccagcuaaggcccaucccaggccguccacacuagaaagcuggcccugccccauccccaccaugccucccuuccuggcuguguccauggcugugauggcauucuccacucagcaguuccuagcaucccacacccaggucucacugaaagaaaggggaacaggccauggcagucagugcuuacagagguuuucuagcuuuguuuccuaccugccaaaaaggcuaaugcaagaugcauccacuuauggucuguaucaggugaauagaaaauaaccauuugccaagauuuggaaagacagagagcucucuggacacggguucgauggagcuugcaccucucugagagcugaagucaagucucacccucucuccauacucccuggccuagugugcucugggcagcagguaggaagggacagggaccucucaucucaagggcugccccaaagggcccucagggaccaugggccuguuaggaccccagcaccccagugucgauccuggaagucaaaggucacgacuguggggggccagcucaugucacugauggcagcaggcaggguuuccagcaugggcggugcgcugcugucugauacuucauuauuguguugucauccuagcuguauaauuaacuauauccaaaagccggaagggaaaccuguagcucugcauauggagaaauaaaacagagcauaugauguauagagaaaaugaacugcacccagcugugcacuagagcgccauguucuuacccagcauuccuugccacggugugaaccacagcagggaagcucgcaugguucuacacgucaccgaggccuggaugaaaauguggccucacgauguguaugguugggacccgccuucuauuucauuuuaucuuaacaccaacgaaagaaaaccgauuucagacguuuuucgcugauuuaugauuuauuauaucccuuucuggcaucagccaaaaucucgguuuuuccuaugacaugaagugaugugacucuuaccccguugucuuaacucuugguauuuuugaagcaggauaagucacacagcgggucacguagacacgugcuguuuugugggacaggcccugggccuccuugcuccuggcaggccucaggugccgcacgccgcgucaccgucaggacucgcaggcugucuggucauuuuugacguugcugaaggugagugggaaaagcugggugcacucugccccaaagguggugcccugugucccccacagaugauggcccuccccagugauggccggucaccaggcacggcuuuccccucugcaugaacagaacagaagcuucuggcucuccaaggcagcagcuuggggccugguggcccgggugugcgagccgcgagugcuuuccaacagagggcaccagagccgugcggugugcuguggagaccccagcaccacuuccccugcuggaggauggauuugaaggaggguggcugggcggcaccccgauggcucccugugcucccugagacccuacaggccgcccucugcagccacaccuggaccggcaggcaugcacgcugcaggcaggcugccuccgcuguuugggucccaugaacgauggaagccucccagugagaucuucaggucucucaucaggcacaggcucugagggaggguccuggggccacaugacugcagccagcgagggccgagcccccagaauccaggucagcuccugguggcaggggaccugcccgucaaagccguccaaggugagccagcaaauccguguggccugggagcacaggugggccugcucggaccaugcccuuggugcaguacaaaaccauguucugcuuccucuccgaggguuuccgcggcccugucagaacaggcuugauagaugcccggagguucccucugacagccgcagcagcagggcucaaaccggcggggccguguaccgcuccaaggacaagcucugccgaggccgacaugaaaagccagcacgcgggucgccuagagccgcucugccuccaagcugcagcgccguucgugaaaauacagagggagagggaaggcacaaagaaauacaaaacuauuuuccaaauaaaaagaaaugucgaaaca

SEQ ID NO: 15451 - RNA, 44427 nt, Homo sapiens
gggcggggcuuucccucgcgcagccgcucagcuccccguggccccgcccacauccggccgccggcacuggauugcuucugucuggcggcggcagcauggcggcgggggcggcugaggcagcuguagcggccguggaggaggucggcucagccgggcaguuugaggagcugcugcgccucaaagccaaguaagcggggcggcgagcgguaggagugaggagccggagcgggagcggccgcgagaccgggccgguguggggcggcggguggcccagccuggcuucuuggugcccggcucccuucggccucgggggaccgggcccggcgccacccguagacucccccgagccuccgcgugaguggcccgagccgcagguuccccgccccggaacagcgagcagggcgcgaggcucgccuggaagccccggccccagcccuggcuccgaccccgacggcuguccaagcccgggggacgcgaccuucccggccucuggccugggcggccccgccgcgggacggaggcgguggugacucagccgugccgcaguggcggggcgggggacggggcggcgccgagaccccggcccuccgcgccacggagcgggacccacggcugcgggcuccaccuuuccugugcccgccgggagggagcggcaggcucggcgucggcccauugcucuucagccucccuucaggaacgccccugucgcaggaagagcggcgagggaaggccccguugcauuagcuaggccuggcugccuuuugaagucagccuuuaaaguuuguuggacagcagguagccucagucuucagacuuaaccuguugccggagacagagauuuccuguuccaugaacugguguagugagagucuguucagauuuggcgccgguguccaggucuucaaucccugggaagacuacaaaaggagauccagaggaaugcauagaaagcguuuucuggguggacuagaagcucugaacugcaagcaugcuuacgaguaaaugcuuacuagcgugcgugccugcagggaaaggucugcacguggacucuccgugauaauaccaccucacauuguagacuacuccaaggacugaguuguucucuuaguuguauuauuagcgguuguuaugggaacucuuaugucggauugccugggauccagucccaccgcagccacucaguagccauguaaccccugggcacguuucaugcccaagccucaguuucccgacggugacauagauuagcaccuguuaguaccucaggguuguugugaggguuaaaugagaugacguauguaaaauacaaauaauacaaugccuaguaugcaggaagcacucaguagauguuggcacuuaguauuucaguaggaaguagaaugguucauggaauucacaggcaaaaagcuuuguuuuguuuuguuuuugagacagggucuggcucugucacccaggcugcaguguaguggagcgaucacggcucccugcagccuccgccucccaggcucaagugaucgacccaccucauccucccgaguagcugggaccacaggugcucaccaccacgcccgucuaauuuuuauuuuuuuuuauagagacgaggucucgccauguugcccagccucgucucgaccuucuggacucgagcgaucugcccuccucagccucccaaaggguugggauuacaggugugagcuaccacguccggccagaaaugcuuauugaucuaaauuuuguuuuguuuguuuucgagacaggcuguugcucuguugcccaggcugagugcaguggcgugaucucggcucacugcagccucuaccuccuggguucaagcgauccucccaccucagccuccugaguaucugggacuacacgugcgguccaccacgcugggcuaauuuguguauuuuucguagaggcaggguuuccucauguugcccaggcuggucucuggaacuccugagcucaagugauucgccugccucggccuuguaaaguaucgggauuacaggcuugagcccccgugaccugcccuguugaucuaaauugagugaaauuuugccgacugaauuugaauuagaggcaaguaguacucugauuuugcaauggagagugcaggugagaugggguguugccuuuggaaauggggaggggugcgaguuacugacuaaugguuagaaaugcuuuaugggggugaugaaauuaaaguguuauuuaaacagcucuuuaggcauuucagguuuaccugggaaauuguuacggaaaaaagcagggguuggggagggacaugugacauuuacucacugauggaagcugggcucugacucauccaguacagaucagcacaaucacaggagucaccagaaguggccucuugaaaugagcaggucuuguguggaccugcccuaaguaaacguuuugaauuuaccaucaccugaaaggcuguuuugucuguuuuacauguuuguuuuaaaugcuucauguuuuaaaaaguccuuaaacuaucaaaaugaauaaaaguguuuuuuuuuuuuuuuuuuuuugggggggagacagagucucucucuguugcccaggcuggaguagagugcagugacacaaucuuggcucacugcaaccucugccucacggguucaaaugauucuccugccucagccuucugaguagcugggauuacaggugcccgccaccacgccuggcuaauuuuugcauuuuuaguagagauggguuucaccauguuggccaggcuggucuugaacuccugaccuuaggugaugggcccgcuucccagcgugcugggauuacaggcaugagccacugcgcccggccaaaauggauaaaaguuuaaauguaaguaccauuuggauguuguauccuugccgcuggccuguacuugaaauggcccaggaaacaaugugcacuuuccuuagugacuaguucaaacggacacgugauaaaugauguguggcaucuggggaaggagcacauuucugcagcuuuuuuggugaagauggagacauuuaagaauauuaggccgggcgcgguggcucacgccuguaaucccagcacuuugggaggccgagguggguggaucacgaggucaggagaucgagaccauccuggcuaacacggugaaaccccgucuuuacuaaagaaaauacaaaaaauuagccaggcaugguggcaggugccuguagucccaguuacucgggaagcugaggcaggcgaauggcaugaaccugggaggcggagcuugcagugagccaagaucguggcacugcacuccagccuggacgacagacgaagacuccaucucaaaaaaaaaaaaaccaaaaaaagaauaucaugguggcuuacaccagcaaacccagcacuuugggaggauggcuugaggccaggaguuugagaguagcuugaacaacauagaacccaucucuacaaaaaauaaaaaaaguagccaggcauggugaugcaugccuguaguccccagcuacucaggaggcugaggugggaggauuguuugagcccaggaguuccaagcugcggugagcuaugauccugccacuguacuccagccugggugacagagugagacccugucucaaaaaacaaaaagugcccgaauuuuaguacuuguguugauguaauaauuuuaaaucuacuuuccaaaucaucgcuucuccaauuuuaaaauuugacaugaauugaaauuuuuuucuuuuaaguaguugaaucagauauuuacauaaguugcugaaaucucagcugguuuguacaaugggguuauuaauauccauuugcagaguaagcagguuuaguauaugauauguuuaauaagcaguagcugguaucugcagaugaauguaguagcagaauacuauaauaauugaaaaacaacuauuugcugaugaagagcugaaguuuauuacauugucuaaaguuacauuagucaggauuugaaugugguuuuugucugaugguuuuucuccaacaaugcuccaggcauauggggcuauccauuaagauggaaagaauacuguaacauguaauccaaaaggggauaacguuuauauuuguuucagauauaguauguccuuauaauauuggacauuaugugcuuaauugagaaauggaagguaagcauuaaauaggagaauauuguggauaauuucaacuaacaauaucauguuuuaauguuuucaaauguuuuauauuuuuguuucaucuucucaacaucccagaguguugguuauugcuguuuuacagauguggaaguuaaauuacucuucaaaaccauguuaguaauaaugaaacugaaaugaauucaguuucuauggcauacuuucuucuuuucuuuuuuacuuauuugggcucauacuauuauaaaguuugguaaccuacuuuaauuuuugaaaaauguaguuauauuaguauuuuccuguggcguugaaaguucuuugaaaauuugauuuguaauggcuuuauguuuucuuaugaccauuuaaaaacuauuauugagcaucagaaauuuuucugauuugcuacguaaaguagugggaaaauauccauguacagaaaaucuuugucucuuaauuacuuccuuaggauugauacuuauguguaagaaauuucugaaaggucccaauuuaauuuuuaccagcaggacaugaaaguacuucucgucauccuuuuuaucauugaauauuaugauuuaaacaguccuuuuguuggcugggcacgguggcucaugacuguaaucccagcacuuugagaggcgaaugcaggcagauugauugcuugagcccaggaguuugagaccagccuggucauuggccaaagcccaacuuuacaaagaacaaaauaugccuguagucugggaggcugaggugggaggaucaccugagcccaggaagucgaggcugcacuugccuugcacuccagacugggcauuagaguaagacccugucucaaaaaaagaaaaaaaaaauuuuuuuuuuggucaauuugguggaaaaugguaucccagcuuuaaaaagaaauugaaguauuacauacaguaacaaugcacagaucuuaaucgucagauguggugaauuuucacaauuguauacacaccgauaaccaccauucacaggaagaauauagaacccaggaaguuuuccauccccuuuagcccagcuacugauuucuuacugucacuguagaugaguuuucccugcucuuggacuuugugugaguagaaucauacaguucuuugucuguguuaucuuuugcucacauauuuucaagcuucauuugugucauugcucaugucugugguugguuccuuuuuacugguaaguuacauucuguuguaugaaugucuaucacuuucuccuguuggcggacauuuggcuaauuuccaguuuugauuuauuauguauagggcugcugugagcauucuugcaugaggccucugugaaccucuguuuuguucuugccauccuuaggcaauggacaaaaaagcuucccuggauccucuucauugcuggaggcuauggugggcagaggcuccugagggaggguuuugaggggucaggccuguguucuaguuuuagggccagaauucaguuccagggccccagacaacugcaaggaagacugaaaaauguaaucuagcugaaugcacaggaggaagaugaaacagugcuugauugaaacagcacagucucugccguggaccugaggccccaccuacucaaccauugaagcugcugaguugugcuggaugcaaauuaacauccggugacuaggggcuccuacaauguguccuucccugccuuaggugggucuucauuuggagcuuccugcuuuccuugugugccuguggacacucucccuucaucaguccuaccaguggucuugcccucuguuuuccuaugcuuugauaaaugaccuugcuucccaccugagagaaaacaggauuucagguagcaucuccccaagcccuccuuccacucucaccucucccaacacuuaccauuuauuuguagccuuacccauucuuaauuccuuggcuccugacucagaggagacugccuucuucuucuucaagguaagcucuucucugcucuggauuuccccucuccugccucuucugaguccuugcauccucagcugucuugugucuacggcccuucccucuccauuugcacuauccccuaguaaaauaaacauauaaggauuuucuuguauuaaaaaggcccaucccuugauuuugucuuuuucucugccuguacagaucucuuagaguacaucucugcuuccucaucuucacuucaguccucaguggacugcagucugaccugugcuucugcuauuccauugaagguacucucucuguuaguugcccuuuccuguugcauuggaugauugucacucccucuugacacucuucucuugacuucuaugugacccuucaaucuuccaguaccgccuaggaccccuuaaucuuccaguaccgccuaggaccccuucucugcuuuacuacauaaguuccuucuccuccaucuguccuaacuuaauguugauaagcccccugaggcgcugaccucgggucuccucugugucccucuguaacccuuugcgguguggugcuggcacuguuccuuucuugauucccaaaucuguauaucaggugcagacuucuucccugagcucuagacaucauacuaacaacccauuaaacuuccuuuccucagguuggcagcuucugcacuaugauuugaggcauagugccaccacuagccaucagucucuaagccagaacuuggagccagcuguagacugccuuaucugucaccaaauccugccccuucuaccuucgaaauccucaugcugcucuuugcuucugcuuuccugacacuuuauuguaggcuuauucucuucucgcugguauuauuugaucaguuuuuacaguuuguuauuccuuuccuuacccauagguuaguuguccuugguucuuuuugccauggaacauauuucuguucgugauuuuucagauuuuuuugggaggugguauuauauuugaacagaauuccauaaaacugaaggauuuuuuaguuggauaugaccauagauaucuuugccaagauaauuuugugugaaaacuaacuaaaauagauacugaguuauuaauauauucuguguguucauacuauaaauguuuagaauuuuuuuuuuuuaaaugggucuugcucuguugcccacacuggaguguagugguaugaucauggcucacuacagccucgacccccugggcucaaguaauccuuccaccuuagucugccagaaugcugaguacaggcaugagccaccuugccuggccuagaaaaaucuuuuuuuuuuuuuugaggcagagucuugcucugccauccaggcugcagugcaguggugugaucucagcucacuguaaccucugccuucuggguucaaacaauucuucugccucagccuccugaguagcugggauuacaggcaugcaccaacacacccggcuaauuuuuugugcuuuuaguagaguugggguuucaccacauuagccaggcuggucucgaacugccgaccucaagugaucugccugccucggccucccaaagugcugggauuacaggugugagccacugcucugggucuagaaaaaucuuuuguagcauaauauuaaaaaguauaaaaaaaagucuuugugaaaagcaguucuauucuuuuccucguuuugcacuggcaugccuucauuuucaacacuuacugcuguuucuauggucacgguuaugucucuccaucacuauaccacauuuaaaaaguaaauaaugauauuauuaguaaugugucuacaaccauuuuucacaaacauugugccauuaauacagaaauucaguuuccacuuugcccaggggucugaaaauaugguugauuugccuggcuuuuuuuuuuuuuuuuucguuuacuuuaaguucugggauacauaugcagaaugugcagguuucuuacauagguaugcaugugccauggugguuugcugcaccuaucaacccaucaucuagguuuuaagcccugcaugcauuagguauuuguccuaaugcuuucucuccccuugccccccacccccugacaggcccugguaugugauguuccccucccuguguccgugugguuucauuguucaccucccacuuaugaaugagaacaugcaauguuuguuuuucuguuccuguguuaguuuacugagaaugguggcuuccagcuucauccaugucccugcaaaggacaugaacucauuccuuuuuaugacugcauaguauuccaugguauauaugugccacauuuccuuuauccagucugucauugacaggcauuuggguugguuccaagucuuugauauuguaaauagugcugcaauaacauaaugugugcaugugucuuuauaguagaaugauuuauaaucuuuuggguauauacccaguaaugggauugcugggucaaaugguauuucugguucuagauccuugaggaauugccacacugucuuccacaaugguugaacuaauuuacacucccaccaacagugauuuacaugacuuuuaauugagguggaugaauauucagaucuacuucaaaugggcuucacuugaaauaucauugaauugaaaauuuaucugaaagagucucaagaccuugcagagugcuuuuauguuccaguguuguauacaacaaaauucuagcaauaugaaaaacuucagacgguucuuuuaaagcuuucuuuuuuuucuuuuugguaauuuauaucaguauuuguguauuuccaaaauugguauaauuuuaaauaaaugcauuuaauugauuuacaggucccuccuugugguccauuucugggcaccaugggcuccacagugugcacagaugaacgaaguuauggcagaguuagcuaaagaacucccucaaguuucauuugugaagguauuuauauuucaaugucaugucuuuugugaauuuaauucugauuuauggguuagauuagggcugggugcgguagcucacaccuguaaucccagcacuuugggaggcugaggcgggcagaucaccugaguucaguaguuugagaccagcccagccaacauagugaaacccugucucuacuaaaauacaaaaauuagcugggcgugguggcgggugccuauaaucccagcuaugugggaggcugaggcaggagaaucuuuugaacccgggaggcagagauugcagugagccgagauugugccacugcacuccagccugggugacagagcgagacgcugucucuaaauaaauaaauaaauaaaauaaaaaauuagauuuuauuaacuaauauaaagauggagugguauggaauuccaaauauguauaauuggugugggaucuguuauuuuugcacaucauucuuaaaaaucuuaaaauaauuuugcauuuuuuuuuuuuuugagacagagucuuguucugucgcccaggcuggagugcagcuccagcucacugcaaccucugccuccccgguuuaagcgauuuuccugccuaagccucccgaguagcugggacuacaggcacaugccaccacacccagcuaauuuuuuguauuuuuaguagagaugggguuucaccaucuuagccaggauagucuuggucucuugaccucgugaucugcucaccuuggccucccaaaguacugugauuaggcgugagccaccacgccuggccaaauguacacuuuuccuugaucauccucgggugugaggcaugacuaccaaaugucaagguggcugugggcuggaguuuuggagagcacaggcagacaaauuaguucccuguggguaacugugguuuuaaggcauuuaaaauaguaacacaaauuaugucauugaaaagcuaggugugcuguagaaaauaauucaggaagggguauguaaaugcugcuagggaccagggaacaggaaguugcuaucuugguuuagaugaaggcagaccuccgggagaaggugaaagucuuucuaaccuguucagaauguagaggaagauggaagccagucagucucuuccuugccucuuuuguuuuucacucugguuauguguacuccuacauuccugcugucucucuugaguggaugagugcuaggaaagcuguaguuuugacuguggauuaacucaauugguuuagcacguuaaagauauuauucaggacuuaguacugguuuaggcagcagggccaaaauauguguugagagucuuagaaaugaauuaucaggaggggaggugcaccuuguauucccaagccugaauccuuaagauuuaaaaaacaaaugaaaaaccaaagucuuauuuuuuaaaacaagaaucugugaguucagaguacauguuacccaauauacucauauaugggauuaaaaauaacaucaacuguauuggucuguaugccucuuucuauguaaacugaaaacacagaauuuugacaggguaauucauucguauaguaggugauaaaauuuucaggaggcuucuguauaaauaaguuugcuuugaauaggcauuauacucaguuggcucaaaauuccaaacaguguagaaagauguccguugagaaggcccaccccguuccucuguugucacccuugugucccaccacauaaguaacugcuuguauuaauuuuguaugaauccuucuaguguuucuuuaugcaaauagggcagaugugaauauagugauuagcuuuuuaaaauuuaaggacuuauuuaaaauuccaaugaaauguauaauguaacuguagaguguaacccuaaaauguccaauauaaauaauagaagggggcauuaaaacugcauguuuggucagugauaaaagauaaugauuacaagugaaaugaaugauuaaacauuucaaucauaagauuaaucaagaugaugguaauuguucuaagucugcuuuuauguguaucauguuacugguuuagguaacacauuguucuuagcugcuaucugaaugauuuauuuaaagugacuauagaauuacuucucacauugguaccagacuuggcagugagauuuuaaguuguucaagugcuuaaguaucucugugagccaaagguuggaggagcccucagcgauuuuggguugugggggauaccugagccugacugcaccugccacucaugaggaugaugacagcguaagauuggucauucuuccaggagucaucacuuuccagaaauucacucuauaacauaguuuuucuuugauuagccaucauuaagggcaaagguacuuuccauggcauuuguaaggcagcuaauuaaaaggcacuugccggacaauaguaagcaaaagagaaguagaaugagagaucaucguucuuucccaguaagagaggcgugcaggcugggcgccucggcucacaccuguaaucccaacaccucuugaggcugaggugggaggauugcuugaggccaggaauucaaaaccagccugaugcacauagcaaaaccaucucuacaaaagaaaaacuaaaaaaguuagcugugcauguuggugugcaccuguagucccaguuacuugggaggauaaagcagaggauuccuugagcccaggaggucucaaggcggucacaccacuggacguagagugauaccaugucucaaaaaaaaggaggaauguaguucauuuuaaaacagcuuucuuuuuguuaaugagaguuuuuggaaaguucuagaguaugaacuaauguucuucugcuucaucuugugucuauuugauuucuuagucuuuuuuuuggagacaaggucucacucuuauugcccaggcuguagugcagugaucuuggcucacugcagccucuaccucccaggcucaagcaauuucuccaccuuagccucccgaauagcugggacuauagguguacaccccugcccagcuaauuuuuguauuuuuuguagcgauacgguuucaccauguugcucaggcuggucuugaacucaugggcucaagcagucugccuaccuuggccucccaaagugcucagauuauagaugugagccacuuugcccuucagucuuuuuuuuuuuuuuuuuuuuuuuuuuuaaugaugaaaugguuuggcauuuuuggcuugugaaguaaagggaucaguucauuuuugugacugggauuuauaaaaucauuaaauaagugaucauacacuagauauuuuuaaacagauuguaaacuuuugugacuaucaacaauuucuuauuuuguaggagcugguaaaaauagaguuagaagaguuagucacccauuuuuggucagaguaguuaguuugugcucuuuggaauugaaugcugaaagacaagguuuucauauuuauugcaucugaaucccucauucucuguauugaugauauggucguaaaguguauuugggguggggcacaguggcucacaccuguaaucccagcacuuugggaggugugagugggaggauuguucaaggacaggaguucgagaccagccugggcaacauagggagacuucaucucuacagaauaaaaauuuaaaaaacuagcuguguacaccuguugccccagcuacuugggaggcuguggugggaggauugcuuaaguccaggaguuagaggcugcagugagcuaugauugugccacuauacuccagcuugggugacagagugagaccuugucucuuaaaaaaaaauuaaaaagugcaucuguacuccuuuugggugcuguguuuauaaugggugguguuccauuuaccugagucacugccaugucuagugggcucuucugggcuccguccugaguuugucacaccuccuagggcccagaggagaugaugugguauuucuaucacuaaaaggaguucaagaccagcuugaguaacauggugaaacccugucuccacuaaaaauacagaauuuagccaggcaugauggcgcaugccuguaaucccagcuacucgggaggccgaggcaggagaaucauuucaacccaggagguggagguugcagugacccgagaucgcgcuacugcacuccggccugcgugacagagcaagacuccgucucaaaaaaaaaaaacaaaacaggaaaagucuuagagaaaccuuguguuuauucagaauaaaaugaaauaguuaaaauguuuuagugccuuuuauuuucaaauuacauagucaguaucuucucucauacugauucuuguuuguaucuuuacccaaaauaggaguacaccuuugucauuuaauuaauuguuugauauaaucuuccaaaauaugguaucuggcagaggggggugggagagaggaagaauagcacaaggcuuuguugggugccugcugcugguuguauuugagauccaaaucaacuauuuuguaugaaaucguagcuauuuuuuccuguagcuuuuuuuuuuuuggucucugugccauugguugcuuggaucaggaaaugcccuauauuuuugucuauauugucauuuaauuccuuuuuucauugccuccuugacuagauggugagauacuugacauggggaccuuuaccucaucagguuuucauuaguaaaaaaaaaaaaaaaaaaauagggccgggcaugguggcucacgcuuguaaucccagcacuuugggaggccgaggcggguggaucacgaggucaggagauugagaccauccuggcuaacacggugaaaccccaucucuacuaaaaauacaaaaaaaaucagccagcuguggugggacaugccucuauucccagcuagucgggaggcugaggcaggagaauugcuugaacccaggaggcggagguugcagugaguugagaccacaccacugcauuccagccuggauaacagagcaagacuccaucucaaaaaaaaaaaaaaaagaaagaaagaaaaagaaaaaaaugacuuuccuuuguucgaauggcucuugcuuuccaugcaagccucccugaucccacuuccagcuuacugcucccauccugcuaggccauaguauacucauuuuaccauaucauguacuucagugcaaacauucucaaagucagacuuaccagcuagcugguuggugagauuuuauacuauuguauuucauuugacauuaauuuuguuuauauaguagcugcuguacuugcauuuuauuuucauuguaauuuaaaauauacgaucaaggguauggaggaguuacguauuuaaauguauuuuugcuucuugaaaaacaagaaucuuuauucuuauuuugaaagugcgacuaucuuaaagauacagauugcacuguugaauuucuaaagaucuguacaaucauuauaaauguaaauguaguuuauguuuaauuucugaguguauaauuacuguauguaaacagauaguguugggcaaucuuccgaaggguaccaacuagcuguauaaccaggugcaugcuaacuaguggaauuaaaauuuuucaguggcagagaauguuggccaauuuauuuggcaucuuaagagagcauauguuggauuucauucuacaggaaggaacucuaaaaaugcgucucagauaauucugguagaauuguuuuuuuuuuuuuuuugagacagagucucacugugucgcccaggcuggagugcaauggcgugaacucagcucacugcaaccucugccuccuggguucaaggaauucuccugccucagccuccugaguagcugggauuacaggugugugccaccacuccuggcuaauuuuuguauuuuuaguagagacgggguuucaccguguuggccaggcugguuucgaacucaugaccucgugauccgccugccucggccucccaaagugcugggauuacaggcaugagccaucgugcccggcucugguagaauuguuaaaucuuaaaaagacuguagguuuuuaucugugcuaucuugguaauuaaaaaaacccaaaauuaacaugguuuuauuagcuguuucugggcuaaguuuggugaaaguauuuaaagaaguuaucaaaacuuuuuuuuaaaauuauuauuauacuuuaaauucuaggguacaugugcacaaugugcagguucguuacauagguauacaugugccauguugguuugcuguacccaucaacucaucauuuacauuagguauuucuccuaacgcuaucccucccucagccccccacccuccaacaggccccggugugugauguuccccucccuguguccauguguucucauuguucagcucccacuuaugagugagaacaugugguguuugguuuucuguccuugugauuguuugcugaaaaugcugguuuccagcuucauccaugucccuguaaaggacaugaacucauccuuuuuuuauggcugcauuauauuccgugauguauaugugccacauuuucuuuauccagucuauuauuguugguuuaaagucuguuuuaucagagaccaggauugcaaccccugcuuuuuuugcuuuccauuugcuugguagaucuuccuccaucccuuuauuuugagccuauguuugucuuugcacaugagaugggucuccugaauacagcacaccgaugggucuugacucuguccaauuugccaggcugugucuuuuagucuuuuaauuggggcauuuagcccacuuacauuuaagguuaauuuuguugugugugaauuuuuuuuuuuuuugagacggagucucacucuauugcccaggcuggagugcagugaugcgaucgguucacugcaacuuccgccuuccagguucaagcgauucuccugccucagccuccugaguagcugggauuacaggcaccugccaccauacccagcuaauuuuuguauuuuuaguagagacaggguuucaccguguuggccaggcuggucucaaacuccugaccucaaaugauccaccugccucaaccucccgaagugcuggaauuacaggcaugaaccacuacacccagucuguuacaugugaauuugauucugucauuaugaugcuaacugguaauuuugcccguucguuaaugcaguuucuucauagugucgaugguguuucaccauuuggccuguuuuugcaguggcugguacugguuguuccuuuccauguuuagugcuuccuucaggagcucuuguaaggcaggccugguggugacagaaucucucagcauuuucuugucuuuaaaugauuuuauuucuccuucacuuaugaagcuuaguuuggcuggauaugaaauucuggguugaaaauucuuuaagaauguugaauauuggcccccacucucuucuggcuuguaggguuucugccgagagaucugcuguuagucugauagccuucccuuuguggguaacccaaccuuucucucuggcugcccuuaacauuuuuuccuuaauuucaaccuuggugaaucugacaguuauaugucuuggggucgcucuucuugaggaguauauuugugguggucuguguauuuccugaauuugaauguuggccugcccugcuagguuggguaaguucuccuggauaauauccugaagaguguuuccuaacuugguuccauucucccugucacuuucagguacaccaaucaaacguagauuuggucuuuucacauagucucauauuucuuggaggcuuuguucguuucuuuucacucuuuuuugcucuaaucuugucuucucacuuuauuucauuaauuugaucuuccaucacugauauccuuuuuuccgcuugaucgaaucggcuauugaagcuuguguaugcuucacgcaguucucauacugugguuuucagcuccaucaggucauuuaagcucuucucuacauugauuaguuagccacuugucuaacuuuuuucaagguuuuuagcuuccuugcaaugaguuagaacaugcuccuuuagcuaggagaaguuuguuauuaccgaucuucugaauccugcuucugucaacuuguugaacucauucucuguccaguuuuauucccuugcuggcaaggaguugcguuccuuuggaggagaagagacguucugguuuuuggaauuuucagccuuucugcucugguuucuccccaucuuugugguuuuaucuaccuuuggucuuugauguuggugacauuuggaugggguuucuguguggauauccuuuuuguugauguugaugcuauuccuuucuguuuguuaguuuucuuucuaacgggccccucagcugcaggucuguuggaguuugcuggagguccacuccagacccuguuugucuggguaucaccagcagaggcugcagaacagcaaauauugcugccugauccuuccucuggaagcuucguuccagcggggcaccugucugcaugaggugucugucggccccuacugggaggugucucccagugaggcuauacgggggucagggacccacuugaggaggcaguuugucuguuaucggaucuugaaugccaugcugggagaaccaccugcucucuucagagcugucaggcagggacguuuaagucuguagaagccuuuuguucagauaugcccugcccccagagguggaaucuagagaggcagcaggccuugcugagcuguggugggcuucacccaguuugagcuucccugccacuuuguuuacacugugagcauagaacugccuacucaagccucagcaauggccuacucaagccucagcaauggcggacgccccuccccuagccaagcuucaguguccuaggucgaucucagacugcugcgcuggcagcgagcaaggcuccaugggugugggacucaccgagccaggcacgggagggaaucuccuggucugccaguugcaaagacuguggguaaagcguaguauuugggcagaaguguaccauuccuucagguacaaucacucauggcuucccuuggcuaggaaagggaaauccuccaaccccuugcgcuuccugggugaggugacgcccugcccuacuuuggcucgcccuccaugggcugcacccacuguccaaccagucccaauaagaugaacccgguaucucaguuggaaauggagaagucacucaucuucugcauugaucucgcugggagcugcagacuagagcuguuccuauuuggccaucuuggaagcgaucucagccuaaacuaucaaaacuguuaauuuaaauuucuguuuugaaauuuauauuuggcuguuugacaaagauucugauuuugaaauacuauuuuuuuuuuuuuaauaucacacaucacagaguagaaggaagccucuuuuggagguuuagccaaauguuccugaauagcagguuuaaguguucucuccuuagucuugcagcucagugccaucauugguaaguggccauccccauucuuggcuuagguauagugaccaccuuuguuuaauauucggucaaaauuuaucaaacacuaaaugccgcacaguagucuaggcacugaggauacagaacauuaagggucacagacaacaaauaguagacauauauguuaucaagguaauuuuagguaguaauaaguucugcaaaagaaagaaauaggcuaugaaaaugggaacugggauaggugggauacuuuauuuagauugggcuggaaggguguaucuaaggaagagagaucuuucuuuuuuuuuuaagagauaaggucucgcucugucacccaggccagggugcaguggugugaucauagcucacugcagccccaaacuuccgagcucaagcauucuucccaccuuggccucccaaagugcugggauuacaggugugagcuacugugccagcagggccauuugaaaaauggaaaggagccagccauugggagagcuaggaagagcuuuuaaccaaagugcagagugucaaagcaaaaggcuaguggggcuggaggguggugagagugugaugugagguuggaguggcaggcaggggucagugaccuuguggggaacgauaacauucaggucuuauuccaagugcaauagcaaugacacaguuccauuccugucauaagucaguuacucuggcuggagaaugguuugaagcgggaagggugcagaauagaagcagguaccccaguuaggaggcuccuaggccaggugagagaugaaaugaugucauggucugagugggauuauauuuuggaagggagcccagaacaccuguugauggaguaggugugagagugagagaaauggauuaaucaagguugucuccuuuuugauuuuaggaacuggauggauuuugugagauagagaugccuugugggaggagcagguuuagugagagguguuugauagagcucugagugcagguguugaguguauagucuggaggugaggggagaggccugggcugggaagaaguugggaguuguaauagcagcgucauuuagagccauaggaucggaugagcccacuccaggagaaugaguguggauaggcauagaagaggacucagaaccaaggcuggcacaugccgguguucaggggcugccagagaugacagaaacggacacugaguuugagcauuuagggagggcagaggaaacauggagagccaaguggaagguguugcaggaaggugguuguggucacuguuacugaaggauacugaagggucaguggaaugaggacagggcagcagccaugaaguggaacaugguguagggaggcgcuuggcuccagagacacacugucugccuacaucacucaacagguuuguaauuguccuaguccauuugugcuacuauaacagaauaccuuagacugaguaauuuuuaagcaacagauuuauugcucacaguucuagaggcugggaaauccaagaucaaagcaccagcagauucagugucuggcaagggcuugcucucuguucccaagauggcaccuuguugccguguccucacuuggcagcaggagaagaagggcaaaaacagacuagccagccucaaacccuuuuauaauggcacuguucccauccaugagggcauagccgucuuggccuaaucaccucccaaaggccccucuuaauugcuaucaccuuugauguuaauuuccagcauaugaauuuaggagggacauauacauucaaaucauggcagugaucuaggccaaguuauggaaccucuuuaaguuccaguuucuucuguaaaauggauguuaaagacggugccuguuguuguaaggauuaagugagucuauacgugugaggauuaagugagucuauacgugugaggauuaagugagucuauacgugaagcacacuuagaauaguaucuggcccagaauaaauuguagcuauucgccguuacugucacaguggcauccgaugaccccugcucaauaaaaguagaauagagagaggauuccccaucucuggauuuaccugaugccucccuugcgcuuucuuuccuucuccauagacacauagcaggugggacuggucccaagguuuggauucuugguauaggaagcaagugguucccacuugaggcauuuugccuggauucuguuuuggaaauguucauguuugguugguccugaagucuuguauaaauccuacuuugacauguaaucuuuauuuuugauuguaguaguagaaaaaauuaaccauaguauagugaaaaaagcacagguuuuauagucaaacaaacuuugauuguuucucagcucugccauuuauuagccauguaucuuugggcaaguuacccaaguuaucuccuguguuaguuaggguucucuagagaaacagaacuaacuaauaggauagguacagauagaugagaggggauuuaggaggcugagaagucucaccaucugcccuccacaugcuggagaacuagggaagcugguggcauagcucaguccaagucugaaggccugagaaccugggggccgcuggugcaaguccugcagucuaacggcuggagaaucuagagcugugauguccaaagacaggagaagauggauaucucggcuccaggagggagggauggggcaggaggggugggggaugggggugugcggaggagagggagggagagagagaaagagggagaaagacaggauuugcuuuuuugcuuuuccucugcauuuuuuuuuccuaguucuuuucaggccuucaaccuauuggaugguggccgccgccccccccccccccccccccccccgcccauauugggugagaauggaucuuccuuacucagucuacugauucaaaugccagucucuucccaaaacacccucacagccaugcccaggaguaauguuuuaacagcugucuggguaucucuuaacccagucaaguugaaaccuuaaaccaaccauugcaccuccucuuuaacuacuuacuaaguugaaaugauaacaugcuaaaauuucgcaccuuucaaaauugucuguaggcuaggcuguuuuauguuaaggccuucucaugguuuauggcacaggguaggucgcccaugaaugauagcuauuucugauaaucuuugagcucuucugaaugcagauccuuuaaaaauauuuauauauuuauuuucuauuuucauuguuaaaacuguuacauuaaauccaacaaaaauauuucuaacgaauuuuagugcugcaaggguuuuaggacuucagaugcccuugauguucuggagaacucuuuugccuuaaaugauguuccuguucccuucuucuuaagauuugucuguuaccauugucucuuguuaugaggaucccuuccucugggagcugauugaguggaggcaguugugguaguucucagccuucagcaggaauuguaagaggucauuugcuucccagaagaauuguuacuccacuggaaaucagcaggaauauaagaauguaagaagaaaucagauuuuuuuuuuuuuuugagacggaguuuugcuuagucgcccaggcuggagugcaauagugcgaucuuggcucacugcaaccucugccucccggguucaagcgauucucccgccucagcaucccgaguagccgggauuacaggcacccgccaucaugccuggcuaagaaaucagauuuuaaaagaagauaggaauuuguuuuuaugagucagggugcuaccuguuuuguucugguuuaagaucacauuaccuuauuucuacuuaguauugccuuuuuuuuggauuuguauuacuuguugguuagaauucaguaguacugaaggaagggcccuuuugugauccuugcugaaugcccagugcguagugggcacuccauagauguuaguugaaagacagaaaauaaugagcuggaggaugguaguguaggcaugcccuagucauuaacuuuucuggucaucuuugaucugagugugcuguuguguaugugaaagaaaauaacacaaacgucuuuaaaacuuuugagagucuguucuaaauagcugucucgaaugccuuaucuuuuuguucuuuuuucagauuauuagacuauuguugauuuuauagaauuuucauauaaguacauuuuaaaaauggaaauaauuaaaaauauuguugcaaaaguguuuucuaaaaaaauaagaauuaagguaguaaaagagcacccaagaauguaggagauagaagauaaaagccaaauacauaguacucugcuucccacuuucucugcaagcuuuauuuggguagauauaaccugauuggguaaggcucuaaauaaaaauaguauuucaagcccaguggaaaucuuuuacucuuggaaaaauacaguguauauauuuuaaaaacuuuuuaacaauauaauuuaucaauaaauuuuauuuccuacagguauaaugugaauacagauuuuuauugguuucaaaaguuuauauuaaauugacaguccuaugagggaaggauauagcuugguauuucuccaaguguaucauuuauaaagaccuacguaaauagcuuacaguaauugugcccuaauuauuuagaaauuguguuacuaaauguguuuuaaauucaugcaucagauaucacauccugucuuguucaggggccuuaaggaaauuaucaaacacaaugcagucaucuuauuuaaaagguauuuacauuguaaauagaccggaagcaaguaaccuagcaagauaucugccuaguguccagcagccuugcaggaguuaaaagcaaaauuuaucagacaucaauaguuuauugaagaaauaguccuuuuugcuucauaauuugcagaaggcugcaacugucagucaugauguacugccucuugaaauuagucaauagagcaaacagcaagaauugcugugggcagaaaauaagcacuguaaucaugacauaacuggggucagugauuuauggauuucaauauaguaguagcugcauaugauugaaaauuuacuaggucacuagugcaccaaaaauuuuauucacagccuccaggcaucuuuugaaaugugcaacaaaauaaaaaccucugaaccuguuuugacacugcaaacucaguggaugacaugccagcccagugagucucauuuaaauguaaaugugucauaaacuuuuguaccaugcucuuuaaaaaaugccagcuacuugaagggauaaugcaugugaaacugauuuacauauuaaaguagugaaaaaggaccuuguaauaaucaagcuugaauucuuuuauuuuaaaguuggaagcugaagguguuccugaaguaucugaaaaauaugaaauuagcucuguucccacuuuucuguuuuucaagguaaggauaaaggugguacaagagauuauccauuuguagggugccauggggcuaccuauuuuguuucuuuacccucucucuaauccccgaauauuagguguuuggcuguuucuggcccuccaccuuucuucugauagucucauuuuugcaccgaugcugagaaagaagaccaugccagcugcuugccagcaucuuagaaaaguagcauggacuguguagggccagcagccagaaucagagcuucuugaucaaaauucagauauguggcuguggaaccccaguguucccugaguugguuaaauugguuguuuagagcaugugccuggacauaauggaaucucuggcugguucugguuugaugaaugacuuuuaggaagcaggugcacaccugugcuuccaggcacccaugggugucaucguaguuccccaaauaccucauuuauacuuaguaauagauucauuccagccaaugugggggcagucuuuuuuguauuauguuagacugaccugauuugacuuugagauguugcaguguuuucucaguguguuucugagaaaagaaaaaaauuauguauuucuaaaauugagaugcagugcaggcaauuggcaaugaggguuucuuuuuuuacaucuccgguaauacuguuguccccuuuaaaaaucugcuauaacaaugucauuauuauggaaugcugcauguauucuaaauaacuuuuuaaacuuuagaauucucagaaaaucgaccgauuagauggugcacaugccccagaguugaccaaaaaaguucagcgacaugcaucuaguggcuccuuccuacccagcgcuaaugaacaucuuaaagaagaucucaaccuucgcuugaagaaauugacucaugcugcccccugcaugcuguuuaugaaaggaacuccucaagaaccacgcugugguaagaagcugccuuuaacauaauauaaacaaaaugggugcuuucccagaaugggguaugguugagaugggcauccuguuuccaaggaugcuauaccauacaucuuauacuuguguucacauacuuuuagaaaaucaaaaagguuauaauucccaaugacacuauauaagaauuaguuugcauuauggacucagcauguuggaaccaaaaggggucucagaacucaucuaauucagauuuuuguuuuauacugaaguccucagacucaaagauagaggugacuugcccaaggucaccugguaagcagaguuaggauuagguuccaacuaccauauugcugucucuuuugccuguuuaucuacuuuugcuguuaacaguuauuuuuucuuucuuggcagccuccuguuuuucaccuaguucagauucagcaauuaaaaaauuugcggaauuuuucaguguuuuuguguccagccugugugcuuuugccuccccugugucaucacugucuaaugauucucuuccugcauugcugucauuuccaguuuauagcugcugguaauggaaagauuccgaauucuuggcuuguagucacucuuauuuucuguacacauggaugcuuauaauuuuguccuuaaguaaguuuuagaguuauuugaccccucugguaguggguuuauguuauuuucuuuuuacugugccuaguacaacauuaguaugcugcauaauugagcauuuaaugccauuugaugaugcuguugagacucuaagaguauuuguaucaacuacacaggagggacuuuauuaagauaggggcaguaacauugaguaugcucuugauaugauuacagcauguccagagugacuuuauaaagauagccaagcuucuagugugaauuugauucuaaauucuucccuguaggguuauuaaauuacauauuagcuuaugauaaugucuaguuuuaaaaauaaaguuucaugaugaauucuuauuuuuucgagauggaauuucgcucuuguugcccagguuggagugcaauggcacgaucucagugcgacggaaccucugucuacuaggggucaagcgauucuccugucucagccucccgaguagcugggauuacagguguccaccaccaugcccggcuaauuuuuuuguauuuuuaguagagauaggguuuguccauguuggucaggcuggugucaaacuccugaccucaggugauccgccugccuuggccucccaaagugcugcugggauuauaggcgugagccaccaugaauucugucuuaaaaguaucucuuaguucugccuaaaaaauuucccugccaguauuuaugugucagauaaugccugcuauuuguguauugcaaagcuaacuuagucuguacuaaacuaaagguagcaacagauagucucuguugcguuuguuauuuuguuuuuaacggggguugcaaaugguucacauucaccuucuuccaugaaacaugaaaauuauuucuuguacuuugugcgguggccacuaaaugggaacuuaccacuucaguugaauggauuguauucagcaccuucauucagaucucagguacaguagaacuggcugugaaaugugggugaagcacaccuacagugaaaucucuacaguauucucuccuuugggguugaacagcagcagucucagucuuuucugaaugauaaaccuaaugaaaaggcagguggcaacacugaagcuuggggaaggagugcucagaggagaaggauguccugggaagugugcugcacugggugucaugccaggcgagccucaggcccaccccugcggccuuagcaacuuuggggacaagucagguacccuccuugugccuuuaauuccuucuagugcuguugggaacaagauuggcuguuggagccaaucuuggagggccuuuucaguguagauauuguaugauuauucaaguaaauuagagagaaacuuagacauuuuaauuuuucugcuuaccuuuuacuuuauuaaacugaauuuaaaauauacugcuagcauuuuuauauuuauauuaaacuuauuuaaauuauguuuauuauaauggagugagauuuggaagacuguacaaauaacagaauaaaaaagaagcuuugaaauauuucagggcugggcgugguggcucaugccuguaaucccagcacauugggaggcugaggugggcggaucgcuugagaucaggaguucgagaccagccuggccaacauggcgaaaccccgucucuacuaaaaauacaaaaauuagcugggcaugguggaguccuguaauuccagccacuugggaggcugaggcaggagaauugcuugaaccugggaggcagagguugcagugagccgagaucgagccacugcacuccaguaugggugacagagugaaacucugucucaaaacaaaacaaaacacauuucagagccaucugaaaacguaguauuauaguuauuuaauuaauaaaagacaauaaauauuuugagauacauaugguugaaugguuacaguuucuucuuuuaaaguacuucuauauaauuuuuauaacuacauuuucaguggguuuuucuguuuccugauauuuucuguuucaugucuuucugucacauauaguaaauagaucauuuaagaauguugcuguucuuuaauaaaauacuuaggauuaauuggaaaauauuuuuaaacuguuuucuuaugggaacauaagucaccucgacccucugcuguuccuuucugagccugguuaguggagcauuguuuuugcucuucuucuggcauuuuagagaagggcguaggcaaagcucccuuuauaaaagcacuggccaucucaucuugugaacacgcacguggcugcucuuuccuuauuuugcaccaaauuagcuuugaaagugcuaucucugcuaacaccacugaacucccacugcggaguauuuugauguuuguuuuuugauuaguuuguccccaccuugcuuucugcuaaucagaaaaacaugaaugaauaacauuuaaauuuuauaucuagaaaaccuugaaagccauuuuuagggucucuccuggagccccacuggacucagccuaaccccugcacaggucaugucuccaucuucuuauccuucaugugggcucuaccugcagaauuguaugguguguuaugagccugacguguagauagggucucaguugaaaagaauuggauuguccuuacucugugcuccucaugaagaugggaaaaugcuuguuuuaggaagaguuuccagaagcacugagguauaugucaucuuaaacagaaucuuaaauccuugagcagguuaauuauuugggaauucuuauaacuauuucaguuaacaaagcuuuuagcaaagcaaaagguauuugaggcauagucagauauuccuucugcagugagagucauccagccgggcucuuacuuuugaaucagccacagaaucagguuucagagauguuuuuuaggguuuauuguuagguagugaugagaugcgguguuaggcaccuauucaugucaugaguagaaaugacuggggguggaaauggggauucuguggcaguuaaacauuacuuuucuacauuuaaauauuuuuauugcaugcaugcauuuuucuuaaaaaaagguguguaaauauuuuguuacuagaauaaagccuucuugccaucuuauccuuaagcguaacauuucuagucugccacuuuaacucuuaaaaaugaaacacuaccaaucaaucuuucuagucugcauguaauugccuaaagcuaaaauaaagcuucuucucagccaguuacaguaaaaaugaguuaauauauuggcaacagaauaaccaucagcaaucagccguuagcuguuuacuaaugaacucccagaugaauaaaaaaauuucagaaucaguguuuuacuucaggcuguacaugaacuuaacacuucagauguaggaaaagcaacuuauaugcuauacaaauaaauacuagugcuucaucucaauaaacugcagauuuggaaaauguuuagagcucacuuguagauccauguuuuaauaguaaauaugauuuugggugacaucaguaaagcccauucuugcaauuaaucuuauauugaauuuuaugguuugauuuuauuuaaaaacaauugcugacacugcuaagucuuauagaaauuuugaaucugaagaauagguucuuuuccagugaauuacaacuguguuugagaagaagaaugaggcgugaaagaguagggcccuacauaguauugggaacaauggagaagaauuagcuuauggaaagaaaaauacuuuuuuuuucagacuaggcuaauagguuuauaaaagacugauauucacacucuuauucuucaguuauaaugucauaauaagaugaugucaaaaaaguacagaauaaaaaugugucacaaaaguauaauaaaaucauggaacauaaaauugucgcuauaguguaguaaaaaaauuacauuacauacuuuagggaauguaaauaguuuuaaaaaagaaacugucaaguuaugacaugagaugagaaagaauaccgucaaucuauugaugguucauauauaacaacagagaagauagcuuuaaaauucaauguacuguguguauuuuagacuacaggagaacacaugccuucuugauuucuaauuuauccuacuuagagauagugaagauugagaacuacugaagugggaacucaggaaguaguaaaauggcaguagaaaugcaacagcauuggguuuuaaguauagucaaguaguaguuaaaaauaacaauuguagaauuuuuucaucugcccagaauugauucucauagauucauaacagaaaggcugggagggacugucagagcaucaggucagucuccugauuaguaggaaagugcugagcggaggccacccauggccucaucaugugucaccuugguggguggagggagcaggugucagauucagauuucugguuuuguuuaaagacaaggucuugcuuuaucacucaaacuggaggcuggagugcagugacaaucucauaggucgcuccagccucagacuucugggcucaagugagccuguugccucaguuuccccagucucugggauuacaggugugcaccaucacccccaggucucugcuuuuuggcuagugcuauuucuccugugacaaaaaauguccaugauauugaagaauaacuuuaauaaauacacacaccacuuuuuuuuuuuuuuucaguagucacaguugugucaaaaaguuaagucauaucugagugugugauaugguucaaggucaaauaaggggauccaggaauuuauuuucucuuuguauauuauucagccaugcuaauuaaaucaccagcaaaauaaggcaggcgucuaugucuuuuagaugauauguacgcugaacuaauguauuaucauguguauguguuuugggagagagaaguuaagugcuuuauuucuuuuuuuguguacagguuucagcaagcagaugguggaaauucuucacaaacauaauauucaguuuagcaguuuugauaucuucucagaugaagagguucgacagggacucaaagccuauuccaguuggccuaccuauccucagcucuauguuucuggagagcucauaggaggacuugauauaauuaagguuagaauugagaagucugugcuuuguaaagaaauuccauuuagagcauacuuuuuaaaauguugugauaaaucuaagauacaaauuucuuaugaaucuauauuuacuaauaagaaccugcaaugaauacacaguauuucugauuaguugauugaucaauaaucuguguuaugguaugaucaaggagauuuauguuauaauaauuuuuuucauaaaacugguaugugugcuuauuuuaggagcuagaagcaucugaagaacuagauacaauuugucccaaagcucccaaauuagaggaaagguaaguguuuuagaagguuucaaauagccuaucauuuaauauauuaaaaauauuuuaaaguccucagguuuugcauugcucuuucuguguagaaaucaaggauuugguaugccagacgucauaauuguuuagucacauuagccauucaaacuuuggcaaaucuaauuuguauuggagaaauuuuagcaccaacuuagugaucauguggaggaucugcuuugcuuuuauagaaaugucauuguuucuguggaacaaccaaguuuugcuuaccucucugcauuucagagccaggguccaguuguuuugucacugcuccuuggcguaaccucagcacacucguguuuuacugggugcagccuuggugacugcugcgggugcugccccaacgccagagcacugagugacaaguggugagugugaaaaacucaucaccucgcaacaagcuuugagcacuucucauggccuuucuagaccacgagaacuuacaugaacagauuuuggaggugugaaacauguauuuguuuuaucaaggaucucacuuggcuuuuagagacguucucuuacagaaauguuggacuuugguguguaaggcaacuuaaugggauuuuuauugcaguaaaauuaauauagaacuuuaaaaaggaauuuauuauaucagcaaucagccauucauaguuggggcuggagauuguaagauaaaccuuccuuugguaauuuuuuuuugccauguaacaucuugagaauuucuaaaaguguuuaauaauaauaaauaccucauuugucugucguuaauuaauaauuucuauaaacagcguccaauccacguaugucaggcugaucuuugagugccgcauucuguccugugguugguaccauuuccuguguucuucaugagaaaaugauacuccucaucccuuuuuugacucugggcgucuucaugugugguucuugccuguagccuggugaugcccuuggcccauggaggcuguguggucuccaaagacagcuguguuuuuuauaugcuuguauuugcucuucaguugauuuuccuucucugcugagugcacuugccgcuguuaauggccuugucuccaucagaccuccguuuccuaaugugcugcuucuaaaucugugcuugcagacaccaaaggguaacgggcuagaauuaugucggaaggaaaauucagcauauuuggaguaauaauuuaaagggcuccgagugagcagaguguaggaaguggaguucauggacuugugacauguauuuuggcaguacuuugugagcugugguucccuguauccaggugacuggguuaguuaguuggguugucagggucagcauuguauuccuauaucuguucauauuuuucugaacuugagcuaaucccacucgguuggcaauguaagugauacagcuuugugcgugauugaugcauuucauuugggaugaguuuauaaggauauuuauuauuauuuuuuuuugagacggacucuggcucuguagcccaggcuggagugcaguggugcuaucuuggcucacugcaagcuccgccucccggguucacaccauucuccugccucagccucccggguagccgugaccacaggcguccgccaccacguccggcuaauucuuuuguacuuuuuaguggagacgggguuucaccguguuuugccaggauggucuugaucuccugaccucgugauccaccugccucagccucccaaagugcugggauuacaggcgugagccaccgcgcccaaccucuaaggagauuuuugagcugugaauugggagaacaugguggcgugaccccauggggcuuagguucuuuagugacccguugucccagcacugacuuuucuugagauuugugacuaaacuuguggcuguauacagauaauuaaaauuccugacagcauguuagauuaugauguuugaaagacuauauaaaauauaaaacauguuaagaugagagaauuugauuuuaguaucuggcauuaguugauguucugagguuuaacgcugucacccugcaguccgaccuugugagcuuuacacguguacagugguaugcagcaucaugauggaagauggugcacacaagaucuaguucuggaaguuuuggaugggcuuaauauauaggccccuuauugaacaauuccuuacugaauugguuauuauuauuauuuuuuuauuacugugaguugaugggcuuaaauugcaacuugaaggaacauucguugccuuaaaagccauauuguguuuuacaguggcuuagggagagaaugaaaucaaggaaaaugucaacgcauuugcuuguuuaauaccacucaaagcugugaacugucauccugccaucccucaaauaugcauguuacucacgaagcggaggaaaagugguguugcauaauugagcugagccguuuuauaucaauuuucucucuuuaggcucaaagugcugacaaauaaagcuucugugaugcucuuuaugaaaggaaacaaacagguaaagaacucaaaaaugguuuuauuuguaauuucuuuugauguuaacaucugcaacaaggggacaguuaaaucuuuuuccuagcuuuagcuaaugaagcuguagcgauaucaggaaguuauccacgccuuaauuggugcuuacggagaucaaacaaaguaaucuacauuuugcuugacuuuaucaucaacaucucaguggggugcauuucuuucugcugccaaacuuugucagcuaauguggucaacacuguuaacacuuuacugguuguaugaguuguuaugucauuauccuuuguuugaguuuguggacugcugaagugugcagcugagucaguggacuuccugaaugcagggaaccuggucgugcuuggguuugcaccccuagaucguccuuuugugacaguggaggagcaaacccuggcuguagcaggugugcucuguguguuugaugaaugagugaaauggucagcaauucucauuuuuaaugggaugguucuuacagcuuuuugauguaaguacauauugauuaugcgucauuuugaauaucaaguuugauagauuacuuccaccgauaguuugagcagaacuaauuuucuuucagauugagaucagagugguaauuuccagaaaccagccauacacauuuauaucauauuuuguaauuuucauagcaauugaaccucuacuuaauucucaaucaguuguugaaguaggcaggguuggacagacuuuggccuguuuuagagauaaagaaaccaaaguuuugaaaggugaggcuguuggaauaaagaaacugccucacuuguuagcaagaugcaccgggcaagugacauggagaaccacuuugcucauugggaaagggacacaauacuucacagggcagacucugguugccauaacuaguguauaaguuaacauaacuaguauaaugaagcuaauuaguuaacauaacugguuaauauaauuagguaauaaugaaaguaacaguaacaaagaaaauguuaauauaaauuucagcauguuggaaacauuagguuagggccuaaauucuuugauuuugguucaguguauugaaacaauagaggaaguuaauaauuccuaguaaugauaaagugacauuuuuucuuauucucgguaaugguuuaaguggauauuuauucucaaaacuauuuuuuucuggaaaccuagaaaguauuaauacauuuuggaaacaauguuauuggggcuauuaaaauguugacaugguaccauaucuuuuccacaagauugcuggaauuuggaguccuguggcaugaaaaaagcuuaagauuuucauaaacucaaaaaaguguuaguauucuguaauguaaaaauaaaugaggcuggaugcgguagcucaugccuguaaucccagcacuuugggaggccaaggcagguccgaggucaagagaucgagaccauccuggcuaacauggugaaaccccaucuuuacuaaaaauacaaaaaguuugcugggcgugguggcgcaugccuauagucccagcuacucgggaggcugaggcaggagaaucgcuugaaccugggagguggacauugcagugagccgagaucacacuccagccuggggacagagugagacucugucucaaaaaauaaauaaauaaauaaauaaauaaauaaaauaaaaagaaaaaugggagucagaauccaguuggaaaugggaaaauaauugucauaaucauugcaaaaaggcuaagugaguuaagaucauuuugcaugagugaauuaaacaaugaacucaaaucucuguagaaaaucucgguuucacuuagaggaacuuuuugaccacagagaauauaaacuguuggaacacaugucaucucaagugguuacaaaccaaaggaaaaggaagucugugggucacgugugccuggguugauguguagauggguucguacuugaagaggggaugagcagaagcucugggagcugagugaaaguaguggcagcuaugcuggacaagugcugugcugguugacaagaguauuagguacaaccaugcugcuugggucauacaaaaauuguaaucuuugcaaauuuuuuuucauuuaggaagcaaaauguggauucagcaaacaaauucuggaaauacuaaauaguacuggguauguaaauguuguuuucaaaugguguauuaaaaaaauuccaaccuggccaggcguaguggcucacgucuauaauccuagcacuuugggaggcuaagacaggaauauugcuugagcccagguguucgagaccagccuggacaacauagugagaccccaucgccacaaaaaauaaaaaaauuagccaggcauggucacauacaucuaugguccuagcuacuugagagacugaggugggaggaucacuggagucuuggaaggugaggcuguagugagccgugauugcaccacugcacucagccugggugacagagcaagacccugucucaaaaaaaagaaaaaaauauuucaacuuuucaguucugccacugauacuuuucaguuguaaugucuauauccauacauaucuguaucuuucuuuauuuuuugcuguauuguuuugugaaugccuuaacuuagaucaaaauaguauuuucuggccagugucaaccuauuaguaacauaaaggaggucuuuaggccaccuuuggaauaacuauuugucuacuuucccagaggaaaauguauaacugaguccucaccaugcauaaagauauuucaggggaauauauuauagguaguuuuuaauuuuucucaaauauccuaguugcuaaacaguacagaaagcugaggggcacauauuaagguccauuaccuggaucugagagguagcacaaguuaaauugcagugcuccuaguuuugaugugcucaguggugaagcugucagguaagaacauugccauugauuuuugugguuaaaaacaaaagcacuuauuuggagauauacagcacauguucuauaggguuugucagauauuuuuguuuauuucucauuucaugauuguaucuuuuaaaaaucauguauucuaacuguagcuucaaauaaauuacuuucaaguaaucuuugauauacuucaaagaucuauugaaaauaguuaaauaguacagguugaauacaauuucagggacauaaaaagaauauagggccaggcacaguggcucacaccuguaaucccagcacuuugggaggcugaggugaguggaucacuugaggucaggaguucgagaccagcuuggcgaacauggugaaaccccgccucuacuaaaaauacaaaaauuagccgggugcgguggcgcacgccuauaaucccagccacucaggaggcugaggccuggagaaucacuugagcccaggagguggagguuucagugagcugaaaccacgccacugcacuccaaccugggugacagugagacucugucucaaaaaaaagaugugguugucgucuuuagauuacuaugacauuuuauagaagcaaguauagucaguuuauuguaauuguaacuucaagccuguuccuuucuucaccccugcccugggccauacagugggggcuggcuuguuuuuggucauuuuugauuuuccccuuucuuugucgacccucugcugcggguccacagugagacacacacaguccaucccucucuagcaguaccagguuccucaggugucuucugagccgacacacugggccugacucagcucgugucuuugguggaacaucuugguaacuuggcuuucugucccauaucugucuaaucuccauuguauugaaagcacccuguugucgcagagagcaggaggaugcuuugggagagcaugaccucccagcucuggacuugcuaagcgugauuggcccuaggaugagugaggccauccaggaccucagcuucgcuuaacacgagcagaccaugcucuugcugggcgccaaauguauguggagaaaacuccuuuuuacuuuuucucauuucuuaucuuuuccuuuaguagccaaaauacacaugcaugagugguugagaaccaaguguauauugagguuugaaagguacccuuuaugaauaacuuuuaggaaguauacuggcuguuaggacuccacauacauacacuugggcccagugcuuccuggauccuuuaugaauaguuguauaacucauuguuuuuaucacaguauuaagagaucugccaccuuuaguucaacuugaacaaagacuuacauugggguuuuuaaaaagcauuagguuuacauuggggucuuuuuuuguucuucuuucaaacauuccuuuuuugguaauugcuucugauuuaucccgucauuuaguuuuuuugacuguucccuguaccauagacaguuuccuugggaacuuguuuacuaaauaaacaagauuucccuaugaugguuucaguuuuauggaaaguccaguuuuuuuuacauguagcauuuucuuuggccaccuuugggaauugcaccuguacccucaggcacccugcaaggauuuaggcauacaugcuugcuaauaccugaccaccuaacggugaaaucgcucugaguggauacaguuggauauucaugcagugauuuuucauuuuuuguacaaguaauguucauuguaugguauaaagccacaaagcuuucauuggccuuuuguacauuaaaaacagcacccucucugaaauaaguuuaaguguggaaagcaugucucuugcuaagguggagggagcuggcagcgugguuguuauccggcugcugagcccuccagccuccguccacgagcacuacuacauccugcugcacgggcagcuuccaggagguuaagaagcagcagccugggguggguuagacauuagaaguggguaagaguguucaguuaaugaaggcucgugcagaugggggugugggucugauccagggguuggcaaguugcagcuggcugcccauuuuuguaaauaaaguuauauuggcacauagccacaucccuucauuuauacauugucuguggcugcuuuuaugcugacaguugcagcagagagcagaacugagcaguugcagcagagacugucuggccuguaaagccugaaguguuuagugucugacucuuuaagaagaaguuugcccaccccuggucuaacccaauauuguccggagaaaaauccagauaaagucauauguuggaaugacuaauucuguguaguaccagacagauuaagaaguaaaaucauuuccauuggucuguaguacauuuuguuagcagugaaacgguuuucuugauuauuuuaaaaacaucaaaugcauagagguuuuacacuuugauuuaacuguauuuccaguuaaaaugucuucucuuuuuugcaguguugaauaugaaacauucgauauauuggaggaugaagaaguaaguucuguguuugauguuucacccuugucuuagcuuuaaucuuaagggccugauaggaugguuucaggauuccuguuguuucuuuagguucggcaaggauuaaaagcuuacucaaauuggccaacauacccucagcuguaugugaaaggggagcuggugggaggauuggauauugugaagguaaggccaguucuucugcuguucuaaagaacggaaaagauuuugguauguuuaaaaaugauuucauauugaauggaaacuugagaguuguuuuugacuccuguuuccagccugacucucagacauuucuagaccaguaucaccguuucugugugcaugacuacccugccauucucacuguccccacguggcagccuguucuuacuuucacaccugagcuaaccauugcaucuccuuucuguggggugaucuucccugucacucaggguccuuguuagauccugcuucagcucccagacaacaaauuguuuuuucuugccuuacucaucugcccuugggugcauggagugacagcagugugaggccuguggcccggugcugcccauccuugccacagaggcugaggaucacugccccuggucccccgaaagaaaaaauguagguccuuuuugguuuugagaugcuuggaaaucuguuaucuguuagauuguguuuuagauaagacaccauuucuuauguaucuugaguccuuccugaugcuuuguguauuuuaggaguucaguaaaugguuguuggauggauaagugacuuuacuucuugauugaguuuuaaauggacguuacuuugcauguauuuaaugucuagaauucagggcaggcccaccaacuaacaccugugugcucuguagcucuuugauuagcccaaaacaauaaacagaagcuguagcuuuaauaucuacacacagaccccacugcaccccaggcccacugugggcaugguggcaucgaggagggugguagcugguuggguauagagaggagcuagacaggaaugcugggcaggaaugccagggucugcucaggggcaugaacaaaacugccccgaaaaguggguugcugacugcccucaggccuuccucuugccucaauccaugagagaauuuucugaggucagaucuucgacuuuuuauguggaaaacaaauagcaaguaguacuacuucuaguuauguuguaaaauaaaaguuuuuuuuuuuuuuuuacauuuuuuuuugagagaguuucgcucuuguuccccacuggagugcaauggugcaaucucggcucacugcagccucugccucccagguucaugugauucuccugccucagccuccugaguagcugggauuacaggcacccgccaccacgccccacuaauuuuuguauuuuuaguagagaugggguuucaccauguuggccaggcuggucuugaacugcugaccccaggugauccgcccaccuuggccucccaaagugcugggauuacaggcaugagucaccgcgccuggccaaaauaaaaguuuuuaacacgugcuuuuguaaagugaagcacuagccuaccacugaaaugacaucagcacuuuggaccaauauguuuuauaaaaacaaagcuugaguuccauugaugcagaggcucuuuuuguccuuugguggccucuguguagguuuuguuuccuguggaguuccagguuugauaucauacuucuuaaacaagccagugagacauuuuuccuggggaauggucucacuccuggaggaaaaaauuuuuaagacuauugcucuugaauagcccugaagcagcagaaacagaucugcauuuguuucuucccucccucccuccuucccucccucccucccucccucuuucucucucucucucucucuauauauauauauauagucuuauuuuuguaagacacaaagaauacucaaaccccaaauacucuugagccuguucuugucugaauguuuuauagccuguaccuuagccauugguaacucuugggaagauacaaucaauaaaucucauuuaauucuaaagcuaagcugcguggguaacuucuuuuuaguuauauaacagaguguuauaugauuuuuuauguucaccugcuaagaacauauacguuugaaaugugugauauuguuaacguuuuuccuugagaagauauauggaauagaucuuacgaucccauuuugaucuguuucuugcagaaugcaguucuucauguucaguucaauuaaaagauguuugaaauggucuaaucuggcuggccucuuuggagcaaugagcguuuguuuuguugaaugagggacugaaugaugauuuaguuacucagcuaaucuaguguccugagaaaauugugaguuguuauugccucugaagaguaaacgguucacuacugcuguuccagaauguuuggacuuaagacaguuuguugagagagauagaagauuugguuagguuuagacuuuccaccugccggcucgcauuaacagcagugaggguggcgaggacugccuuauuuggcgcgcucccaauguuccaggcacacugcuuuggugcuuuaagaggcugcuucacguaaucucccaagcagccucagagagcagaauucuucuuagucaguagaugaggaaacagagacauagagaggucaggugaauuguccaccaucccauaacuaguaagccauugaguccagauuccaccugagggccaccugcccuugcccacucagcugcgugguccucuccgugccuucuugagugugugcucagaaaaguccugcugggucccuuggaggggcagggugucugcuuguugaguagguagaagaagaucccuagacaugacugaaagccgucuggguuuugugugacagcaucauuccuauuugaauuucauccagaggaggucauacggauuuuaaugguuuuauugauugauguuuaugcuguucagugauaaccugaaauguuauaucauacuaaauguuucuuuaaaccagaaaaucuuauuuaucaugucuguccuuucaagcuuggugucuauaauccagauuuuaaaucugaaaaacaggcacaaggagcauggcgccuguacugcaguuccagucaaccuggugguagcucuuuugaugccaugucuguuucugaauuguuaggucuuuuuaaugguuucugccuuucccucuuacugguacucuagcuuuuccugaggcagagauguguugccagguuggguuucaauagcaaagccugauuccucucugugaguggaagaacgggaggggaacaagcaucauauuugaguagacuuuuaacgucacacugcuuuuuuuuucuuccuuuuuuucgagacagagucucacucugucacccaggcuggagugcaguggugcaaucuuggcucuugggucacugcacccuccaccuucuggguucaagcaauuuucaugccucagccuccuaaguagcuagaauuacaggcacaugccaccaugcccaccuggcuaauuuuuuuuuuaauagagauggguuuugucauguuggccaggcugggcuugaacuccugacuucaagugaucugcccccuuggccucuuaaagugcugggauuauaggugugagccacugcgcccagccacauuacuucauucuucaaccuugaaagucacuugauuuauuuuccuuauuuauugcuacaguuuaaauaggggcuucauuggcuccaguugcugcguuuccuaauacuaaacaaucuguugguuuuaggauaccuuaacuucauuuauuuauuuaugaaugaaugaaugagauggagucucgcucuagcccaggcuggagugcaauggcacgaucuuggcucacuacaaucuccaccucccggguucaggagauucucccugucucagccuccugaguagcugggauuacaggugcccgccaccaugcccaacugauuuuuguauuuuuaguagagacgggguuucaccauguuggccaggcuguucugcaacuccugaccucaggugaucugcccuccucggccucccaacgugcugggauuacaggcaugagccacugcacccagccuuauuuauuuauuuuuuaagagacagauuucaccauguuggucaggcuggucuugaacuccuggccucaagugaucugcccaccucggccucccaaagugcugggauuacauuugugagccaccacaccuggccaagaauaccuuguuaaauuuuuuaaccugauaguguauucaggguuuauggcucauuuaguuugagaguguuaagagacuggaguuuuaauccaauagguguuucuuuugguucucagauauacauacaagcugugauuguuuagauguuuccaucuuuuuauauaugcauauacauauuauuauuguuguuuuuuauuuuuaggaacugaaagaaaauggugaauugcugccuauacugagaggagaaaauuaauaaaucuuaaacuuggugcccaacuauuguaagaaauauuuaauuacauugggagcaguucaugauuuaguccucagaaauggacuaggaauagaaaauuccugcuuucucaguuacauguuuuguguauuucacaaugucgugcuaaauaaauguauguuacauuuuuuucccaccaaaaauagaaugcaauaaacaucuucaaauuauuaacaauaauuguaugaaaaaaguguaucuuuacagcaguauuaaacauacagcuacuauaauuaacccaccuuaaaucucuuuuucuuaguacaugaguaucuucuagcaguuaagaaaggcagucuucagaaaauggagaacuguggcggaaugcaguacacaacaguauuuaggacaacuccuuugccaacacaauggcuccccucgcuggugaaagaucucuuuacagcuuaggaaaaacaacggaaauuaguuucugaugucauugcugagcucggcacugguuacauugcagaggcaguguaggaugucugcagguuuagagacucauuucacaaggcaccaguagugaauuaucaagaaacauuuaagaggaaaaugauuucucauugaauaugguacaacaagcacuuuuuucauaaggucuagaagaauggguagucaugacaaagaauggaaaaguauugucauuuguuguaagcaucacuacuuuuuuuuuuuuuucagacggggucuggcucugucacccaggcuggagugcaguggcacgauuauggcucauugcagccucgacuucucggggccaagcgauccuccugccucagccuucugaguagcugggaccacaggcgugcaccaccaugcccaccuaauuuuuuauuucuuguagagaugaggucuccugccucagccucccaaagugcuggaauuuacagguaggaccaccacacuugguccacuuacuuauaauaaacauugauuuggucguucagguuccuuugguccuccuauugagaacaguuugaaguccaugaaaauuuuaacaauauuuuugauccugaaucuaacauauuugaaaaauaguugcuccacuaggcuuccacagugcaggcuucaaaugggauggcuaaauucaccucaugguucuuaguuuuuuuuguacuuguggcacauucucuucauauauuaccccacccuguuuguuugggcaguuaagaugcugguacugucugguggcgauaaggaaagggaaacagaagucaguaauucagacaagaauaaacaggaugaaaugcaucuauuccuagguaagauuagcccaccaccuccacacugcugcugucucuucagcucaggcuguuuuucu

SEQ ID NO: 15452 - RNA, 497 nt, Homo sapiens
cucuguaauuuuuuuaaauauaauccaaucuuuauuuaaaaaucuaaucugccaguuuagcguuuuccaccaacuuggggagcugaaacuuucacaggcuucacaaucuuuugcuuaggugcugccuuuguaggugccuuagcaguagccauugcagucuuuuuagaugcuugcuuagccuuuuuugcuuccuuagcagcccugauagcuuguucucguugagccuuucuaacuuaagguuucugauuccucuuggccauuauaucagcaagagaugcaccaguaauggcccucuggaauuugacugcuggguggguucuuuucuuuugaauuucuuccgacucucccuuuuugugcuuccuucuguggaggacaguccaguuuaucugccaaggauuccucuuggaaaggaaugccgacucgcauuucgcauuaagaaacucgaaaaccuucccgucgguccuggcguagugccuccccugucccggguagaucuu

SEQ ID NO: 15453 - RNA, 1413 nt, Homo sapiens
cagaacgcgugugggcggcccgggcggcgucuggcccucuccccauccucgcgcgccgcgccccagccccgggaugcugcuccggccccgcaggccgcccccgcucgcgccccccgcgccgcccucgcccgccagccccgaccccgagccgcggacacccggagacgccccggggaccccgccccggaggcccgccucgcccagcgcgcugggggaacucggguugccgguguccccgggcucggcgcagcgcacgcccuggagcgcccgggagacggagcugcugcuggggacgcugcugcaaccggccguguggcgcgcgcugcuccuggaccgccgccaggcccugcccaccuaccgccgcgugucggccgcgcuggcccagcagcaggugcgccgcacccccgcgcagugccgccgccgcuacaaguuccuuaaagacaaguuucgcgaggcgcacggccagccgcccgggcccuucgacgagcagauccggaagcucauggggcugcugggcgacaacgggcgcaaacggccucgccgccgcuccccgggguccgggcgcccccagcgcgcccgccgcccgguccccaacgcgcacgcgccggcucccagcgaaccagguaggcgggggacuggggggccagguggggccgaggacugcggaggaaccgggggcugccgagggcugcgggggaggggcgggcgcgccccgcgaaaauccgcccgaccgccugcuccgcguucccagacgccaccccgcugcccaccgcccgcgaccgcgacgcggaccccaccuggacgcuccgcuucagcccguccccaccgaagucugcggacgccucccccgcccccggcuccccgccagcucccgccccgaccgcccucgccaccugcauccccgaggaccgcgcgcccguccgcggccccggguccccgccgccacccccggcccgcgaagaccccgacucgccgcccggccgccccgaggacugcgcgcccccuccggccgcgcccccgucgcugaacaccgcccugcugcagacccuggggcaccugggcgacaucgcgaacauccugggcccgcugcgcgaccagcugcugaccuugaaccagcacguggagcagcugcgcggcgccuucgaccagacagugucccuggccgugggcuucauucugggcagcgcggccgccgagcgagggguccucagggacccgugccagugagucccggcugcggccagucuccccucuccaggccgaggccccuccgcccugaccccuccugcugccuucccacccccguucuuggguauguucaauaaaaggauuguuuuccuagaguccgggcuguguaggagugcgggucuggagacggggagggaguggcgcccugcagugcuggggcugcaa

SEQ ID NO: 15454 - RNA, 1413 nt, Homo sapiens
uugcagccccagcacugcagggcgccacucccuccccgucuccagacccgcacuccuacacagcccggacucuaggaaaacaauccuuuuauugaacauacccaagaacgggggugggaaggcagcaggaggggucagggcggaggggccucggccuggagaggggagacuggccgcagccgggacucacuggcacgggucccugaggaccccucgcucggcggccgcgcugcccagaaugaagcccacggccagggacacugucuggucgaaggcgccgcgcagcugcuccacgugcugguucaaggucagcagcuggucgcgcagcgggcccaggauguucgcgaugucgcccaggugccccagggucugcagcagggcgguguucagcgacgggggcgcggccggagggggcgcgcaguccucggggcggccgggcggcgagucggggucuucgcgggccggggguggcggcggggacccggggccgcggacgggcgcgcgguccucggggaugcagguggcgagggcggucggggcgggagcuggcggggagccgggggcgggggaggcguccgcagacuucgguggggacgggcugaagcggagcguccaggugggguccgcgucgcggucgcgggcggugggcagcgggguggcgucugggaacgcggagcaggcggucgggcggauuuucgcggggcgcgcccgccccucccccgcagcccucggcagcccccgguuccuccgcaguccucggccccaccuggccccccagucccccgccuaccugguucgcugggagccggcgcgugcgcguuggggaccgggcggcgggcgcgcugggggcgcccggaccccggggagcggcggcgaggccguuugcgcccguugucgcccagcagccccaugagcuuccggaucugcucgucgaagggcccgggcggcuggccgugcgccucgcgaaacuugucuuuaaggaacuuguagcggcggcggcacugcgcgggggugcggcgcaccugcugcugggccagcgcggccgacacgcggcgguaggugggcagggccuggcggcgguccaggagcagcgcgcgccacacggccgguugcagcagcguccccagcagcagcuccgucucccgggcgcuccagggcgugcgcugcgccgagcccggggacaccggcaacccgaguucccccagcgcgcugggcgaggcgggccuccggggcgggguccccggggcgucuccggguguccgcggcucggggucggggcuggcgggcgagggcggcgcggggggcgcgagcgggggcggccugcggggccggagcagcaucccggggcuggggcgcggcgcgcgaggauggggagagggccagacgccgcccgggccgcccacacgcguucug

SEQ ID NO: 15455 - RNA, 16860 nt, Homo sapiens
gggcggggcgcgcggaaaagagccucgggccaggagcgcaggaaccagaccgugucccgcggggcugucaccuccgccucugcuccccgacccggccaugcgcggccucgggcucuggcugcugggcgcgaugaugcugccuggugagugguuccagggaaccgucccgggcgcagcgcggggcaggguggcucuccccgcaggacgcgacgcggaccccgagccccuggccugcucgcaccccgcacccuggcccggcuucgggcuggucccugggagcgggccaucaggugcacaguggucucuggguggagagccccgggccggggaggccggggaggucggagggaaccuucaaaggugaacugugagagggaagucccgccucugagcuuguuaguggggucggggccgggccaagcaggacgcuucaccugcugcgcgaggcgcccuggguuccugggauucaccuguggggcuacccacccccacuauuuagccgaggagggaagggagggcagacaagcugaggccuggagugcaggggugugggcugaggggacccgucuccugccugggggaggacauggggcugcugacccuggaucccaccccugcuccuggagugacuugggcuggggugugcugaggagcuucaggcuggaggccggguugcuucccgccaguuuccugggcagauaggggcuggcugcuccccugcugccucuccagguuggagauguggucauggagacacguccacuauuguguuuuaaugggagcaaaggguccugggguugguggucuccgaaacccugcccauugcaugcugggacccugcccucugcucucggauaccagggaguuuccaguucuugggaggugaacagccuccgggaggcacuuccugcuccccaguuagaugcgaucagaugaucagaagaauggaggaggagaauggaaacgggcaggucggcggcccgaguccuccucccuggggggaagguucauccuugcccucgggccccuccagagaucugagacagccuggagaccuguggagucacuggcacccgcuggcacccacagcgucucugagcacugugugugggugcugcaggacacaggcccaccggccaugccugggggcgcuccuggggucuuuuaggcacagaacccucacuugagucuuugucccagagcuaucuggugaguuccccaggggagggucaagcccagcaagagacagaaucugagggcccaggaggccucugggaaggaaaccugccccccggccccucaugccugcugacccucccuccugcagcgauugcccccagccggcccugggcccucauggagcaguaugaggucguguugccguggcgucugccaggcccccgaguccgccgagcucugcccucccacuuggugagucuaagcuggccuggggagggucccuggcuggccccugagccuauuuuugugaaaggagcuuuagcuuacagaaaguggugagaggccagugggugucuggggcugcccuguacagcucuagcccccuggggcccaucuccguuccucccuccagcacugccugagggcucccagccuccucguuccuucaggagcucuauggaccccuggaagggagcaggggcagguugugcuggccccgggccccuccccaguuucacuuggcgaggcugauaagccaaauuccucuuugagaagugacgcuggcucaccgcagaguugacacaccuuccuguguuggggggggggccuggcggggguuucccagggcuagaaacugagaaugccccccuccccgacuggggcugcccgagggugauuccugaagccugagugggugggugugcacacaugugcacggcauaugcaugugugcaccuguuuccagggagggcaguuccggccccagcccuguccuuaccucagcauccggggaaccuacuaccgaccugcccgcugcccugggcucauccagccgguggcacagcuaaggcugucccagagcucugcaggccgagccccagccugcacaugggggcuggagaugcagugguccagcaggaggcucugcaggcaccaccagguccggcagcugcuggaagggauggguccuggaggcaggcagcugucgcuggaggggccugugcgugcuauccccgccacccaccuccuuugcugccuggcugaggcuaugccucccccacccuaugcuuucucggggaaggggcauugucguuacccaugcguggucagauggggaaacugaggccugggaggaccgaggagcaccguguccuuccugucuacccaagugcugggcuccgccggucgccuucagcacagccccguucccuacccuccacccuccaccccccgccccccacccucugcccuccgccccccgccuccacccuccacccuccacucuccacccuccaccuuccaccccccacccccugcccccuacccuccacccuccacccucuacccugccugaggcuguggacccuccaggauggagccuugaccuggggcuggaggccggcaccccuucccccccagcugagcuucucuggcccccaggauugaggugggcacagcccgggcaggcugcucaccugggacccuucccuccucgcucagggccugcacccagagagggugagcuacguccuuggggccacagggcacaacuucacccuccaccugcggaagaacaggugagugggucucgggucggccccccugcccgggccuggcuccagcacacugguguccccggcguccagccucugggccagccucucugcaccgagggggccgaggcagucacagcacuucuuuuccagggaccugcugggcuccggcuacacagagaccuauacggcugccaauggcuccgaggugacggagcagccucgcgggcagguaugggucgggcggagcagcugggcgggcagguaggggcugggcggcccuccccgagccuguggggccaugggggcacagccuguggaccccucuccugcuucccccgcaggaccacugcuucuaccagggccacguagagggguacccggacucagccgccagccucagcaccugugccggccucagguggguguggcggacgaacgccagggcucccgcagguggagaggaaggccuaagccugugguggggguggggaagggaggcagggagggugccuccuccucccacucaggccuuugcugucuugcaugggggucugcucaggggacgccaagcccaagaggcucacccuccuguacccuggggccugaagucaccugcggggggcugcugguggcaggguagggggagcuguaggcaacaaacuggagccucugguccuucggggcaggaccaggccacucugaagcccacagcacacccggcucccacuccccucagggguuucuuccagguggggucagaccugcaccugaucgagccccuggaugaagguggcgagggcggacggcacgccguguaccaggcugagcaccugcugcagacggccgggaccugcggggucagcgacgacagccugggcagccuccugggaccccggacggcagccgucuucaggccucggcccggggugagcacccuugucuccuguguuuggcuggcccugccgguguccacuugccuggccugugaguccuccuggcuccccaugugcugggugcugcccauugucugcagccuggagcaggccuggccacgcucccccagcacuggacaggggcuggacaguggccccgggucccugagggaggguccaggccccggcgcugggaaggcugacuggcuucuuguggcuguuccccaggacucucugccaucccgagagacccgcuacguggagcuguauguggucguggacaaugcagagguguguugggggcagggaaggugggagagcagccggcggcgggggcauggggggugugugggcuccagccugagggucucguguccccaguuccagaugcuggggagcgaagcagccgugcgucaucgggugcuggagguggugaaucacguggacaaggugggcagcgguccuggcugcagaggugccagagccccuggcgggaggugggggggguguugccacaggguucauuccaccugcuccagcucugccccgcaccugugccuggccccaccucgccgugggacaggugcauccuccgccacccacccucccugcuguaccuuccgccacccugccugacccccaggacuccaccaccucuccagcuauaucagaaacucaacuuccgugugguccuggugggccuggagauuuggaauagucaggacagguuccacgucagccccgaccccagugucacacuggagaaccuccugaccuggcaggcacggcaacggacacggcggcaccugcaugacaacguacagcucaucacgugagcuggcggagcgggcaggguggggagggcuggggagggagggcgggcagggugggguggaagggagagcagggcuggggugggagggaaguggggagggagccguguccagggcaucugugucacucccacuuccaggggugucgacuucaccgggacuaccgugggguuugccaggguguccgccaugugcucccacagcucaggggcugugaaccaggugagggggcuccugcccggguuugccaggccgaggccagagcuggauaggggaggggacgccucgguccaggucucuggagcaggccaccuccccucaggccagguuuaaugccugauuuuauguuuuaaggugguguuggcgggaagcugugccaaguccugggcccugguggggugaggguggcaggcguggggaguuggccacaugguuccugagagcacagacccuccugcaggaccacagcaagaaccccgugggcguggccuguaccauggcccaugagaugggccacaaccugggcauggaccaugaugagaacguccagggcugccgcugccaggaacgcuucgaggccggccgcugcaucauggcgggcagcauugggugaggcggccaggcccugcagagccaggguaugcuggagguacgagguggguggggaaggggccaggccgccucccccaaugcugccccgccuccccagcuccaguuuccccaggauguucagugacugcagccaggccuaccuggagagcuuuuuggagcggccgcagucggugugccucgccaacgccccugaccucagccaccuggugggcggccccgugugugggaaccuguuuguggagcguggggagcagugcgacugcggcccccccgaggugcguccaugccccauaccugcucccgucagcacugggugccacaaccucugucccuucaggccagggugaccacugcacauccacacguggaacuuggggcucuguggguguccagagcggucacagggagggaguggcugcagggcaccccaguggucaggggaggcggccagguccgcccuggagcccagcccggccccagugcagccugccaaggccuuugccgucgccccaggacugccggaaccgcugcugcaacucuaccaccugccagcuggcugagggggcccagugugcgcacgguaccugcugccaggagugcaaggugagugcagccucccaccagugacccccagagcccauggcuggcaggugggaagggacccuggggcaccagggaccaggcagcuugcguggaccuguccccauggugagcuguucucugcugggccaggugaagccggcuggugagcugugccgucccaagaaggacaugugugaccucgaggaguucugugacggccggcacccugagugcccggaagacgccuuccaggagaacggcacgcccugcuccgggggcuacugcuacaacggggccugucccacacuggcccagcagugccaggccuucugggggccaggugaagugggcacagagcuggccuggcaggguggcugcaggccuugccagggcuaacccgcuucuggucccacaggugggcaggcugccgaggaguccugcuucuccuaugacauccuaccaggcugcaaggccagccgguacaggugagcugagaccgcccugggcccaggacaugugcuguucccacagcggggucagccccagaagggccucugcaaaggguccugcucccaugagggucugcucuggacccauggaccccaggcucaagcgcaccguguugugggagggaggugggucacuguggcuccugggcuccccagcaugcucccaggcaagcuggcccacgaccugccguccauccacagggcugacauguguggcguucugcagugcaagggugggcagcagccccuggggcgugccaucugcaucguggaugugugccacgcgcucaccacagaggauggcacugcguaugaaccagugcccgagggcacccgguguggaccagagaaggugagccccuggcucagaggccgcgccaccccccaggcaucccgggcaugugccccacgugggugcagaugcguuucugagcuuggcagcugcucgaggccaugggaacagaguucucuccgcgcuucuaguagagacugaaagguuuccggggguggggagagacaugguucucaguucaucugauggccgucgccggcggccacgugccccaggagggccacuucccaggggcuuuggggguaggcagccggcagaugggcugaagcacagccaccuuggacguggugaccacagcccacccccagcuuaccaugcaguuucaagggacgcuggcggggcagagguccagagcggcugccugagagacgccuccuacccccagguuugcuggaaaggacguugccaggacuuacacguuuacagauccagcaacugcucugcccagugccacaaccaugggguauguguggccucucgggacagggccccugcacagaggcugccgcucugagggagccggugcuggggacagcucuggacacgggagccugaggcugggggagccuggcguguccuguccaugggggucucuguggagccccugucggcugaggcccggccuggguggccuccguggauggaaccugcauggucaccgggcagcgggcaggggcuacauggagaggccucgccgucggcgcaugugggcagggaccgaggggcccucggggguggggcuggcccggggcccucaugcuggaggcacggcccccacggccccuugggguccacaacaggguuggcccugagcccagccguccccgcaggugugcaaccacaagcaggagugccacugccacgcgggcugggccccgccccacugcgcgaagcugcugacugaggugcacgcagguaggccucccuggccagcgcagguggggcugggguccaagcucagagggcccgaacagagcccaggcagaagccgcgggcccgggaagcuggugguguucacggugccaguuugcugccacaggcaucgacacacagguauaggcagagccugucuguccccaggcugaugugaggaggggagagcccugucccagagggaggcaguggccgagggcagggcacggccgugagcugagacuccaguguccucagccugugucuuccagccccuccucggcccggggcccugaggccacccagcauuuccuccccggcggccacugagcauguggucguccagagcaucaggccucaaaggcacagccgugcccacagcacuguggcccagggccacccugccaagcucuccaaccugucacuggcaagcugggagugccaguguaagguaccagguccucccugagggguccacagggcacagccugggggugcugagaaagaccgugucucugggaaccucccuggcuccugccugaggucgcggccugccugccugauguggggccgugugucccacagcguccgggagccuccccgucuucgugguggugguucuggugcuccuggcaguugugcuggucacccuggcaggcaucaucgucuaccgcaaagcccggagccgcauccugagcaggugaggguggugggggcugugacggaggguggcgagugcuucccgugcucagcugccagaggaaggagugcccagcacgggcccaugguggacggcacggacacccaggcuccucugugccccgacgucaugacgccccccggcuugggcugaguuugaagggccuuccuggcuccacucggccagugccacucuggacuccaccuuccccugaggcuggggcggggcaugguuuugguggccgguugggcuuggggcaaauccagagaggcccgguggggucccccauacccugacccagccccgugagcacccugccaguuuccugcugagcccugcucuagggaccuggacccccacacagcaggagacccccacgcagcaggacacacuggccccacagccuccaagcaucucccgcccaccugacuggggcccccaggacauggagggggugucccugccucuucaggguccgccccaccuccugggccugucugucucucauggccacaaccucucgcccugaagccucucgggucggcuggagcugggagggagagacucaggguguggugcuggggccccauggccggacacugaccaugcgcccugugcuuccuccccaggaacguggcucccaagaccacaauggggcgcuccaacccccuguuccaccaggcugccagccgcgugccggccaagggcggggcuccagccccauccaggggcccccaagagcugguccccaccacccacccgggccagcccgcccgacacccggccuccucgguggcucugaagaggccgcccccugcuguaagcaccaccccuggcggguucaugaggccgaaagcagugcccaggccccauccugcgaccccaagugcagcccgaggccagcagagcccuuucauuaaauucacgcacaggccagcgguggccccgaggcccagagcagcugcuguggucgcccugcugggaacacugaggcuuugggagugggcacuucccagaccccuuugagccaugauagaaucugagcuugaacuuaaacuugggggcucccagcccagggaagcuuccuggccuccacagagcccaucugaggacagugucgagacacaaaugcucuccggcccccagcucgggaucacacggcugaggggaggaauggggcggggccucucaucugggguggggcccugugggccgcgcagacgccuccagcacacacaagaggcaggaaccucggauccuggagcugggggugcuggaggggcacgggggucccagcucugacccaggcucucggcccugucuccuccagccuccggucacuguguccagcccacccuucccaguuccugucuacacccggcaggcaccaaagcaggugagcaguggugauugggcggccaagccuucugaggguguccaggccuuccugaugggauuggggucugugcacugcaccgggggccagggauccccagguggccccugcuguacacagaaggcugguuagcccgaccucgugaggacaucagacagaaaggcaggucagcgaggccacaggaaggcaggagcucaguccugcccugcguuggagcugguuuggggguccuggcuccuucuccuuccacucagaccugcuccgcccaccaagccccucccagagcugaagcucuggcagagaagaggacucccuggggcccugcaggacagaugggugggugggcucagggcagggacacguuccgcgcuucccuuggguuugggggcuuuggggguuuuggaaagaucucucaaaacccgaaucacuggagcccuggcaugcugaggguuaacucccaggccuccguguccccccaggguugggguccugucccugcgcccuggcucccaccucugggcuaaccuuggagcccuuuuuggaccccgugggggcagcucauuggccucagcccugggaaaccgcucuggcaguggguggagaaggacccuugagcucccuuccuggggccacugacucagcuagggcagcagaaagggccaggcuuucucucuggggccuggcacggggccccagugguaccaucgagguccacuuggcauugcgggacauugugagcagccucuguccucagagagggcaggacgguggcgggcaggcuggggcuggggaggugccugugugaagaggucccacggugcaucuccggggacccccuccacagagguucguggucagcccuaggacugggcugugcauggaagaccuggggcaggagagccccugcccucuggguugaggcuuuuuuuuuguuaacauuuaauuuugaacaaauuuuagacuuacagaaaaguugcaaaaauagccuagagaauccugcaugcccuucgccuggccugcucccgaauggccacagugugggcgcgcagccgaggcuccacgucaccaaugcgacccagucaguaccgccugcucccucuggacgcccuucuccagccaugguccccccaggcacucagcccccggccccucugccuuuccucagcuugcccuuuggaaguguggccagcaguguuuucagagucccucagccuggguuugucccgucuuuccuuguguggaugagggcccugcacuguuggcgggggcagcacuggacacacccuuccccaggcacagcccaggccuggcccacaugcagcuucggucacgggggauguugacacagcgccuaguuggagcagcguccacagauuuuuccuuagaaagcuccugucuucuuuuuauagugagcagaugccucagggagauaccuugagacucuuugaaccuuaagcuuggacccacuaguuuuggcauccauuggugaauauuggcugcaauaguuguucugugcuguuugccuaauagugauuuucucucuuuuuuuuuuuugagauggagucucguucugucgcccaggcuggagugcaguggcgcgaucucagcucacugcaaucuccgccucucagguucaugccauucuccugccucagccucccaauguaucugagacuacaggugcccgcgaccaugccuggcuaaauuuuuguauuuuuuuuuucaguagagacgggguuucacuguguuagccaagauggucuugaucucuugaccucguaaucugccugccuuggccucccaaagugcugggauuacagacgugagccaccaugcccggcccuaauagugauuuucuauuucucucuuuccuuuuuaacuuuuuauuugaacuaacuucagacuuguacgugaguugcagaaauaguccuagaaggggucuggacaggcaaaaugggggccugaagggggcagagagauuucuggccaaggaaguuaugguuaccaggcauagcaguauauggggcagaggcugcagcaggagccgggcguggugguagauggggcagaggcugcagcaggagccgggcguggcgguagauggggcagaggcugcagcaggagcugggcguggagguagauggggcagaggcugcagcaggagcugggcguggagguagauggggcagaggcugcagcaggagcugggcauggagguagauggggcagaggcugcagcaggaacaggcguggagguagauggggcagaggcugcagcaggagcugggcguggagguagauggggcagaggcugcagcaggagccgggcguggagguagauggggcagaggcugcagcaggaacaggcguggagguagauggggcagaggcugcagcaggagcugcgcguggagguagauggggcagaggcugcagcaggagcugggcauggagguagauggggcagaggcugcagcaggaacaggcguggagguagauggggcagaggcugcagcaggagccgggcguggagguagguggggcagaggcugcagcaggaaccaggcauggagguagaugcggcagaggcugcagcaagagccgggcguggagguagauggggcagaggcugcagcaggaacaggcguggcaguagauggggcugaggcugcagcaggaacaggcguggcaguagauggggcagaggcugcagcagaacugugcaggagggaagucacucacucuucacucucacgggcuuccccuggcugcucaguaggguccuuuggaagcugcugaaaacugcaaaugcuuagcccacccaggcuccgugugacacagccaggagugagcuccacagcucugugugguggacauccagccucccuacccugggaaagcugaaaugcaaagaaacacguguuuuaguagcuaauuauuggccuuugagcuuccaaaaccccacauuccggcaaucuguagagcucuucaggccaggcgcauuggcucaugccuguaaucccagcacuuugggaggcuggggcgggaggaucacuugagcccaggaguucaagaccagccugggcaacauagggagaccccgucucuacaaaaaauaaaaaauuagcuggguaugguggcuugugccugucgucccagcuacucaggaggcugaggcgggaggaucgcuugaacccaggaagaggaagcugcagugagccaacaucacgccacugcacuccagucugggugacagagggagacccugacucaaaaaaaaaaaaaaaaaaaaaggaaaggaaaaaagcucuuggaggguaauauggggguugguuaggggauguggaugguguacugggcaggugggcccaggauggcguucugccacugaugggcuuuauuccugggcaguggcagccaggagggcuuuucuguagcgagcucagugggggcggagccugcaggcucccuggggggcagagcgaggucuguggggagcuucguuccagguccagagaaggugauguccaggcuagagccgggagugccugggggacccaugucagcugugucuguuuccucccaggucaucaagccaacguucgcacccccagugcccccagucaaacccggggcuggugcggccaacccugguccagcugaggugaggccccagcacacaccaggcagaguccacugugcaauggacggcacggccuccccacggggcugacgguggcacugcccuggagggugggguuuuuuucugauuaucuguggauaaacuugggugacugaaagaaaagggaaaggcauuggcaguggcuguacugugguaucugugcugugaucaggggacuucucagcagaugccgaccccggcugucaguggugccugaccuucccccagcaacugcagggaagaaagucuguccucugugagcuguauauauugugacugccacaccugccauugugugcaugggccauguuguugguggaugaaccaagaauccacauuuuaagagauguuaaaggacguaaaauuucguuguacccuuuauauaccuuuuauagcagguaguuuuucaacaucaauuaucuuuuccuccucccagggugcuguuggcccaaagguugcccugaagccccccauccagaggaagcaaggagccggagcucccacagcacccuaggggggcaccugcgccuguguggaaauuuggagaaguugcggcagagaagccaugcguuccagcauuccacgguccagcuagugccgcucagcccuagacccugacuuugcaggcucagcugcuguucuaaccucaggaaugcaucuaccugagaggcuccugcuguccacgcccucagccaauuccuucuccccgccuuggccacguguagccccagcugucugcaggcaccaggcugggaugagcugugugcuugcgggugcguguguguguacgugucuccagguggccgcuggucucccgcuguguucaggaggccacauauacagccccucccagccacaccugccccugcucuggggccugcugagccggcugcccugggcacccgguuccaggcagcacagacguggggcauccccagaaagacuccaucccaggaccagguuccccugcgugcucuucgagagggugucagugagcagacugcaccccaagcucccgacuccagguccccugaucuuggggccuguuucccaugggauucaagagggacagccccagcuuuguguguguuuaagcuuaggaaucgccuuuauggaaagggcuaugugggagagucagcuaucuugucugguuuucuugagaccucagauguguguucagcagggcugaaagcuuuuauucuuuaauaaugagaaauguauauuuuacuaauaaauuauugaccgaguucuguagauucuuguuagaucagcggggaaggauggagggcuucaguucacgagauacaagggucggcgcuugguaaaaugcagacugcgaauagaugaggucaagccaccuucuuuucucccuggauuucucaggcccuccccagcguaacuaagcagucccgccccucccgcgggcagacgauccgauccaggaacccacgcccaagaagacuucgccgcgaugcacggaggagcccgcgcuaccccugccccgccccgucuccgggcaauggcccggccccgcccccgccccgucucccggcaacggccccgcccgcgccccgcccauuccgucucgucucccggcaacggccccgcccgcgccccgcccauuccgucucgucucccggcaacggcccccgcccgcgccccgcccauuccgucucgucuccuggcaacggccccgccucuuccggccccaugcccuuguccgggccacugccccgcaccccccccgccaugcugggcucgaccccggccccgcgcggccuccacgccuggcuggacgcgcucccgcucagccacccacgcgccgccuggcccgggaccucagcuauggcggugggcgcgcguccgcgaagucguggaguccgaggggcccccgcggcaggggccugcgcccucggcccaggagaagcggcgaauggcccgcggcgccccucccgguugcucgcugacccccccgcccaagagucuggggcugcgaaccccgcuucgccuuugcugcauccgacucagccuuucagaucuguaggauccgggacuccaguguccgacuacagggcggggcucacggcccacacgcgccgcaguaccccgcccgaugcgcacguucccucugggcacccccugggagcguccccguggugccaggcuggcgcgcuggccucugaggagguggcuucugcucuaggcaccugagcagcaagucugagugggcgcccacggggcggaggcuguuagacgcaucuggugcugcaccgaggaggccugacguccccuguggccaagcccccacacccaugggugcugccuccggguggcuccuccgaggcagagcccugagcugauagcgcccauucgucucgcaggccugccacgcccccagcucccuucagcacgaagaaugagagcguucuggaggggacaggccacugcacuugcagaggguggguuccugucucucaagcccauaccucccuuccucccgaucuccccagccuccgccgcccaccccauuuccucgacaguuggauucaaggcuggugucuaccuuguaguggggacccagccgccgggcgccagagcacccagaccccggaguccagcagcuacuggaggacaaggagcaggcgcuguccuuuccgcaggagacagucagggugcaggcgaccuggcacccuuguugccgggacacccuguggcugaaggacugggaaacagggccugugcggagccuugcagagagggcauggccuucauuuucuccagcccuccccaaaaugcagacauuugcugaguaccugugggcaccagcucuuaucaccuggcggugcuggcuggcaagucugccuggcugcccuccagccagagccgagccccuucucccauccccaaaugcacagaagacagccagagagccaggguccugggcagcaccugcccagcccaagacuccacaugagcacuuagauaugcagugcacaccuggcucucugcacacaccugguucucaacagacaccuggcucuccaugcacaccugcucucagugcacacgcggcucugcaguguacaccugacucucugcacaccugacucagugcacacccggcucugcagcgcacaccugacucucucugcacaccugguucucagugcacacccggcucugcagcgcacaccugacucucucugcacaccugguucucagugcacacccggcucugcagcgcacaccugacucugcacacuugguucucagugcacaccuggcucucucugcagaccugauucuccgugcacaccugguucucagugcacaccuggcucucucugcagaccugauucuccgugcacaccuggcucucucugcacaccugguucucagcgcacaccugcucucagugcacacgcggcucugcaguguacaccuggcucuccgugcacaccugguucucagcgcauacccagcucugugguguaaaccaggcuugacaggcucuguggacccaugccuggcucugcaggugcacaccuggcucuuucaccaggggucuccaguuuuccugcgugcaggaagccccuugccauaccugccuccccc

SEQ ID NO: 15456 - RNA, 4804 nt, Homo sapiens
ccagguaacgugaacauuauucagccuaacuauccugcggcagcccgugacuuccugcagacuuuccgccgugggcugcuggguuccgugaugcuggaccucgacguccugcggggccaccccccggcugagacuuugcccugaacuuguccggguagggagggccggaggcauguggccucccagaccuccugaccugggugguugaggcucaagacagcucacccgguccagaagcuccaugcuggucacuagggugcugugcucucuggcgccccacagccuggccagcuccagggaccccaguugcagggcccaagcaggugggaguggacaccaggcuucccaguggacgucccugagcagcuccgcaugcuugguucucccggagcuuccugcucaggccucuugagaaauggaugcugucucagaaggaguuaaagcuauaaccuguaaccuuuaaaaucuccaguuaaagggccuguuucuuacuggccugugaggugcaccguagugccuugggccuguguguuaaagcugcucucaccagugaaaccuaagaaaugagcagguuggcagcuaggguuuguguuggaggcuuucgguccagugucuugcaguccuacaacaagugagaggcuugcugccaucagagagguuuauuucacacuuacaggcacacacagacacagaccagagacucccagcagcagagcccaagcacuggcuucgccccucagugcccuggggcauguucagggcaggguugagggggacgcccugcacauggcuuugcugugcaaugacuggaaggccgcccggcaugggcaguagagaccccuggccucugagcaccuucuagcucacggguagugggauucugcauuaguggggcugagagaugugggggccccuccagccccauuauagugcaccugaagggguccacagccuguguccuagaagagggaagaggaaggaagguggguggggcugguaguauggacuaaggugcugcaggaccuggggccagggacauccugugcagaagcuccggcugccucuuugcggugguggccugaccgucccacagcagccuccaccagggcccuggugcucaguggccccucuuugcuggcuggcugccucugcugccccauaccccacacacucaucagccugaaguuagccccugagugccaccugcaucgugccauaacccugaccgccuggggcaggaaguauucagguuggcugugucagaugcuaaugugcugaaucaacagucauugcagaucacgaaguguccaucauaacuggaacauuccaucagcuugcagugcuguggugugugagggucuggugcagcucagcccauuuuccaggugggcaucugcaaaguugagggggcuccggugggucucucugcugugaggagacucagaccacccccugccuccugggggaaaugucagaagggcuucucugccuaugaggaucuggggcagggcuuggccuuggccugcuggucuuggaggcguugagcuuggucuggaagggguggaggagcgucugggcucacugggccaggggcauugcuggcaguguggacgggaggcugcagggcgcugccuccuguggcuuagugcccuggagcuagagagcagugcuugguugaguccugccaacagcuuccagauccucacccaggccagaacccaggccagcuggggaaggcagaggcuggcagggcccguggugggugcuggucuugacuuugguguccacugagucccgaggcucaggcccaggagggaugcaguccggcugagggcgaggcuguccccaggacauggagagggugagaucccaaggccacggcggggggcagggagaaccccuccuacccuggaugagugggugacuggagagcuagagaacguggcagacccaagaccucucagugcugagcccauggaggaugccccaggcuggcgggacugggaagcagagggcuggucuuaacacagguguguccagugcuggaggcaaguccuugucgugacuguccagcgccacuccaugucucuccuguccuuggauguuggggggcucagccucuugcauggguguccugcugggcgcugggccccgccacuggcccccugcuugcuuuggggucugaguuagcuccuggcuccacugagcaggccgucagcugccagcccaccacgcggauacccaggcccuguuccgaggccuggaacagcugcuuccgaagaaggggcugccuucagggaaaugcgugcaccgugcagccugugcugugcccagggaggccucuucagcgggauuggcaguugcugugcccugagaacaggcagaacugugugaucccugaaugugaaccugaaguucaaaggacuuggaaagcucuggaauguguugguuuuucccccccaaaauggguccuaaggaggguaaagugacuuguuucaaguuguuggagcaaagugggucucucacggaucucggccugagggugugggggagaaggccuggacagccccucagggcaggguguguuuucccaccagccgcagagagccaggauggacguuccucggacggacgguuuuccugcuugggaauguuccugggcugugagauccacucuucugggcaggugguuagcaccuaacguuuuucccucacuuccccccaaauucuuaaguccuuugguccauuucacugcuucuuuuggggagggucagauuccucaggggcucaguggcagaaccagccugaugucgccucccugcccgugagucaccacggccccugggcaggcgaggggagccgggguggcuuggguuccuggccuuggcaccucccuuugggcggcgauggagcguggcugggcgguugguacaggagccacaggcagcugccuuuuuggcugaggggacccuaacauccuggaguggguggggcagggcccauggucuccucuaggugggagguggcaggcugaggcggcgugggcaggacgguggauggcggguccacagggacagccagcagcuccugcacccaguggggcuccaagaccgugggcaagggaggaagggggagcccaggccggaggauccugggggauggcgcgggccgggggccagaugugguccccgagcccagccaggccuagggccgcagcagccccagggcuccgagggcgccgcccagcacgagacagagacgcgggccgcgcguggguccagcgcccgaaguccacgcccgguagcuguagaugccggggccugucccguugccuccgggcaccccguccuccucguccuccaggccgcguuccccgggucccgcggcccuucuccagcccgagcccgccgccaggcccgcggccgcucccgccgccgccccggcugccgccccggcggcagccacgcgcagggaggagcccggggcaccguagcgcugcgccggccucacgcgcacccucgaggccccgcgcgcacccccgcggaccccuccccgggcacugccccgcgcaccuccgcggccgcccuuggcugcgccgcugucgcagaggaaggcggccgccaguagcagagcccagcacguugcgggugcccaguucaucuucguggggcuaaaccugcgggaagagagggaaagggcccuuaguuuccauggagaucgggugcccaggggcggagggcucaaggcuggagagcagagggacccccaucuuuugugggaucagggugcccccagcaucuuggaggcccacugaggccugggggggcgcgguuuaaccucuagcaucagggacuuaggccugggggaggcgcugggaaguggcagguggggcaggaggguucugcaccugaagguugugcaccuggauuggggguguagaagcggggcaggagcguucaggccucugggggcguccaggcccgggcgggggagcaagccugggggagggagcucugcacgcguugcugggauguggggggcggggggaggcggcauggggggaggggcguuguguuuggaggacgcgguagccgggaccaagagcuggcucagaucagggucuggaacggggacgggccgugccugggccugguccccaccuuuggggccaaagccugggugcgggccuugcggaugcugcggaggacaagcggcugcugacaucgugcggacuccgccccagcagacccgugccccaggggcagucccucccgcgcgcgcccggcgcucaaugccguccccggccgccuaguucagcagcuggcugggggcgggacggggucgaguugcggggccgcguccagacacggcugugcgggcgacagcugcauccccuccccgcgccgccccucgcucccggccccguacccgccccagccucccggccuuacccgccacgggccucgguuggaaccgcgcgcuggaguauccgucccugaggccgcggccgagcgggaaggagcgggcgggcggcggcgcggacccucagccggagcgcggagccgcggcgccuggguuuugcgcgaggccuccgcccugggauuggggcgggcagucgcggaggcgcaucccuggugagccggugggaggggaaaaggaugucgcgucccccauccuugcggccucccguccuccgucaccagcccccuccgucuccugcaucacaaggccccguccccgcggucccccgcgacccccgcacccggccccgcuccacccgccgugcuuccugccccuccacacc

SEQ ID NO: 15457 - RNA, 894 nt, Homo sapiens
uucuucagagcuuccuugaccucucgguuucuuaggcaauaaaugaaaggguugagagaaggagugacaauggcauagaagauggaaauaauuuuguucauguugaaggcauggauaacucgaggucgagcauacaugaaaauaauggcugaauagaaaauggugaccaccacaagaugggaggcacaaguggagaacgcuuucugcuuuccugugggcaugcauaauaugguggccagaaugcauccguaggacaggacaguaauaaagagugggaauaggaagaugaccagugccaggauaaagucuaccaacucaguuauggacaugucugugcaggagagauuaaguacuggagagaugucacagaagaagugguugaugacauugggaccacagaagcugaggcaggagaugaaguagaucuucgccagggagaugccaaagccaauggcccaggaaccaagagcgaggcggaagcagagcccauggcucauuaugguuggguaguggagugggcgacagauggccacauaccggucauaggccauggcggccagaagcacacauucugugcacaugagagcaaugaagaaguacaguuguaucauacagagugugaaagagaugcuguuguucacagaccaaaaacuaaacaguaacuugggcacagucacagagauguaccaggucuccaagaaggacagguuggccaggaagaaguacauaggcuugugcaguggccgauuuugcagcaccaauaggaugaugaucacguuuucagccacugucagaauauaggccacaaggaauaucagaaacauggcugcccgcauacucaagcucccagggaaucccaccagaaugaacuuggugacucgugucugguucucc

SEQ ID NO: 15458 - RNA, 248 nt, Homo sapiens
agaugcugauggaaaguuaagcgugaaauuugggguccucuuccgugaugauaaaugugccaaccucuuugaagcauugguaggaacucuuaaagcugcaaaacgaaggaagauuguaacauauccaggagagcugcuucugcaagguguucaugaugauguugacauuauauuacugcaagauuaaugugguuuacauaucuuuauguacugccauuuuuuguuucugguaaacuggaauauaaagu

SEQ ID NO: 15459 - RNA, 980 nt, Homo sapiens
cuccacuaaaacugcagucuccaaggacaaaaacuucagaagacacaaguuaauuucugaagaaagggaaaagcuuccugagggcugcuuugaccuccuuguuucucaaaguauagaugaggggguugaggguaggacucagcacaguguacagcaggccagccaacuugcucuucccugcgcuguagccagagaccgggcuuauguaggcguagaagacagcgguguaauacaugcacaccacggugaggugggaagagcagguggagaaggcuuucugccucccccaggcagucuucaccuucaggaugcuggagacgaugaagccauaggacgcgauggucaucaggaaguucacuaugccguagaaagcauccgccaggacaaucaugacaccguugacguagguggagcugcaggagagaagcagcaggggagggaccucgcagaagaaauggauaaugacauuggggccacagaaauccaagcgcagcaucagccccguguggauggccguguugacggcgcagagcagccacacggcuguggccagcccgcugcagaacaccuugcucaucaugcugcuguaaugcagcggguggcagauggcugcguaccggucauaggccaugaccgugaggagcagcagcucugaggaugcagcccacgugaggaaauagagcugggccaugcagcccccguaggagauggagcucucuuccgacaccagacuggccagcgccuugggcaugauggaagaggugcagauaauguccauaguagccaaguugaguaagaaaaaguacauaggagcguggagcccaggguugaacgugauggccaaggugaugaggacauuaccugugagggccccagaguagaggaagaggaaacagcugaauaagaacacccgguauucugggugcuccgaaaagcccugcaggaugaacucgguuaccaacgucugguuacucaucauc

SEQ ID NO: 15460 - RNA, 931 nt, Homo sapiens
uuaauuucugaagaaagggaaaagcuuccugagggcugcuuugaccuccuuguuucucaaaguauagaugaggggguugaggguaggacucagcacaguguacagcaggccagccaacuugcucuucccugcgcuguagccagagaccgggcuuauguaggcguagaagacagcgguguaauacaugcacaccacggugaggugggaagagcagguggagaaggcuuucugccucccccaggcagucuucaccuucaggaugcuggagacgaugaagccauaggacgcgauggucaucaggaaguucacuaugccguagaaagcauccgccaggacaaucaugacaccguugacguagguggagcugcaggagagaagcagcaggggagggaccucgcagaagaaauggauaaugacauuggggccacagaaauccaagcgcagcaucagccccguguggauggccguguugacggcgcagagcagccacacggcuguggccagcccgcugcagaacaccuugcucaucaugcugcuguaaugcagcggguggcagauggcugcguaccggucauaggccaugaccgugaggagcagcagcucugaggaugcagcccacgugaggaaauagagcugggccaugcagcccccguaggagauggagcucucuuccgacaccagacuggccagcgccuugggcaugauggaagaggugcagauaauguccauaguagccaaguugaguaagaaaaaguacauaggagcguggagcccaggguugaacgugauggccaaggugaugaggacauuaccugugagggccccagaguagaggaagaggaaacagcugaauaagaacacccgguauucugggugcuccgaaaagcccugcaggaugaacucgguuaccaacgucugguuacucaucauc

SEQ ID NO: 15461 - RNA, 1516 nt, Homo sapiens
ugagcugcggaagaggcuuuauugauuaaacgguuugaggauacauuuccaugugggaggugguagugggcguuguguccacggcugcuuguguggcagguccuauggcugagccaugucugagguccacuuaggcaccguccugacugcccagcacuugcaccuggaaggcagacacauguggacuaagagggcugugcucaauaaguggagagccacagcuccaucaggcaagcaaggcccucagugggggggggucuggcauauugcugccuaucuccucccagcagcugggaggugugugugcacaugugauggugugcacacauguaugugugugcauaucccagugugagcaugugggugugaacguguuuauacaugugugcacgcaguguacauuucaugucugcaccuguguuuggaucucuguguauguucacaugugugcauggaggaguaucccacagacuggggaggaggucuauggagucugggggcugcucgguggacaggaggucugggguguccaccugagcuggcugaugcgggugcaaugucugugggugguggaugucugugggugggguaggcugugugggugcuguguuggguggucuugguaaggcugcagaucuuuagaaaauggggugcccgccgcccucauaccagcagcuugaccagcuccgccuugugcauuggcugcaggccaucuauacaggacuugaguucagucauugcugccuuggcaucuucguugacauuguacuugcccaagguccccucauagagcuccucugggguccccaccaguaguguuugcaggaaguccaugaaaaacucaucguuguccuccccuguggccaucccugcaucacgagcgagaugaugccaggacaggacagggugacucuggugcaaccacagcccuggaccugccccagggcuccaaccuccauggucuccagaccuuccccuucaaugcccaccucuccuccccagggcuuccuccacaacaccuccaacuccaccuugcccgaagaccccuccacaucccccuuaaucuuagcugcuccaauuuccacucagcauucccugggaucaccagggaaggaaaguuaagcuccuggugugggggaaauuuccccugaugagaggcuauuaugaccagaggcuugaagggucaggucaggcuggacugggcugggguaggagacacugggcugguguugggucagcugggcuuuguccuugguugggguggaguagggugggcgcggguucugcaggguccuugcccacuucugugacagaagcagguggaguguucacugcagaggcccgaugccaggauuuuaccuucucagguaccccccacucccccccaccccugaauguucuggaaaccccaguggcacagacucacggcagaugcagaacagggugagggccaccagcaggagggcacggcuccccuucaugccagcagucucaggagcugccuccagccagaauc

SEQ ID NO: 15462 - RNA, 4820 nt, Homo sapiens
ccccggccucaggcggccgcuuaccuccugguuguaugaccgcagagcuuccauaaucacauccuccucacccgucuccacggcuucugcaaccgcccggggcuccauggcgcgccggggaaggcgggacgggcccuuccucagccguuccgggccgcaguucgccggccccgcccuggcccagaaagccccgcgccagcgcgcgggggaggccgggacggggcgcggcgucugguggcgcuuuaacggggcgcagcgucugguggcgcuuuaagggggcgcggccugaggcagaacuggcggcucggagguuuuaagacccgagucgaggggcugagucgcucugaaccgaacugaccccucuccuugugacccgcgcuucuugggccagaaguuccaacaggaaacgaucucagcccccaccgugcccugccacacacacagugacgccccucgagcuccacagaaccgaugggauguagaggggaaagccgaaguggaaaggaauuuucaguccugggccauuggguucguuaggcguuugcuggggaaugcaggcgaacgggauucccaggucccugccuuuguggagcuuauguuccagaggggaagggggacaaggaaaaacaaaaggacacgaggcggucacagggcugugcuucaaaagaagcaaaaggcgacugcugggcugcaacgggcugugaggaagugcuguuuuugcugacaccggacggugggaagugagccgggaaaagacuggaggagccacuccaggcagaaggagcagcacuugcaaagguggaggggccgagagaaaggggagcaacccagucuggccuggacucaguucccucuugaaaagcaaagauccugcguguccguuucaguggccgucaugaggauucagugacgcacaggaagcgcgauccacucgcucuucuaacaagugcccgggagcaaaggcgucuacggcccccaguccccgcgccgccucccagucucucucccggcuucacuuuccuguagugcguucuguacggcuguauucgacgcggcgcgcacucgcaggcacgagcgaggcgccgaucuccacuugacagaggaggcaccccugcccccaccacacccagugcuccucgcgggcuucugcccgaggggucugcuccuuccucaugacccgccugugaauccuuccuaaccguuaggaccuaacccacagaagcgucuuuccaccaccaucgucuaggcacugagcaagcaaacggccccgccccgccccacguucacaggaacaccaaacgucacauccgcggugcugcuguaaucccagcaccuugggagcccggcaggcgggggcugcagugagcugagaucgcgccacugucugcgcgacagugcugaaaauaagccacagauaugcccaucgcuuccgcgcccggcaguuccccacccucggcccuaagccggaagucagcgagcccgaagcggaaggggcugggcuaucuaggggcguggucggugcggaggcggggccaucgcuagcugggggcggggccggaagcucuuuccccgcgacugcgccacgucugaggcggcuguggccgcgucgguguccgcgucgaggagccggggcagggcacgauggcggacugggcucggggugagcgcgggagagcggagccguugggggcagggccgggccgaaaccgacgccgcugccuguagagccgcgugcgccugccucuggcccagcuggggugaccucggccgagaggacccugucaggggggcggauucggauccuuccggguccgagcagggccggguuucggccggcacugccguuaggaccgaaggcgcgcguggcggcccagcagcuccagcgaggggucgcgcagcagcggggucuccccacuccccgccgcccccugugagaucguucugcauggguucggggugagcgggagucggcauucgacaggucccgaggccaggcccuaggaguagaggcugugcuccgcugguguccaagcaggacucuuacuuuggccucgguggccccauuuccccuccuggagcccguguucuugucugcaaagugggauauugaugccugucucugugagguguuaugaugauuaaaggaauuuauaaauaugaaguggcuggaaggacgcuggcaucccuuccugacacugaagcuagggaggaggugguucucacgcaccugaugugacagaacuuccuuauccccuggcccagccugucacaggccaggccucugcgagcacucugcccuggguguugcaggaagccccaugcgggaugcagaccaaggaucccgcuccuggucgaccucagcucccgucucggggaaauugggaacuuugcucagccauuuucugugcgguaaagggccuucccaauguucuguccugguuccuugccaccucuucaggaccuagcucaaaggucgucucugcaggagccuuucugcugccuugcuggguacuuuucccaagucuuuucuaugcucuuagcagaguuuacucuuuuucuauaagaaugggcuccacauacacagauggugaccucccuggaugcaagugucacaucauacuagcaccccagggcuggguccaguuuuugcuacacagucucagaaggugcugguuggaccgaacccauugugggugcuugcccauccccaccuugauguguacacaggacauguguucacaugacaggcccuuacacacaucguccuuuaugcagccugucucaugugcaagauucaccugcuggaaccuugguuagggcccccuagauuucugacucacccagaugugguuggagugagaggggucaggggccgugcucaccgauggaugcaacccuucagccccucucuuuucucagcucagagcccgggcgcuguggaagagauucuagaccgggagaacaagcgaauggcugacagccuggccuccaaagucaccaggcucaaaucggucagugguggucuguccucuuaccuccaccuggugccuuuggggaauggggaucagagggaaggcagagggcccagaggaguuucaggcaguuuuccauccucauccaauucguggcugugcucaccugcaugaggccccagcugacaccuggaccuuucugucugcugcagccccacugugucuggcagaguuguuggcaggguuuaucuggucuggggagggugagugcuguauuaugugucugcucuggcccaacccugcccucucugucugcugaacagcucgcccuggacaucgauagggaugcagaggaucagaaccgguaccuggauggcaugguaagggcccacggugugcguguaucagugcccugcccuagcacuaccugcugcagagccugcagugucuccuucagcacuggugcggguggguggucaaaucaccacuucugugugaucuugcugggauuccucccuuaggacucggauuucacaagcaugaccagccugcuuacagggagcgugaagcgcuuuuccacaauggcaagguccggacaagacaaccggaagcuucuauguggcauggccgugggucuaauuguggccuucuucauccucuccuacuucuuguccagggcaaggacgugagccagugggagcuggugucugugggugccaagggcagccagggucuucccugccugguguuuugggcuccagaggacuuaccuacaaaauacuccuuugcaaugauaauugugggucaggaaucuucuuccuguguggcaggaggcugcggcugccugugaccugaugagcucauguuggcuggucccaugugugaaagggacucucucggggaaaccaaggcccagccccuccccccucccccaggugcuagagagccaggcagagcuggggccacagcgugucuggagaagccaggucugagcagagcagcuggugaaucccagacguggccaccuguggcuugcagcccuucuccccgcgcuugggacucugacaucuuaaggcugcacggucguguccuugucugggugaggccaugucugugauccaagguuccuggaacugacacaggaaggggcugugaacccuaagugggugucaucuccuccgaccgaggcuucucacccuggagauggcaguuacuccuggccaugguugcugagcaugggcagaccaguggaggccacccuacuguguuaucugcgccuucgaugaagugagacccuuggggagaacgggcuguggaugaaggaguggacugcagccuuggccuagccacugggcugggaucuucugggucaugugacuguguauccaggagcagaaacuuguauucucaggauucaggaucuacccagcaccaaagauguauuuucaggagaacagaccuagaaaugggccugucuggcauuucagagucaggcaaagcaggcagggccagggagcuucugugggucuacacaagaagguuccugugagggcuaucaguuguugccuucuagcuugcugguaacuuuggcgccuccgccaagcccugccagacuccccuggcugugauggcauucugugccauccuccuuguccccagccucugcaggaugcccucccuacccaccucucccugggccuucccuguccacugggcuggauucauguucaaaccacuggacuggcagggcaacgacuucuucccaccucaagaugagguccucgcccccuugucuuggcauaaaaacaccuuuaaagcaugagccaugugcuucuuugcccuucucug

SEQ ID NO: 15463 - RNA, 9223 nt, Homo sapiens
gcuuagggccgaggguggggaacugccgggcgcggaagcgaugggcauaucuguggcuuauuuucagcacugucgcgcagacaguggcgcgaucucagcucacugcagcccccgccugccgggcucccaaggugcugggauuacagcagcaccgcggaugugacguuugguguuccugugaacguggggcggggcggggccguuugcuugcucagugccuagacgauggugguggaaagacgcuucuguggguuagguccuaacgguuaggaaggauucacaggcgggucaugaggaaggagcagaccccucgggcagaagcccgcgaggagcacuggguguggugggggcaggggugccuccucugucaaguggagaucggcgccucgcucgugccugcgagugcgcgccgcgucgaauacagccguacagaacgcacuacaggaaagugaagccgggagagagacugggaggcggcgcggggacugggggccguagacgccuuugcucccgggcacuuguuagaagagcgaguggaucgcgcuuccugugcgucacugaauccucaugacggccacugaaacggacacgcaggaucuuugcuuuucaagagggaacugaguccaggccagacuggguugcuccccuuucucucggccccuccaccuuugcaagugcugcuccuucugccuggaguggcuccuccagucuuuucccggcucacuucccaccguccggugucagcaaaaacagcacuuccucacagcccguugcagcccagcagucgccuuuugcuucuuuugaagcacagcccugugaccgccucguguccuuuuguuuuuccuugucccccuuccccucuggaacauaagcuccacaaaggcagggaccugggaaucccguucgccugcauuccccagcaaacgccuaacgaacccaauggcccaggacugaaaauuccuuuccacuucggcuuuccccucuacaucccaucgguucuguggagcucgaggggcgucacuguguguguggcagggcacggugggggcugagaucguuuccuguuggaacuucuggcccaagaagcgcgggucacaaggagaggggucaguucgguucagagcgacucagccccucgacucgggucuuaaaaccuccgagccgccaguucugccucaggccgcgcccccuuaaagcgccaccagacgcugcgccccguuaaagcgccaccagacgccgcgccccgucccggccucccccgcgcgcuggcgcggggcuuucugggccagggcggggccggcgaacugcggcccggaacggcugaggaagggcccgucccgccuuccccggcgcgccauggagccccgggcgguugcagaagccguggagacgggugaggaggaugugauuauggaagcucugcggucauacaaccaggagguaagcggccgccugaggccggggggcgggcacggaggggguggggcagggucgugcgcggguagcagggagggcgugggugaggcagaggcugugucagcaagcguaggggacgcggcggggugcggggggcaggucugggaugcaguguugcggggagagugggggugcacccguuggguggcaggcguguagggaugggggcgagugccgacccugccauccguucugagcaguggcugcugccugaguuagaggccaauaggccgcccgcaucagcggacgcggauccuaccccucuguggauuugaauucacuaguucucucugcagcacucccagagcuucacguuugaugaugcccaacaggaggaccggaaggugggugcuggcccaagggguaaaggggcagggacggguggccccaggaagaagggccugguggagccgcucuucucccugcccacagagacuggcggagcugcuggucuccguccuggaacagggcuugccacccucccaccgugucaucuggcugcagaguguccgaauccugucccgggaccgcaacugccuggacccguucaccagccgccagagccugcaggcacuagccugcuaugcugacaucucugucucugagggguccgucccagaguccgcagacauggauguuguacuggagucccucaagugccugugcaaccucgugcucagcagcccuguggcacagaugcuggcagcagaggcccgccuaguggugaagcucacagagcguguggggcuguaccgugagaggagcuucccccacgauguccaguucuuugacuugcggcuccucuuccugcuaacggcacuccgcaccgaugugcgccagcagcuguuucaggagcugaaaggagugcgccugcuaacugacacacuggagcugacgcugggggugacuccugaagggaaccccccacccacgcuccuuccuucccaagagacugagcgggccauggagauccucaaagugcucuucaacaucacccuggacuccaucaagggggagguggacgaggugagcacugaccuuaacccauggaugggucucaacucagcuccaacauuuccuggaccugcuuccuacuggguaccuucagguuucugggugucagacauggagaggacaggaccucccagccuguugggacaaggccaaggagaugccaguucugggcugggaccucaggaaaggcuucugagggaaguagaggccccuucuggcucuugcugccuggcaggagggcuguguggugucuggggagacuguaagagauccuccaccaugaggcugugaguggggcugagacagagugugacuucaucccuaagguauguguuagcauuccuaaucagggaagugcucuuagaagaauacucauggaguuuuuaggaagacagcaguggucaucuuuugcccccagcacuacccagagucaccuaggaagaccccaggggaccagguaugcaguacaggaggugcacagucauugccacacaguccuggagugcaacagacaguggagccucagcaggcagcagugggaugaguggggcuccucacaggaacccuucuuucuuuggucaggaagacgcugcccuuuaccgacaccuggggacccuucuccggcacugugugaugaucgcuacugcuggagaccgcacagaggaguuccacgggugagaauggggcuuuuucugggagggaagugugcccacaugucuagauggucguccucaaccccggcucugaaccagaaccaccugagagcccaggccccacccuagagagucugacguugucugggugagugagacuggacauagccaugaauuugggggcaggaaugugccaacugggccuuggguaguggcaacaguaugguacuuacuagggcacauugguuccuuguccccguuuuuggucuaccugccccuaggcuggucuggguuuccagagauggucuggcgcuuuggcucagacagggucggggaggcagugugucucagugcccccacuuccccaggggaccccacuguacagcugaguggcagugccucucagaucagucccugcccuuggcuuuggucccuagcgcugccccuuugggacucagaugccagcucauguaaugugugguucagcggagucacaaagauugcaccugugcucagggauuagcccuguugaaaccccuaccuccaucuguccccagccacgcagugaaccuccuggggaacuugccccucaagugucuggauguucuccucacccuggagccacauggagacuccacggaguucaugggagugaauauggaugugauucgugcccuccucaucuuccuagagaagcguuugcacaagguaggcuggggauggcugugcaggcucccccaguggcucuggcacugguucuccugcacagauguggucagugcuuccacacuguccacacugguacguggagauugucuugguggugugauaugggcgacucuuccgguuguucugugguccagccuggcaagaagccagacccuuccuccaugagaagcauguggacaccuuccacacacuugaagguuucacuucuuaaaucuuuggggaucuuuacugagugguccagagaagccccccagucccuacuuuuaagucuuaaacacaggcagcccuugauuacaagcauaguugucccucagcauccugaggagacccauaggaaccucagaucaaagcuuccuucugauugcugugacugcacuacagggcaucuggacagcuggggcucuaaccaucuuccaggagcuugcagaaagcaggcuggaguacaauaaaccgagauuuaguagaccuccugggaaucuaccugccuaagcaagggacacacaaggugccugcgagccagucaggauagggagcuggcacuggacacacagcuaggggguugucugugcccgucgcugccacugcuggugcugggguccaggcacauuaugcuaggagggucaagaacucccugcucuguccacgaaguacacagagcggggauucgguucucguuucuuuuugccaccaacaucugagggcaaugugugugcgagucuaaagcuuuaauugcuuuguguuuucuucccagcucugguuuauaguugaaguaauuagacuuaaagcaguuauuucucccaagucacaaagcuuacgaguaccucugaguuacgcucuaucccuguccuuuucaaaagugacacagacacccaccacccacucuuggccuucugcugacuaacugcagaggggccucuucccaaaccucugccgccaggaccagcuguuguguauguuggugggaaggggugguggggagguguaacucugugccagucacaaguuaggcaggggcauagccccagugacagagaauccucuacagacacacaggcugaaggagaguguagcucccgugcugagcgugcugacugaaugugcccggaugcaccgcccagccaggaaguuccugaaggcccagguauaaggcugaggagcuggugcuccugggggaugugguuucggcccugaucacagacccuuggcugcucuaagcccaagcuuagggauggccaccuccccaggugcugcccccucugcgggaugugaggacacggccugagguuggggagaugcugcggaacaagcuuguccgccucaugacacaccuggacacagaugugaagaggguggcugccgaguucuuguuuguccugugcucugagaguggugaguuauggagacccaggucccagcccaccccaccucagccaggcuugcacacugaccucugccuugccccucagugccccgauucaucaaguacacaggcuaugggaaugcugcuggccuucuggcugccaggggccucauggcaggaggccggcccgagggccaguacucagaggaugaggacacagacacagaugaguacaaggaagccaaagccagguguguacccccaacacacccucgggucuccacucacagccccauagucccugcuuccacacccauguggaccccuguagggugggacaggaugacaaaugggcaagagcuuccagaaucaagcaccuguuccuaagugcuaucugggauaccagaagguggcagauggcaggagcugguuaccugugccgcuucuggagggaggccucuuccugcaguugccuugcccaccucaccccacugggaaaauagguggcuugccuccuguccuggagagucacuaaugcauuccccacauuccacccacugggaaacagcauaaacccugugaccgggaggguggaggagaagccgccuaacccuauggagggcaugacagaggagcagaaggagcacgaggccaugaagcuggugaccauguuugacaagcucuccagguguguggcaugaggaggaggggccugcagcugggagaagggagagcugacccacauccugucuugugagccccaggagguaggaucagaggagagcuuaggauccugguauuagguugcauugcucacguuugaaaucacuugcccuggaggaaaucccccaggggauggguauauugagaucaguauugugccccuuuuacagaugauaacugaggcccagagaaauuaagagacugucuaaggccgggcgugguagcucacgccuauaaucccagcacuuugggagacugaggcagguagaucacaaggucaggagaucgagaccauccuggccaacauggugaaaccccaucucugcuaaaauacaaaaaaaaaguuagcugggcgugguggugggcgccuguagucccagcugcucgggagguugaggcaggggaaucacuugaacccaggaggcagagcuugcagugagcugacauugugccaccgcacuccagccuggcaacagagugagacuucgucucaaaaaaaaaaaagagacuaaugucgccagauuuauuggagauggcccaguguccaaauuaagagccugcuuaaggccaauuuagauguuuaaaauaggaaacugcuuaaagccaggaggcagcaguuaggguuugggcccaguuaacagaagguccaaccaggcuuccccaguaaaugggagcagccuacuugguagagaggaagguagcagccacgggugaguaggaccccugccuggccaacugggccccuuccccagccccacugcaccuuuccccaacaggaacagagucauccagccaauggggaugaguccccggggucaucuuacgucccugcaggaugccaugugcgagacuauggagcagcagcucuccucggacccugacucggacccugacugaggauggcagcucuucugcucccccaucaggacuggugcugcuuccagagacuuccuugggguugcaaccuggggaagccacaucccacuggauccacacccgcccccacuucuccaucuuagaaaccccuucucuugacucccguucuguucaugauuugccucugguccaguuucucaucucuggacugcaacggucuucuugugcuagaacucaggcucagccucgaauuccacagacgaaguacuuucuuuugucugcgccaagaggaauguguucagaagcugcugccugagggcagggccuaccugggcacacagaagagcauaugggagggcagggguuugggugugggugcacacaaagcaagcaccaucugggauuggcacacuggcagagccaguguguugggguaugugcugcacuucccagggagaaaaccugucagaacuuuccauacgaguauaucagaacacacccuuccaagguauguaugcucuguuguuccuguccugucuucacugagcgcagggcuggaggccucuuagacauucuccuugguccucguucagcugcccacuguaguauccacagugcccgaguucucgcugguuuuggcaauuaaaccuccuuccuacugguuuagacuacacuuacaacaaggaaaaugccccucgugugaccauagauugagauuuauaccacauaccacacauagccacagaaacaucaucuugaaauaaagaagaguuuuggacaaaaauguauguguaaauuaucaaauaaaggggccaggcacaguggcucaugccuguaaucccagcacuuugggaggccgagguggguggaucacuugaagccaggaguucgagaccagccuggccaacauagcaaaaccuugucucuauuacaaauaugcccaugugcuagguguggugggacacaccuguaaucccagcuacccaggagaaucgcuuaaacccgggaggcggaaguugcagugagcugagaucauaacaccgcacuccacccugagugacagggcaagacucaaaaaauaaaaaaggaacauuaacuaggguuagaaacuaacuucauucuuuuuagaauucaacaguuuuccuaggucaccaauuccaccuuuuguucuuauuaaggcgcaaagucacaggacccccuuccugggagucacugucauuaaaucuauugccgucagcucagcccaggguaggcaagguucaagaaugggaagugcuuuugucuggggaaacacgcagguaaugugaugcuaggaaggaggaugugcaggugggugagagcccaggagggagcagcuggugccugacagggugagccaucagggcugggccuggguacagccccaggagaaggagccugugcagaaguagcaguucaguggauuccaccuccuaugucacaauccagcagguggccaggacucagccuggguuuuaagugaguaaugccuucccugucucagagauuagcucuaacagugucacuagaggaagcccuggcgagggugggggggcguaguguggggacaaggaggccagauagaaagugcuggaauguucuggaacagaucuguuucuggaggagaggcugaguauggagagucaacagaaugugaccaccuucagagggaggagcugggccgucuccaauaaauccagggacaaaugccuucaguccucagacuguuccaauagaggggacgccacguaucccaggguucccuuuccaacucaugucaacaccugcagucccuuugaggagacuaaauguauuucaugcuggaaagaacagauuuucucucauuaaaaauagccccacuaaaggagaccaacaugcuagaagugcggcaccagggccucaagacuacacuucggaacaugaagagggcuggggaccgcucggcccaagucuggaucuuguaaccaacagaugccgagcuugccguucaacuaggcacagaaagcagacucggucugggauuccaguuggucugauucaguucaagagggucacagucagaagaaagcuuuuuccauuaggagcuucagcagagugaagaguucaacacagcaaacaggcaggcagcuccuuuguauaugugacgggguggcccugacuguaaacacagcccuaccagucacugcagcucauggccugagaagacauuccaguggcagccucggguguccacucaguucacauauucugguuucaccugcccaagcugucuucaggcaugaggucuugucagaauugggauguggaugucuccuauguuaccauuuauugugugggggcagccaucauccuauuugucugguccaucaagcug

SEQ ID NO: 15464 - RNA, 5993 nt, Homo sapiens
gcucuccccagcaccaaagcuuuaauuccucaggcugacagcggugcagggggccugguccucaucaggguuucagcagcagaugccaucacaucuuguucuugggaaacugcugacgaccgaacccuggggcugagcucccaagacaaaggcugggcagggccagggccuugaacccaugcacaccuggcuccagucccucuggcugguccguggagagcgcuggggucucgcccucaaaucccucuccuguucucuggugacuucccacuucccacucccccaccucuguccucacaagcggcguggcugagggaagagagccaucccaccccacgcuguagcagaggcugcccaaccugauuaaagcugcccagagucaagaggagccugggauugagacuaaguccccucaacugcaugacaugaaaaguuccuuuuuggcaaagcugcaccugagaguccugaggaauucugaaggggccgaguccccguccuucgugccccuuaucccugcuguccacgcugaggccugagccugccucucugccuucucagcagagcggccggccgcugugaccacugcucucaggagagugggggaugagaggccagaggugaugcaggcucagaccccggcuucaggagcucgggguggggucgugggacggugcgcgauagcaucaguccacaggggcaggcagaggcgguguggagaugccacggggaagccaccugcccacggggguccacgggaguccaggcuacaggcagaaagccuugaacucaggccaagcagcauggaccuucccugagagccuggcugcaggugagggauggcaggcuaggagggugcccaggaggggugggugcagacguggccagagggaaggcccaagagacgucucugaagccaccguuccugauuauucagaggcaggguccacagugagugacucgguggggcuggaggaacccagggugacccagagggggcucuggagcgggucccuaacaucugaaaaaguccucccagggaacucggagcuggaacuuccaggcagcuucgggggugacauuuguauccggccagccgagcggggaaaggagaccuuguguccugcagggagagaggcagccugggggugaggggcagccuggggucgcaggcaccugggcuguugggggcuguucuaccuggcaacagggagagccgggacugggauggccacagcucagccuccaggugaggagcccagggcccugcucgagcugugaccuccacggucacggaguccucggaaaaagagaaguugagcuuguuccccugguagaagaugccggagacgcucacucuggagauccccgacagacacacagggucaaaggucacacccgcucgggugacccugugggaggagaggcuugugagguggcaggugggggcaugggcugcccucugccagccucugcacuuaccugaaccccgugcacccgaagaccaccgccugcaggaagccccccaugccugucaggaaguucacagcgccugacccgucugcauucuccguccacaccugcaggggcaagggcagcugacaccaggacccccaggucaccguccucucugggcugcugucccaagauccggcaggaagcuccaggggugcacccugcugugccugcucugaggcugggcuccacucccaccacaaggggcccagugggaggcagguguggccaggcugaccuugaaggguucagccauguuggcaaagcuccuguccaggaggccccgggcccgcacugcguccuucagcuccauccagcccacagcaaacaugcucuggggucagagguaagaggacacacaggggugaggcccacugcgugggcagagaagacugaggccaaugggguaggaacuccacagccccagggugcucacccaggucauggcggggcccuggggggacgucacagccucguaaaucuccagauuuuuccugcgaacaucaggacucagggagaaggggacuggguaucccaggagcacgacgucugccugcuucaccaccucuccuacagggaggugccgcugacuggaagguguuccaggacagacucgagggucucgacggcaggggaggagcccuugaagggguccacucaccaggcucauacccaucgaacuccggguggaaguucugcuccacgucaaaggguaccuugaucuugucagccaccgccagccacuggcuggggaugggaagacccagguccugggccagggcagcagcaaagcgcaggcuggagguggagguaggugggggaggcugcaaccccuacacuuccagcugcugccugccuagugggggcaccggggcaggucuccagcuggggcggggguggggugaggugaggggaucuugugucugaccuguucuggaccaggacguugguguacacagaguuguugaccccugaaugguacucgucgggggacaugacuccuggacacacaaguccaagauggugcucagugcagagucucagaggccuucccuccacgccgguggucagcguggggcuggcacacgugaggugucugaaaaucaucugcugagucugggagcauccacccuuccuccccgagccccuccccaccauggccucaccccucaggugguacuuuuccucccuggggcuccacucaacacgacugcaccaaaacucggccacagcccugaccacgucccagccaccagccucucgaaauagcugcagguccuggggagcaggaggaggcacagaggccagggccccagucacucucauuccuaguggccugucugugcccagaagcaaggccuggcauugagacaccuguccucagccagcuucccaggaccagccccaaacaggaagccacgaggagugggggcuacaccagcugccuggccacacuugcaggaauggugggcacgcagcaccucaccugggugguaugguaguacagcucgaaggccaacaccacggccccguugacguggaccuccuggacuccguaaauguccucagggcaaaccucuaggccggagucugcacucucccaggcaaacuuggcucccugagggguugggagggggcagacuugaccuuguuggaggggagcgguggccccccaacuuucccgugcccucgcccuggaggagggggggcucggccugcgccagguacccuggcgggugcuacugcuagaaggcccacugcacguccucacggggccagguggcuucugcccaguucucaccgagugcugacccuggugcagggcagcaagggcaccccaggggguccugggccaaagcagggucccagcccgcugcgguucccaccuccucucucucaggugcgggcugcagggcacugcugaggccccacaagccucaggguggggaaucuaggaugucccagcuuuguccagagggggccuggggagagggauacaggccugggaggggugugggggcugcaggcccugcagggcccuacgggccagugccccagguccccucaccugguagcccagguucugggcguucuccagggccccguccagcgugcggaugcgguacuccaggauggcccuggcggcuucuggguggaacaucaggauacucgggaacauccagagguccugagagcacggucccucguucuagcgccggacaggccgucacugcucccgccccuccuggccacauuccgccccggcagagcuccaucgcuggcgucuucuggguuccuccucggcugcccacucagaucugcaggcccuccccaccugcccacccaguucugucuccagcccagacgcuccuggaguucuggugcucagccccacacuucgccuccccagccggcguuuguguggccucagaggcuccagcccgaauaugcgcaugggcagcuucaggcuggcagugaaugacucggccucugagagccucaucaaagaaacggccacagcggcagcaccgggaggcucagacaacgauggagcagccccagcacagucacucucgacaccuccacgcccagcagccaucaugccccuccgcucugugcccucagcguccccgucacccccgucggccuccaguaccgggcuccacgcagccccacaggccuucccaguccccacagguccccguccugauaggucccuggagcuccacuggcccucagguaaacuccaagcgccacacuacugucuacaaacgcuggugaucuggaccugcagcccuucucgccuugguggaggccccuccccacgcucuggaaagugccucaggcccucucagcucuggucucugcaccuuccauuccccucaccuagaucacuccucuaccaaacuccugcacaccuuccaggccucuucccuuuugccacagucccugugcuuccccaaccauagcccuggucccagggagggcagagaccguggaccuccaugugucgccugcuguguggcuggugcuggguguacagugcucaccuggucccagaagacguggccccaguagcauuccucacggcucccauuggagaggcccccaggacugaggccauggcagauguauccuggggccuugggcuggggcagggcacugagcagguaguagagggagccacgcagggccuggcgcagcugcaggggccccaccacguccaagccacauucuacccagagcugggcccaggccugugcgugagccguauacagagcuccccuggccugcagcugcagggccucagugaggcaggccugagccucagccuggcugccgcccacugcugucaggaagucccacguccuagccuccucaccuuccccaagggucaggucugggggugcugguguccacagcauguguaccucuugcuguggccccccgggcugcucaggggugaggguguggccauacagguaccugugagagcguggccaugccucagggaugagcucccucccuggacucccuggcugcaaauccagcccccuccuuaccgggcucccuggaagucaggacccugaugcagguccaggucugggcuuucuggggagaaggcugaccgcaggagcagcgugaugggcccgcuccccggggccaggcgggcgauggacacucggaaagccagcacguggggcagcgugcgaugcgcauagaugcacugggaggcccggaagcgggggcccuccagggugugaagaaaggagccuggggaggcagaagcgaaggcagguggguugccaagcuauggccucucuggggcaggaguggaccacccgaccgcugccucuccccacaaugaggcggaucccucugggcccucggcugcucguucccgcuacagcugcacaggaggccuccagguggagggaaggggggacccugcgggccucuggggccuccugucuuagugagacuuccuguguaaacucaggaggugcuggugggauucgaugcugugguugccccaccgaccuggaacaaugccuggggcaggggugaggcaggccagguggcgcuaccuguguugguguccagggcgaaggucucggucagcugcucccccaucccugcaggggccuccagccggacguugagggggcugggcagcauggcccggugcguguccccgccagccccauuguacacgccgcucacgugcagcgugucgugaaacacucgugugcccagguaugcguuggucacaguggccaagagacgggggucacugggcagagagugggcagcaaacguggugggguccucgccggcguccuccauggagcugcugggccugagcggccugauggggugucaggggccgcgggacuggcugggccucccucuugagaccgucuguaauccccugaagccucccucagaacuggggggaguugcggaaccagcugggcagc

SEQ ID NO: 15465 - RNA, 1297 nt, Homo sapiens
cacgugcacuuuauugaaugccauuguagaaaagcgugugaggauaaagggcugauacaggacucggcuccgggggcagggcgaggaauggaaguuggaguacgugggauacaggucaugggcagagcuccuggccucagugaugccuccugaucuauccauaggccuggaagaucagcacugggaugacgaugagcagaauggucaugaggaugcccagaaucagggcccagauguucaggcacuuggcgguggaggcauaggccugggccccggucacgucgccaaccaucuuccugucccuagacugggggagaggagauggugaggggaccaggaucccccagcugagagccgcgugcuauggcuccgucuccucauuggcucuccccgcccugagaucagggaccaccuccuccccuuccucacccgggcucagacucuccaggagccucggggcucauccuccuucugccuugaccucagcacaggcuguucuccccaccauggggugaagucaccugugaguucccuucucacuuucugggagagccugggugccagucuggaaggugaagguguaauuucuuacugggcuauagggagaacugcucugggcuaguggauagccggggacagacucugagccagccagccagccuccuggagccuccuccuaaaccugcacugggcagauuccccaagccacacacacacacagaucacacagacaaagccacugacgugggcacacacgggacagaggugcacacaaacucacagucacagggacacacaaguccccaccccaggcagcaugugggcagguggagcuccaggcucagcggcacccucugagcauucccuggggccauacgcaccuucacggaguaggcgaaugcuaugaagcccaggcagcagggguucaugaagaggguguugaacagggaccagacgacauggucgggcacggaggucucgcugcggauguggaucacgguggacgucgggggagcaggguuguggggcgcccccagcacagccaccucgugcuccuccuugagcaucucauaguuggggggcuggccacuguugacaggagagaagaagguuuggacagugugauucaugguguccagcgaagaccagcggcggucggguuacugggaugguucucagugagcccucccuuuccccaguaguuucgguuucucaacaguuuccuuuuccuggcauuugucaaaucgggauuuggccggggccagaugagggcggaacaaauuccugaggaucaaau

SEQ ID NO: 15466 - RNA, 12508 nt, Homo sapiens
cgggcccgcggccgagggcggccugggggggucgcggccgcacccgguggccgcgcacggcggacaaaggaccaugcggggccgcgggcgcugagcgcggcggggcgggccggggaugcggcgcggggcgggcgggggccgggggcugcagcggcgccgcugagcgcggccuggggcgggcgcggcggccgcgaugccgcggcucccggugaagaagauccguaagcagaugaagcugcugcugcugcugcugcugcugagcugcgccgcguggcucaccuacgugcaccugggccuggugcgccagggacgcgcgcugcgccagcgccugggcuacgggcgagguacggcgcggggggcgcggggggcgcggggggcgggggcggcgcggggggcgcggggggcgcgggcggcgcggggggcgcgggcggcgcgggcggcgggggccccggggcgcgggccgggccucccaccgcacagaggucucggcugggcccgacccucccggagaccccgcccgcuguucuccgcucugcgauuuggggggagggggcgcgguucggcucggcccggacgcucgaugacgucggcagugacgcgcgcgacccucccagagagggucccugacucugggaucuggcuuggauccgguagugaggggcugacggugggcuccuggggaagucucugccccuagacccugcugaggcuuccaagaggccuucucaggccucgccuccacccccugcccgcuuagcagggccucaguuucccugugugcuggggacccgggccggggcuugcugaaguggccggugcagcugggacgcuucccggcgggggcgccuucggugaacugugccaguguuguggggguccaugcguagggauggggcccagcuuggggagccuggcguaaacucucccaaccccaacccacaaacaaagcagauggggucacggugagccagccgggguagggccuccuggagauggugaucuuugacauacaccuuugggggaaagagcauuccagacaggaaggcgcagaugaaagccuggcggugggguugggggagaagguggggcagaaugcccccucuggaggagggagguuagugccaugcccagaccaggagagaccccagcuggcugccucugagccuuuuccagggagccagguguccugagggggcagaacaaugauacuggcuggggacuccugggccacuccaccugccaaagccccuguguucucuuccuguaccgggacgccuggacccacacaggccaagggucuggggcuugucccaacccacauaccucacagcuuccacacccucaagagacccccgauacugcugaaucccuaaaaagccccaccccagcuaucagcagacagggcaggauccacagcuggcccagugacacagaacaaaaccagcccccucugcaggcuccucugugguuuucugagcagcgcaggggucuaagcccaaccaggagggggcggaggcauagggaccccucuuccaaggaccccuugaggcuaagccagcuccgccccagggcaccuguacacuugcuaccucugaggcuagggccaggaccagaggagcccaacagcugcccagggagagggcgagugagcagacuguucugucgggggaccuggggcccaagucaggggagcccugggggacccuucccagaucugccuguggacaucucuacugccuccccacaagccugggcaggccagcucugcaccccagcccucuccacuuccuggaccucccuaagcugaggaccuagacauccccacugcagccccaggggguuccacgcccugggaucugagcaucuguagggaugcuucucuucaccccaauucugccccuccugguccuccuacccaaggacacucaauccagggccacccucugcuccagggccaugccugggcgucagcauccaugccuguuccucaguccagacuuugagagcucaaauccuucaggagagacuacagucccuggcacuaacccugaguucucaguucugguaagggaggcagacguggaacacuccagcacacagagaaagugcugagggcacagggcaguccuggggucuuccuggaggcagagccacucaacaagaauggccagauggaggugcaugugggugccuacacacgccagcuggcccacccggcuuuccucccucacaccugcuggagguugggaagagccugcuggaaggcucagccugggcugccccaccagaggugggguguagaagaaguugccuugcuggggggaggggcaucugguggcagaggaagcagaugagaaggagaggcuuuagugagagacaccacagccugccugcccugcucuggccaugugggucccuggcccagcugaacccagcagcaggcagaauggccuuggagagagccugggcccgagacaggccucaugugccaccugcagauggugagaagcugaccagugagaccgacggccgggggguccacgcugcgccauccacacagagggcugaggacuccagugagagccgugaagaggagcaagcggugagcagagcccuggggagaacacgugugcacggagacgagaccccgaagccacuuguguguuggugucuugagaaccuguccauucuggaggacgcagcagggggcaugagacacaggacauguggggcacggcacagcuugucugugugagcuccagcaccagccauccugucuggagcucugugucugggggcugcagcaggugcaugaaugugccggccggucagugugugggguggccaagcaucugcuugggcuagagugaccagggugucugaguguaugugccaggugccacaggucaggguuugcauggcuggggcucacgggcauuuagggcuguguggauacauguuggaaggggucuuugugaagguuugucuuggugugugugaccuccucccugcccuuccaacccugacccuguugccuuuucucuccugcagcccgaaggucgggaccuagacaugcuguuuccugggggggcugggaggcugccacugaacuucacccaucagacacccccauggcgggaggaggugagcuggcucggccuguaaugggcugggaggcagggcgggggcuggggcgggggggcggcgggccgugcagaagguaaggcccccccauccccaguacaaggggcaggugaaccugcacguguuugaggacuggugugggggcgccgugggccaccugaggaggaaccugcacuucccgcuguucccucaugugagugccgggguuggggggugccgggugggcagggcacgcagggggcuucgacagcaacagucacugcccccccagacgcgcaccaccgugaagaaguuggccgugucccccaaguggaagaacuauggacuccguauuuuugguuucauccacccggcgagggacgguacgggggugagggugccccgggggaggggugccgugaggcuccaccccccugagccuagucuuguggacuaggagacguccaguuuucuguggccucagacgacaacucggaguucuggcugagucuggacgagagcccugcugcugcccagcuuguggccuuugugggcaagguacccccaccccagcccuggugucgucccgggccuccugcagcucagucaccugugcccaccagccucuugggaaugaggacccgauggguuugguguccccagggagagagugaacccccccccccaccaccaccccugcucuaucaccccccagacuggcuccgaguggacagcgccuggagaauucaccaaguucagcucccagguguccaagcccaggcggugagugacuguggggugcaugugcgugcacuuguguauucgugggaggggguuacgcgcugucuccuuauccugugcacacuugcgcacacucugcacgagcacccgcccggccaagcugccauccuccugagggccagcccugaggggugugggagccaccugcccccuucccugccuccacuauuugagcguccugugcauggcacgacccuugcuccucguguccccaggcucauggccucccggagguacuacuuugaguugcugcacaagcaggacgaccgcggcucggaccacguggaagugggcgugagugccuuccuccccugggggcuucuggagacuccacuccccccaccucccugcaggacaaccgcaaugggguccccgucccaaaguugacaaagcagauggucagggccaugggccugaggucaggagggucugcucugcccuccuggggggcucggugaggcuucacuaggagucaccuuugaguagagucuugagaggauggagaccuucaguagggagauguggggggcagagaauuuggggugggguguacggcggaugaauuccacaccacaagaacagcgaaggaacagacccagcagaggaaccgggucuucgagacuaggaggggucugguggccagaucaggcggggccugagcagcacucuggacagauaggccuuuguccugagaaugaggccauuggauuugcauuccaggaaaaaaccccuggccacaaagcggagagagccugggggaaggauuuuuacuguggccuuugguccucaaacccagggagguggcuguggggauggacgggggaaggcggaagggguuauacagcaaggcagagggccugcagccugguggguguggggggcagcacgauggugccugugucugguguguggagggcacguuucaccccagcucagcugggcagagggcccagacuggagacagggguuugggguggucuguggaggccccaggaugaggugggaacagaagggccugagacagccccuggagccccaacuugguggggguagaguggggggggcauccagccuggcccuuagggggccagcagugacccucacugggugggguuggaaaucuuaaccugaggcggggcgggggggccucagggagggagggagggggaagggagggagggggaagggagggaggaggaagggagggaggaggaagggagggaggaggaagggagggaggaggaagggagggaggaggaagggagggaggaggaagggagggaggaggaagggagggaggaggaagggagggagggaggaggaagggagggagggaggaggaagggagggagggaggaggaagggagggagggaggaggaagggagggaggaggaagggagggagggaggaggaagggagggagggaggaggaagggagggaggaggaagggagggaggaggaagggagggagggaggaggaagggagggagggagguggaagggagggaggaggaagggagggagguggaagggagggaggaggaagggagggagguggaagggagggaggaggaagggagggaggaggaagggagggaggaggaagggagggaggaggaagggagggagguggaagggagggaggaggaagggagggaggaggaagggagggaggaggaaaggugaggaagggagcaugguggggucuggcccugcucccagggucccucagcuuucugggcuuccuuccccagcuucccugcugccccuucuuggaacgccccggaccccucugccaucuccucuccugcauccuuuaagggauugguccuauuagucccccggcccugagccaggguagacccuuucuucccuggacccagccaccgcccugucccugacccccacccucucugccccgcaguggcgagcuuuccugcccggccugaaguucgaggucaucagcucugcucacaucucccuguacacaggugcgagcggacgccucuggggauguggggcuccucgggaugggcucugggugugagugggaagaguggaggagggggucugagcacucccuggaacucuucugcccccagaugagucagccuugaagauggaccacguggcgcacgucccccagucuccagccagccacgugggggggcguccgccgcaggaggagaccagcgcagacaugcugcggccagaucccagggauaccuuuuuccucagugagagggggcccgcgcgggggcgagggcgggggugccugccccagccacccugugaccgcaccuccugcagcuccacgcauggaaucuucgagccuggagaacgugcuggagcccugcgccuacgcccccaccuacguggucaaggacuucccgaucgccagauaccagggccugcaauuugugagugcggcuggagaccccgucucccguccgggacuccgcggagccuucuccagccccuugggaggccgccccgggagguccgcgcccugagcccugcgcccccccaccccccagguguaccuguccuucguuuaucccaacgacuacacucgccucacccacauggagacggacaacaagugcuucuaccgcgagucuccgcuguaucuggagaggugggcgcgcggccgggcuaaugcggggcggggugggcggggcgggacucggcucugaugccccgccgcgccccagguuuggguucuauaaauacaugaagauggacaaggaggagggggaugaggaugaagaagacgaggugcagcgccgagccuuccucuuccucaacccggacggugaguguccgcagcgccccuggcccgcacccaccugcgcagggagcuucuaacccgcguuucccgcagacuuccuggacgacgaggacgagggggagcugcucgacagccuggagcccaccgaggcggccccgcccaggagcggcccccagucccccgccccagcagcccccgcccagcccggagccacccucgccccgccgaccccuccccgcccccgggacggggggacccccaggcacucccgggcccugagcugggccgccagggccgcccgcccuuugccgcucuucuugggccgagcuccgcccccgcgcccugcaguggagcagccgcccccaaagguguacgugaccagggugcggccgggacagcgggcauccccccgggccccagcgccgcgugcgcccuggccgcccuucccuggcgucuuccugcaccccaggccucugcccagagugcagcugcgggcgcccccacgcccaccccggccccacggccgcaggaccggcggcccccaggccacacagccgaggcccccagcccgggcgcaggccacccaagggggccgggagggccaggcgcgcacgcugggaccugcggcgcccacaguggacucaaacuuguccuccgaagcgcggcccgugaccuccuuccugagcuugucccagguguccgggccgcagcugcccggggagggcgaagaggaggaggaaggggaggacgauggggccccgggcgacgaggccgcgucggaggacagcgaggaggccgcgggcccggcgcucggacgcuggcgugaggacgccaucgacuggcagcgcacguucagcgugggcgccguggacuucgagcugcugcgcucggacuggaacgaccugcgaugcaacguuucggggaaccugcagcugccggaggcggaggccguggacgugaccgcucaguacauggagcggcugaacgcgcgccacggcggguaugggggcggccgaacgcgcgccagggcgguuuuggaggcggggacagccggggagaggagguccuggccuuggcggacuccucagaccuuccccagggcccagugguguaccggccugggggcugaggcaccgcgccccaccccagggaagccccagcuucucuccuuccuuccuggcguccugacugcccgggcacuuguccagccucagggaccucccuggagccccacccagggcuggcgccccauccuugcaccuguguaccccacuucugucauccuggaccugggcccagggaugaguccaagcugcagagaucagcgucagucgcauccaguugcugcgcagacagccccauuccgggggggccaggcagagacccuuagggcaaagcucaagaccccugggccccuccuccucuccccucgcagugccccugggcguucccagacugucaggacccgacugcagaggaaggugcagggcuucugccccauuggccccucuggucucccugaggccccaggaaucuagugcugucugcccucccugcaggcuggugggcaggaguggggagucuaauuuggccuuggggaggccuguggaguucuaagaagaggcagugucugcugugcccagccuugaaggcgaguuaggaguugcacagugaugacaggcagaggcaggggcagaggauggaggcagaaccgggacuguuucuccugugcgugauggaagguugcgagcagagcaaagccaggggcagaggauggagacagggccaggacuguuucucaugugugugauggaagguugcgagcagagcaaaggcaggggcagaggauggaggcacagcugcaugugacuguuucuugugugcaugauggaagguugcgagcagagcaggaauuccaccgguuugggugcagacagguaugccucugccuggaggggaagggaagguggugguggugacugacagccuggagcccugggcggugggugcuggauucuagguggcucagagggcacgccugccccggcucuaagcuuccugagagcagcucgucauuucuugggggccucaugggaagaucaugguuguggccccaccaaugcccaccuggguauggcucaaggagcaacaguguagagagaccaagagcauuuggggcaggaggucccugacacucagggcuuugggguggggaaggacaggaguuggagggaggccuuggacccucagcugucacacaggugggcgucccccagugaaaggcacagacugccaagggaggacgugaggccgacugaagagaaaccaucgucuagggcaggguccuguuuucuccagaugaggagagcagaguggagggaaacugagguucuuggccgaguggaaugaggaggaaggggccaggaacgggcucccagcauggaagcagccuccuccacucagggaucaggacaggagcggaacugcugccugggggaaaggggugcugugaaggcacgauugggggcuucucagaagaggugacccagggccuggaagaggaguggcugggaggacuggggcaaacaucccaggcaggggacuccucaggacaaaggagaggagacaguggcugugccugaggaggagucugcuaccccaguaugaggggaagguugaaagccacaaaaucaaaacugcuuaagguccuagaaugccacaaaagccccuuggaaccuuguccuaugggcgguggcuaacuccugaagguuucugagcaaggggguaacaggacaggcgggcaugucauaaacgucaccugggacgugagugguggccaggaggcccgcgaggaggugaggaugggccugggcucgcuggugugcccccaguccugccccgacccuggaggggguggcuggaagguggaccugccugcugggccaaccuggaggggcaggugcugugccgcggagcccgcagccuccgccaacuccaagucggcugaguuucuguggccagggcggaccaggguugcgggcggggugcaggcuggaagccccaguaccggcugaccgcugagccuugcaggcgcuucgcgcuucugcgcaucgugaacguggagaagcgccgggacucggcgcgagggagucgcuuccugcuggagcuggagcugcaggagcgcgggggcggccgccugcgacuguccgaguacgucuuccugcggcugccgggagcccgcguaggggaugcagacggagaaagucccgaacccgcucccgccgccuccgugcgccccgacggccgccccgagcucugccggccacugcgccuggccuggcgccaggacgugaugguucacuucaucgugccagguucgcagggcgggcucgggguguccgggagaccucguggaaggaacauggacccuaaugacuaggaaaggguguggguguccgggaugaaguucuucggagcugggaggccccaccguagagucagcgucggcucagcgccccccccgccuuuucuccuccagugaaaaaccaggcacgguggguggcacaguuccuggcggacauggcugcgcugcacgcgcgcaccggggacucgcguuucagcgucguccugguggauuucgagagcgaggauauggacguggagcgggcccugcgcgccgcgcgccugccccgguaacgaccccuacuuccaccugggcggacccagcgcagcuuuccuccccgggagauggguuuuccugaccccacccccagagaucgugccugugacucgcccuccccagguaccaguaccugagacgaaccgggaacuucgagcgcuccgccgggcugcaggcgggaguggacgcgguagagguccgagggccccaugggggucggggagcaaaacggggcgugcccggggaggagcggagggcggggcucagaccucccgcaccccccaggacgccagcagcaucguguuccucugcgaccugcacauccacuucccacccaacauccuggacggcauccgcaagcacugcguggagggcaggcuggccuucgcgcccguggucaugcgccugagcugcgggagcucgccccgggacccccacggugaggccccgagcgucccacccugugauaccaggguucccaccaaccgccgcgguaaaguccaggaacccggggccucucucaauucccaggggaggccugggaguccaucagugcuccccguagugcccagagccccaguccccccgcaccagcacacccagggccaugccaggggccccaggaaccuccuccaguaucccgcguuuaugcaccgcgcuccagggucaugacccaguaccaccggacgacucccggaagcccccguggugaugggacccggcaccugaccccucccgaggucuccuagcggcgcuuugccggggggaccuugcaggaccuggucugaaggguagcaccccucacccucccgccccagguuacugggaggugaacggcuuuggccuuuuugggaucuacaagucggacuuugaccggguuggaggaaugaacacggaggaguuccgagaccagugggggggugaagacugggagcuccuggacaggugaccaccuccccacuccccagaggugacacccugaccccugcguccuccuccucugaauggggaagggggauuuaugccccccacggcgcccacaugcugagagaacucugcccuucccggucuucccaguauccuguaggccuggagagacuccuccacccacaucacuucugaaacccugucccacccccaggguccugcaaggucagggacaucccugaaccagcucugcccccgaucccauaggcccuggguggcccugaguccccaucaucccacuggggccaugcaggcucgaggcagcccugacacccccagccccuggaccaggguacugaccaccucuccgcccccggccccgggguccugaccaccucuccgcccccggccccgggguccugaccaccucuccgcccccggccccggguuccugaccaccucuccgcccccggccccgggguccugaccaccucuccgcccccggccccggguuccugaccaccucuccgcccccggccccgggguccugaccaccucuccgcccccggccccggguuccugaccaccucuccgcccccggccccgggguccugaccaccucuccgcccccggccccggguuccugaccaccucuccgcccccggccccgggguccugaccaccucuccguccccaaccccgggguccugaccaccucucugcccccggccccaggguccugcaggcagggcuggagguggagcggcuccgacugcggaauuucuaucaccacuaccacuccaagaggggcauguggagcguccgcagcaggaagggcucucgcacgggggcgucuugaggacgggcagccccucccagccccggugggagucccgaggcagcugcugggggcugggcuuugagcucggucccgagagacccggcagggcuggucagaggggcacagccaccgccugugccugccccucucuggcccacugggcgucgugccccuccccggagaggcagccuucacggcgggucagggccuggccuugguccccacucugcgaugauuucugugaaauuuugcuguagcgaugacauuguuuucagaauuuccaagaguucugucuguucuguuuuuuauucagaaugaaaugaaauauuuuuuuuaguucugac

SEQ ID NO: 15467 - RNA, 24081 nt, Homo sapiens
aggagcacccgccgcuggcagccacucuccuggccgccaaaccccagcuggaacuccggccacagccagcaugcaggugaguccugcgcucaaaaggguccacaccuucaaggcccccagccacgcccacaccuggggcccccggccccagccccccgccagccccaccuggaaggcgccuguguguguggggggggucccugcaggcugcccggucaggcgagggugaccgcccggcucagcuaagcugccuccuggacuccuggggcacgcuggggguuggaagugcuggaggcgggcggcguuccucccuccagcccgggauucugagggcaccagggcugggcucucagcuaguguguggggccaggaaccucuaccagaguccugaacacgagauggagagggccugcccaccgaggcgggggcugcugcugaggaccccagaccuggcagcuuugccuugcagcuggccccuaagggggagcgggcugugggcaccaggcaggcugccccaggguugggagcugcagaguggccggcgggcugugggcucucugcuccccaaggaccccgcccagcacaggugggggccgacugcugcugcuggauuccgauucugggggugggcgcugacugcugcugcuggauuccgauucugggggagggagugcaggugaacacguagaaagacauccuuucuccccucugccagugaagaggucaccuggggccagggccaacaccugggcaggucagcaccuggucggcccagggaggaggcaguggugagguguggagugaaaccagccucccucucggccugccagggccuccacgugugggcugcgccggcggccucuugcuccaucuccgcccagggcucuccucggcccuccacauccaggucugacacccuggcugcucagcccagcaccugaugccccuuagccugagcucaggguccccucugccagccccuuccucccaugcuggggguuagaggagagacuuggggcuggccagggguuggguugggagaagcagcaccugguuuguuggaagugagagcaucaguccuucaaaaaagacaguugcagccgggccugguggcgcaugccuguggucccggcuacuccggaagcugaggcaagaggauugcuugaacccgggcgucguggcaugcaccugcagucucagcuacucaggaggcugaggcaggaggacugcucgaacccgggcgugguggcgcgugccugcgcucccagcuacucgggaggcugaggcaggaggacugcuggaacccgggcgugguggcaugagccugcggucccagcuacuccggaggcugaggcaggaggguugcucgagccugggaguucugggcuguaguguguuaggcugacuggcuguccgcacaucaguauggugaccucccaggagcaggggaccaccaaguugccuaaggaggggugaaccgguccaggucggaaacggagcaggucaaaacuccuguggugaucaaaaaggacaguugcagacauggggaggacuugcuagucccagcuccaggcuggaucugggcgugccuuuccucugcucuaaccccuuccauggcuccccacugcccccugcugaaguccaagcucuccauuuggccaagaagccuagcagccuccccugauuggccucugccaaccuccagccuccccuucuggcagcucccuucuugcccuuuaugcuucugcaaagcugaaguaccaaggacugagucccuggacucaguuuccguaggugccgagugcugagucaccaggaguaguagcuaccaaguccuccuuggaggugcugagugcugagucccugggaggugcugacugcugagucccagacaccaacugcacccugauucucagggcgugcccacacauguucuuucucccgggaaugcugcccccauuuucucaccuuuugccaaccucuugcccuacaaugccaagcuccaugccuccucaccugccaaguaggcccccgccccugcguccacgaacgccacgcacugccugggagggcugcacgcaggucgcuccgucagugucuggggauggacgggcacacggaugggugaacugacagaugacagacuggacagcuggaggggccggggggugggcagaagacuggcuucaggagcgcagagccagcuggggaggguuugcucagaggaugcgugggcugggcagaggcgagacgcuguggcucacaaggugggccucuccaugcuugggacugcgguggggcagaaggggacccucuguggaugacgaaacuguaaaguucucaagggccagaucccagagggcucagggcaccggccaagaggcuugacgugaccucaggaggagaugaggcccaaacaccuucccaugcacagcuggggggaugugcgucgugggacccccuggccaggccugcuccuucucaugcacagcuggggggaugugcgucaugggacccccuggccaggccucucaggaguaggguggggucauaucugcacaaccaucuccucugccugcccccaaccuggaggcuggacugggaagaggauggaugggcaggacccccagcucuguccucacacuccagcccuugggagggagggucuccugcaggcuacagugucuccagaagcuuccucacugggaaccaggggcuugcccacuggacgcuggccuaugcccacaaugggggugccaagagccccccacaaacucccuggggcccuggaguacugggugugucaccugugagggcugugggacaggaaggaugggggagaacagugugugguucuguccaccuucuuccugugucugcacgucgcugaggugaccugggggcuggggugaggacacccuguuguacagacgaggaaacugaggccugggguguuucgguggcgucagagcuagggccuggccggcuguccacccagagccggccucccucucuggguuugcagauggcaaggcuggcugaagcuucagaggcccucagacugaguguguagggacagccccugucccuacccugggagcuggaagccugugggcccauacauaguuucccggagguggggcccauggacuggggacaugggggucccagacaucucacuguggauaaaccgaacagucugcauggcuggaaguggaggugacuucaggugguccagcccucaccugugaagaccccgagggugguguggagaagccaggcucccgugguccguaaacacuggcccuggagacggauggacagauggauggccugguccuguaggcugguggcuguggcccgggggaugggccgguggguguggcuccguaaacacuggcccuggagacggauggacagauggacggcccgguccuggaggcuggugggcccaguguucugcagcagagucucggagccugaggccugucuggcuguguguguugggggggcuacaccugccuggcugugugugucaggggguggcuacaccugucuggcugugugugucaggggggcuacaccuaucuggcugugugagucgggggggggcuacaccugucuggcuguguguguuggggggacuccaccugucuggcugugugugucggcgggggcuacaccuggcagcccuagugcuucugccuuguccgagggagcagcuaagggcagccaggggcuggcacgccccaggugugcguguagcucugcccuggggggagggcucccugucagcccacgucagugaugggggcuuugcaccccauuccccaggggaggcugauccugcuguuugcagaggcguggggucaucaccccagugcugcacggugucuuugguggggaggggguuucugugccucauuucuggggugaacgauggcuucccacccccaccuuugagaauguuccccagggacaguccccucucccaggcuucuccgaaaguccugccuggucuggggucccugccucgucccuuccuucucaggggucugggcuuauccugccggcuuucaacuuucggcccaggcugaugugagggggucucuaauuucagccucugccagaggagcugggguucugggcagaggagggacccucauccugggucugaagccaggcaugugaggggccauucucccaugaaucccuccaacacaacacuucccgggccccuacggaggcaagcugcagagcuggagccgugaugcccacgucccccagaccaccagucccccccagggaggcugcccucugcgcugagacagaggugccucuccugccugggcaggugccacgccccuuccugcauaucugucggaggaugaagguuucuccucuaacccaggacgggggagaaguuucaguguggcaggccacgccugagugcagguaucuguccgugggcugucgggaaggccaaggagggagucagaggaaggguugauugaggcaggaagaacuacuggucuaggauaggacagaagggccaggugagccccgugggccaacuagggcaagaacuuccccccgcagggaggcugcaguguggcacugggugcucagauggugucuaccugagcccaucucccugugaccggggcgucggaugccuuagugcagugcuccccaaccuuuucagcaccagggaccaguuucgcagaagacaauuuucccacagcuguggguguggugggaugguuuugggaugaaaucgucucaccucagaucaucaggcauuagauucucauaaggagcagccgagaucccugcaugcgcagugcacaaugggguucuuccuccuccuccugugaggaucuaaugccgccgcugaucugaugggacauggagcccaggugggaacauucacccccagcucaccccccacgcaccccccgcucaccccccgcucaucuccagcucacuccccgcucaccucccgcucacccacugcucacccccugcucacccccugcucacccccugcucacccccugcucaccuccugcucaccccccgcucacccccugcucaccuccugcuuacccccugcucacccccugcucacccccagcucacuccccgcucacccccagcucacucccugcucacccucugcucaccuccugcucacccccagcucacccccagcucacccccugcucacccccugcuuacccccugcucacccccugcucacccccagcucacccccugcucacccccugcuuacccccugcucaccuccugcucacucccugcucacucccugcucacccccugcucaccuccugcucacucccugcucacucccugcucaccccugcucuguggcccgguuccuaacuggccaaggacugguacuagccguggaccaacccccugccugagagccuucuguucugugguugguuggaugcauuuccuggcuucugugguugagacgguagagagaauagggagaucugucccagaacccguagcuccugguguguguguguggggugggggcuggaggccagaccuggacuaggguugcagacuuagcaaaacaaaauaagaaacagggccgggcgugguggcucacaccuguaaucccagcacuuugggaggccgaggcggguggaucacccgaggucgggaguucgagaccagccugcccaacauggagaaacccugucucuacuaaaaauacaaaaucagcugggcgugguggcgcaugccuguaaucccagcuacgcgggaggcugaggcaggagaaucgcuugaaccugggagguggagguuacagugagcugagauuguaccacugcacuccagccuaggcaucacgaggaaaacucugucucaaaaaaaaaaaaaaaaaaaaaggaaagaaaagaaaaaaaaaagaaacagacacccagucaagcugaaugucacaaugucacauaaacaacauuuuugguguaggcgugucccaugcaaucacuggggcaucuaugcuauacuaugcuaugcuauacuagacuagacuagaccauacuagaccauacuagacuauaccauauuaugcuauacuaugcuauacuagacuagacuagacuagacuagacuauaccguauuauguuaugcuaugcuauacuaugcuauccuaugcuauacuagacuagacuagacuacaccauacuagacuagacuauacuagacuauaccauauuaugcuaugcuaugcuauccuaugcuauacuagacuagacuagacuagaccauacuagacuagacuagacuagaccauacuagacuagacuagacuagaccauacuagacuagacuauacuagacuauaccauauuaugcuaugcuaugcuauacuaugcuauacuagacuagacuagacuagaccauacuagacuagacuagacuagaccauacuagacuagacuagacuauacuagacuauaccguauuauguuaugcuaugcuauacuaugcuauccuaugcuauacuagacuagacuagacuacaccauacuagacuagacuauacuagacuauaccauauuaugcuaugcuaugauauccuaugcuauacuagaccagacuagacuagacuagaccauacuauaccauacuacccuauacuaugcuaugcuaugcuaugcuagacuagacuagacuagacuagacuauaccauacuagacuauaccauacuauaccauacuacccuaugcuacccuaugcuauacuaugcuaugcuauccuaugcuauacuagaccaaacuagacuagacuagacuauaccauacuauacccuacuacacuaugcuaugcuaugcuauccuauacuacacuacacuacacuacaauacuauauccuucugcuguuuaucuggaaaucaggugugacuggguggccucuauuuuaccuggcagcccucaagggccaacuggcucaagcagucaagugagacuuucuggaggaggcaggucuugagcuuggcgaggaugcggcuggcagaggggagggacucaggugcagggaccaggugugacgcagccagagacagcuuggagacugccucaguaauuaacaaauaucaggggaugcucugaggcccugcaaauuccccuccuccggaagguucuggccccagacucucgugucccugugucugcugggaugugccugcgcccgucacccugcaggagccccgugcacugugccugcgggcacucaccuugccugcugcaggauccucccugugagggggcggcaugaugcaugguguccaucugcccagcccccagggaccugaugugaaauggggccgccgcgagugcccucgucugcaccuccagggguggacgggcuaggccagggguugggagcguucaauuuuaaaaacaguccaacagguuuccaaacccgugcucugauacgcgcagcacugggagugugcaggggcgccuguggcuucucccgugcauuggucuccugguccucugaccugcguuuccuuggcuguucuggaguucccgucgcuuccccugugggcugcucagcgugcuccucuucugugcaaucccguuggccucugugggcugcgucuucccuuuugcauuuguaggagccccucacgcgcuucuguuuccacaguccuucgucgguuguuuguagcaggcccucuggccugucacccgccuacagccaucuccucgggacucuuugcuguucuccuuguggggagggacggugugugaccaugugguccgcugcagggacccgccaaugaggggcaucuagcccccaaucacauccuccuaucccuuucucugcccccaaacccccagggcgaagagagccuccggauccugguggagcccgaaggggacagcuucccgcugauggagaucagcaccugugagguggguguccgggggccccucccgggccccaccuggcccugcucugccccuucaccugcgccuggccccaugccuccucccugcagaccgaggccuccgagcagugggacuauguccucguggcccaacgucacacccagagagacccccggcaggcgcggcagcaacaguuccuggaggagcucaggagaaagggcuuccacauuaaggugggcgggugcccagcgaggggcagggccauggggccggggcggguguccagcgaggggcagggccauggggcuggggcgggugcccagcgaggggcagggcuguggggccggucauggcggcacggagggccaggcuuggaggcucucuccugggcuggaggauuggggagaagcaggggcguggggagcgaggcagcuccguggcucugggccacagcggcagaugaagggaggguucugaggcggaauagaggggggaggguucugagguggaauagaggggggaggguucugaggcgggauagagcggggaggguucugaggugggauagaggaucccaugugcccccaggugauccgggaccagaaacaggucuucuuugggauccgugcugacaacagugucuuuggccuguaccgcacuuuccuccuggagccugaggggccugccccccacgccgagcuggccgcgccgaccaccaucccggucaccacgaggugagaggcugcacccagagccguggccaggagaaccccuugccaccugugugauugguccagaccgggcaggagacagugccaggcuccaggcgucgccaaggcaggacagccguguggucucagggcaggggccacaggugugagacccacuggcugugugagccucagcuuccccaucccauuaaaggaucacggugguucucaacgcucagagcauucugagggcuccguguggcugccuguguuccuggggacacagucacagccagccuuagggguugggcaggauuugcagaggcccaggggccccuccuggaucaaggccagugucucuugaagaccccuccucuccaguuccgaugccccuuccuggacaccgucccuggccuccaaggcaaagacccagaggcccagcagggacacccuccucgcucccuaaggcccugcuucuccccaguccuccagcccaggagggagccuccaagccuggcccuccaugcccccaugaccugcccagccccauccaggccccgcagggcucagccagggccugcuugguggaccggccaaggacacuccuggcauugguuacgaggcaguggagggcacccgugaagagagcuaugggucuuggggagucgcgaggcggcaucaaaggaggggagguggcuugagggggcugacgggagcaggcuuggggggcgcauaccugcgacgugcccugggguguccaggagccaugucuguaggcacagggggaggcugggagcccggcucugccgucggacgcuuggcugugccgcuucauggcuguguggccuugggacguucccuuuccugagccccagucucugcucugcacaguggaacagaacagcuccaggguauaaggagggugugugcggaugcaggcuggggugugcucuggacacauggggcccgcaggugggaggugugguugcaggugcgggcuguggucugggcuucugggagggacgggcugggaggagaaggagcccccagcccagccucauccuggacgccguggggcaggccaggcccugggagcacuuuaaggagggugcggggugggcucccgggugaguuguggauucugggcucuggucagggcuggcaggcugggggcucugccaggacagggaggggccugggccuggccagaccagagggcagguugagaccuggaggcaggguccacuguggucacacggggccacccugcucuggcucuugagucucagaauccgaaucgugaacuucguugucaugaacaacaagaccucggcuggugguaagggcagggguggggcacugacaggggcgcugcgggcaggguucucccagcaccucacucccccugacucgugaaccccugugacccagagaccuucgaggaucugaugaaggacggggucuuugaggccagguucccccugcacaaggugaggggugggcuggccuggagagggcccuggggugggacccugggaugggggcucucacucucugucacccgagccagggggagggacgccugaagaagacgugggcgcgguggagacacauguuccgggagcagccaguugaugaaaucagguaacgcugcccaaagagagcacaggaaccccgcggacggccccgccuccugcggacgcccccagauacccgcggacgcccccacacccccgcggaagcccccagauacccgcgggagcccccacacccccgcagacgcccccagauacccacgggagcccccacacccccgcggaagcccccagauacccgcgggagcccccacaccccugcagacgcccccagauacccgcgggagcccccacacccccgcagacgcccccagauacccgcggacgcccccacauccccgcagacgcccccagauacccgcgggagcccccacacccccgcagacgcccccagauacccgcgggagcccccacacccccgcagaagccccccagauacccgcggacgcccccacacccccgcggaagcccccagauacccacgggagcccccacacccccgcggacgcccccagauacccacgggagcccccacaccccugcggaagcccccagauacccgcggacgcccccacacccccgcggaagcccccagauacccgcgggagcccccacacccccgcagacgcccccagauacccacgggagcccccacacccccgcggaagcccccagauacccgcgggagcccccacacccccgcagacgcccccagauacccgcgggagcccccacacccccgcggacgcccccagauacccgcgggagcccccacacccccgcggacgccccuagauaccggcgggagcccccacacccccgcggacgcccccagauaccggcgggagcccccacacccccgcagacgcccccagauacccgcgugagcccccacacccccgcggaagcccccagauacccgcggacgcccccacaccccccagacauccacacacaccacccagaagccaccaccuccuguaaacgcccccacacaccacccagaagaugcucccacacugcccacacccucacagaugcccccacgcccacagaugugcuucccauucagacucacugaugccaccaaaagagagacccccucccccaccccccucccacccugucccucccccacugcccccucccucccccaucccuccccugccuugcccucccacccucaucccuccccgucccucuccugucccucccccgccaccccuucccaccccgucccucccccaucccuccccugcugcccccucccacccccaucccuuuccugucccucccccaccgcccccugacagcuggccuugaccccugcugccugcaggaacuacuuuggggaaaagguggcccuguacuucgucuggcugggcugguacaccuacaugcuggugccggccgcccugacgggccucuuagucuuucugagcggauucucgcuguuugaggccagccagaucaggugggccgcagcaggggccgggcauggggggccggggugggcccugcugccuggaggagccgaccccagccucaucccugccccuucagcaaggagaucugugaggcccacgacauccucauguguccccucggcgaccacagccgcagguaccagcggcucucggaaaccugcacuuuugccaagguuugucgccuccggguccaccccagggccugcggaagaugggaacggugcauccacccgaagcgggggagaucaaggccuggagcccugcagagcugcucagcuuuccccacagggcugacggggaggcccagccccagcccacccgcccauuuccucagcccaccugcccccuuccccggcuuuccugccucccucccuggcucaccugccccccuccccagcucacccaccuccucuccggcccaccuaucacccccccagcucacccaccucuuugacaaugauggcacggugguguucgccaucuucauggcucucuggggugaguugcugcgggacgccucugcggggccaggggaagugccagcccaagcuccgagguccaccuggcguagugcagugaugccccuccuugcccccgccgcagccacgguguuccuggagaucuggaagcggcagcgcgcccgcgugguccugcacugggaccuguacgugugggacgaggaacaggugagguggagcuggcagcgcagcugaggccgacccgagcaggggcuguuggcgcccgaugcccugcacggcccacauaugccugccgugucugaggugugugucccgagucugucuccccacauguggggcguguguccuggucuguccaccugugaggcgugucccugugucugucuccccacguguggggugagugucccgugucuguccacccgugaggcgugucgcugugucugucuccccacguguggggugcgugucccaugucugucuccccauguguggggugagugucccgugucuguccacccgugaggugugucccugugucugucuccccacguguggggugagugucccgugucuguccacccgugaggcgugucccugugucugucuccccacguguggggugagugucccgugucuguccacccaugaggcaugucccugugucugucuccccacgugugggaugagugucccgugucuguccacccgugaggcgugucccugugucugucuccccacguguggugugagugucccgugucuguccacccgugaggcgugucccugugucugucuccccacguguggggugcgugucccgugucugucuccccauguguggggugagugucccgugucuguccacccgugaggugugucucugugucugucuccccacauguggggugagugucccuugucugaggcuugcccggugcucuccccaggaggaaauggcacuucagcucauuaacugccccgacuacaagcuccggccauaccagcacuccuaccuacgcagcaccgucauccucguccugacccugcucaugguacgcaggggacaccgcgguggggcuggagacccgggcugcaugcccuccccggcccccgcccaccacagcugucccgcagaucugccucaugaucggcauggcccacguccugguggucuaccgcguccuggccuccgcgcucuucagcagcucggccgugcccuuccuggaggagcaggugaccacggccgugguggugaccggggcucuggugcacuaugugaccaucaucaucaugaccaagguggggccgggagcagggcaggcccgagcugggggguccaccggagccccagugagcccauucggugcccuccuccgcagaucaacaggugcguggcccugaagcuuugugacuucggugagaggacuaccccagacccucuugggggacccggcgggaggacucagggcuggggccuuggggcuguggucagagagcaggggaggggacccuuccugcugccccagggccucuccuaugagcagggagagaggugagggccggucccauuccagagaugcccaggaccuucucggagcgagagagcagguucaccauccgcuucuucacacugcaguucuucacccauuucucgucucucaucuacaucgccuucauccugggcagguagggccggcgccaggcucccuccaacccaacucacgagggcuuguuccacugccuuuaaaguggcaauguccauucuuuuaauuuuaaaaguaauuucugcugagagcaaguggaaauccaaucuagagacaugugagcaaagccugcagugagcccagcuccugaaucccgggccccgagguagcaucaagacagucugguggccucccaggcuuuuucaugcauuugcaggcgcauaacagcacuggcagaaauggcuuuguccugggaauaacugcaccugcucuuuaugcugaaaaugcacuuggugucuuccugggucugccugcccacacauccucguauacauguauauaugagagagagagagagagagacagagacagggucuugcugucgccaggcugguguccaguggcacaauguuggcucacugcagucuugaccuccugggucuccugaguagcugggauuacaggcgugcaccaccacacccagcuaauuuuaauauuuuuuguagaaauggggucucaccguguuacccaggcugguuucgaauuccugggcucgagcgauccuccugccucaguuucccaaaguguuaggauuucaggcgugagccacugcaccuggccaaaaaaaggugcauauggauugauggagccagaaagacucauuucacuaauuaggaaggcgaggugagagggaugcuggcugcagcuuuacuuuuuuuuugagauggagucucgcucugucgcccaggcuggagugcaguagcaugaucuuggcucgcuacaaccucugcuuccuggguucaagcaauucuccugccucagccuccugaguggcugggaccacaggugcgcaccaccacacccagcuaauuuuuguauuuuuuguagagaaaggguuucaccauguuggccaggcuggucucgagcuccugaccucaggugagccaccacgucuggcccuguagaugcugguucuugacccccauccgucuugggaaaggcgugcaccauggcuugcugugggccacgucucuccuggugggaccucucacucuggaagcuccugcgggugaacccuggucuccugucuggaggcagaaggacgcugucuaugugcugggaggccagcugggguuggggaggacaguguggggccucagugucaauugguccaacccugugugcugagucccugguuguucaaaccccuagugagcuucuaguccuccugaggggguuuuguggucagguaggaagcccagggaccuuccagcugggccugcauuccccuaaucagugcccccaagccaccagggguacccaagucccgaggcuuccuggggauccuggcagggcuggguugcuuccugagugucucccccgaaagccugaugucuugaguggacuucaggccucuccaauucccuuacaccucuaaggugaugccugguagugggugucagcagccugucauuuuauuuuuauuuauuuacuuuuagagacaguaucuugauccauugccccaggcuggaguacagugguaccauuacagcucacuacagccucaaacuccugguuccagcaauccuccugccucagccucccgaauagcugggacuacaggcaugugccaccaugccuggcuaauuuuuucuauuuuuuguagagaugggguuuugccauguugcccaggcuugucucgaacuccugggcucaagcaauccuccugccucggccucccaacgugcuacgggauaacaggugugagcuaccgcaccugcagucucaagcaauccuccugccuugguguccccacgugcugggaugacaggugugacccacugcaccugcagucgccauuuuaauugugacuugggaguuugcauuuacauuaacauagauccugcuaaagagaccuccagaaaggcugugucagugacaaagcuacccacagugugugaaacuauauguuccaucuugagcugaugggcaaagucuuuucauuuuuuaaaagugccuuuaaaaaacuacuggugaggggcugggcgagguggcucacgccugucaucucagcacuuugggaggccgaggcacgaggaucaugaggucaagagauugagaguauccuggcuaacacggugaaaccccaucucuacuaaaaaaaaauacaaaaaauuagccgggcgugguggcgggcaccuguagucccagcuacuggggaggcugaggcagaauggugugaacccgggaggcagagccugcagugagcugagaucgcgccacugcacuccagccugggcgacagagugagacuccgucucaaaaaaaacaaaacaaacaaacaaacaaaaaacaaaaaacaaaaaacuauuggugaagucuagcaucuuuccagauauuuacugaucauuguauuuuuuuuccuaugaauugacuguucauauuaucggagcauuuuuguuagguuaucguagcaugaaggccaggcuucuuucuugcuugcuuuuuuuuuuuuuuaacugucaguuucuuauaaucaugguauguuuuacuuugcaucauauuuguaacauuuauuguacagcucuuuguuuuuccuggaguuucuuuaucuuuuguuguuuuugauuuugucugccuuccaauccaucuccugggguuucuacuugccucuuuuucuugaaugucuuuaucaauuguauccagccucucugugguacaucguguauugcacggagucccuuuucuuccagagaucuuccuugggagccuuuuccucccgcgcgucccgucucuccacgccgccuuuugcucccgcgcgucccgucucuccacgccgccuuuuccucccgcgcgucccgucgcuccacgccgccuuuuccucccgcgcgucccgucucuccacgccgccuuuuccucccgcgcgucccgucucuccacgccgccuuuuccucccgcgcgucccgucucuccacgccgccuuuuccucccgcgcgucccgucucuccacgccgccuuuuccucccgcgcgucccgucucuccacgccgccuuuuccucccgcgcgucccgucuccccgccgccuuuuccucccgcgcgucccgucuccgcgccgccuuuuccucccgcgcgucccguguccaugucuccuccuuguaacaucuggagagauuuccuucacuuugugccuuuuucuccaucgauugauuucuuuguuuuacguuuaacaauuaaagucuuaauuucuaagaguguuuuguuuccucuuuauuuuuuauucacagcaucccuuccguguuuuuauguucuugaggauuucaauuagguuuuccuucucccugaguucucaucuguucccuaauuaucucuuguuuccuaaaggguccauuuuuguuuuuuaaucguuauucuccucuuacuccucugugaguaaaucucugugguuauucauucguauuaaagaccaaggaacugaauugauuuuucuugauggaugagaugggucuguauaauaguagcuacauccauugcccacucacacauucuaucauuaacucauuuaaucugcacaguagcccuauagggcagagcuucucucauugccauuuuacagaauagaugacugaggaccagagagguuaagaaauuaucuccaggacacacagccaguggguggcggaacagauaaaaaccacaaagucuggcucuagagcuuaguucugugccucuuugcauggggaggucucucggaaaacagcgugaaaaaucuaccugguuucucauguuacacuagagcaaauuuucuuuuugacaguauuccuuuaugguucuauuuuuucaugccacuccucaagauuaauaaauauguucaacugugggccaggugcaguggcuuaugccugaaaucccagcacuuugggaggcugaggcaggcagaucaccugaggucaggaguucaagaccagacuggccaacaugaagaaaccccgucucuacuagccaggcgugguggugugagccuguagucccagcuacucgggaggcugaggcacaagaaucacuugaacccaggaggcagagguugcagugaacugaaaucgcaccauugcgcuccagccugggugacagagugaggcuccaucucaaaugugugugugugugugugugugugugugugugugugugaguauucaacugugauuuccuuuagauguuuaugauuucaaaauauuaaacauuuggcugagugcaguggcucaugcuuguaaucccagcauuuugggaggccaagguaggaggauuacuugaggcugggaguucaagaccagccugggcaauguagugagacccacugcccccaaaccccccaccgcacgucucuacaaaaaauagaaaauuaguugggcguggugguuugggccuguaguccuagcuacuugggaggcugagguaggaggaucgcuggagccugggagguggaggcuauagugagccauaaucucaccauugcacuccagcccgagugacagagauccugucacaaaaacccuuaaaccuucaaaucccugacuuguaaggaauuuguuuugcugcaaggggcagaggaaggaaggcuguuuguuuguuuuccaaauggcacccaguuguccccaaaccauugauugacuaaccauccccaucaccauucuuaacuugaaaugccuucuucgucauacaccaaauuccauucuuugcuuauauauugucuucucauggauucugacaauuccaguaccagccccuugcugugcuggguauuauugcuuuaugccuugcuguaggguggggcuagcugcuguccaucacucuucuuuucuacuuuuuuaaugguuauuuacauauguuuauucuuucagaugaaugucagaaucauuuugucaaauugccaaaaauucugugagacuagcugggugugguggcucacgccuguaaucccagcacuuugggaggccgaggugggcggaucaugaggucaggaguucgagaccagccuggccagcauggugaaaccccgucuuuacuaaauauacaaaaauuagccaggcgugguggcgcgcaccuguaaucccagcuacucaggaggcugaggcaggagaaucacuuaaacccggaagguggagguuguagugagccaagaucaugccauugcacuccagccugggugacagagcaagacucugucugaaaaaaaaaaaaaaaauucugugggacuuggcuuaagauuguauaaguaaaaugauacauuauuuccaagaaaaucaccauaacaaacgaccacagcuuaguggcuucaaacaaucaaauuauuaccucccaguucugcaggccacaaguccuagaugagucccacugggugaaaacuaagggguuagcagggcugggcuccuucuggaggcuccaggggauaauucacuuucagcuucuccuuggugcacggcugcuccucccccugcagagcuugcagcguggggcugaguccuucugagugaguccugaguccuucugauuccuucugagucaggccagcucccagcugcucccuguccccacagagggacccuugugauuacaccagaaaaacccagauaacccaagauaaucuccccgucuuaaagucagcugauuagcagccuuaauaccaucugccuugugagauaaaauuccuuugccagguaagaacguggucacaggcuccaagaaugagcacguggacgucuuugcggcccaucgcucugacuacaaauacauccuccguuuucuuaugggagaacgagguucucccugcaagucuuucaugcuccuugguaguuuuauaguuuucuucauuuaggccccacagaugccuugugaguuucagucucguuaugguauaacuugugcuggugucugcgggugaccgauacuuucucaugccauguuuccccgcagcuuugccgcacacggaaaagccaguucugcuggaugcucguuuuguauccacuugagcacucgauugauuuauccacccaggcuuucaguuguuuuauuuugauuuuccagguacauaaucauguuuucuaaaagagucauuuuuuucuuugcaaauguauacuauuuauacuucauauuucucuugcuuauuugcaaggaauuccagaaccguguuaaauaccaguugucgugagcuacaauaggaaugcuuuugggauuucaccacugaccaugagccugacuuuugguuuaagauaguucauguauuucucauauuauggaaagcaggugauuuuaaacacaaaauaacccaucgugccguuuccacggggagaaaccgaggccacucguaacagacacugucuggagcguguguuggagccuguggccuugccugugugugugugugugcgcccacgugcaggugcgguucgucugggagccuguggccuccccugugugggggugugugugugugugcgcgcgcccacgugugggugcgguucaucugggagccuguggccuccccugugugugugugggugugugugcgcccacgugcaggugcgguucgucugggagccuguggccuccccugugugggggugugugugugugugcgcgcgcccacgugugggugcgguucaucugggagccuguggccuccccugugugugugugugugugugugcgugcccacgugcgggugcgguucaucugggugugagcaccugugccccgcucaccugcagggccugccccgccuguucugugucuuuccuacccgcuucuguccugcugcacccacccugucagaggcagggcgcugcccgcagugccccagacuuccccuuccuccccaggaucaacggccaccccgggaaguccacgcgccuggcgggcuuguggaagcuggaagaggucagucacccccaggcuucaugcccugucccugagccacugcuccccugaccgucccccaggaccccucccugaucuccuccugucuggccccgcagugccacgccagcggcugcaugauggaccucuucgugcagauggccaucaucaugggccugaagcagacgcucagcaacugcgucgaguaccuggucccgugagugccgacccccgcccagccccgggagccccaggccccuccgcccccugcgcccucccugccacgcagcucuccccgcaggugggugacccacaagugccgcucucugcgggccuccgaguccgggcaccugccccgggaccccgagcucagggacuggcggcgcaacuaccuucugaacccggucaacaccuucagccuguucgacgaguucauggagaugagugcgugggcgcugcggggcggggguucgcggagacgaaugcggggcggggguccgcggacaugagugcggggcgccggugagccugacccccaccgcgcagugauccaguacggcuucaccaccaucuucguggccgccuucccgcuggcgccgcugcucgcgcucuucagcaaccucguggagauccgccuggacgccaucaagauggucugguugcagcggcgccuggugccgcgcaaggccaaggacaucggucagaccgggcgggcgcaggaugggcgggaacugggcggccucaggccugugggcuucccgcuggccaggccggcucaccuggaaaaaauaaucucucggaucucaggccgcagacagcccccagcccuucuccgacggccucggaugcggguugagccugggugggaggguaccaggagugggcggggccgagcgcuuuguaggcuccucccacaaaccgucaggaucucagaggggcuugacgcccccaagggggacccagguucugccaguggcuggggcuggaacagagcagccggccucugucccaagacuggccacgcugagacggacaggcagcaggggagcgacgggagcuggggcgcuggauguggggaaagggagagagguguuagggaggcccccagucucgggcccagguuacaaggucuuacccuggggugggaacccaggagguggaguggcuggggggcacagcugagaaguucaggaagauggaggaugaggauucccagguuccucccuguccaugucagggugaggggugcaggagcgcagaggccaugcucugccauggcuggggacuuccuugugaauacugcagcccuagggcugcaaggggacaccacgcacagagacacggcaggccccguguuggccgggggugggggugagggcagaaccagccgagggacgcugagucagaccgcuugcccacugcucuggugcagggaccuggcugcaggugcuggagaccaucggugugcuggcggucauugccaaugggauggucauugccuucacaucugaguucaucccccgaguggucuacaaguaccgcuauagcccaugccugaaagaaggcaacucuacugucgaguaaggccucagggugucuggagaccccugggagaaacuggcccuaccacagccaagcccugggggauccagacccuuucuccugggaauggcuggaccuguugguaccccuggggcuuuagugaggcuggggccuggggguggccccugcccugcgcccacugacggcaggcccugggcuggaggucagggauaacuggccaggaccgcaguugggggugaaguucccagaccuggcugccuccugaguaggcccugccagaacggcucccucccgaugugagguuccgcauguccucuucugauuuauccagcucucugaccucgaggagccaccaaacugcagacuggguccccagggccagucucuggcagggaaaguggcuggugaugcccagaguccccacaguccccacaaggcccccggaugugaagaugugcuuggcccgggagccccgucccacuggacgcagucuguggcguggcccccaccucacuguuugcuccacaacgcaggcuagaagcacucuggggccugaaggggccgcccuggaagcccaccccaccccacacuccucuccccucuccccagcugccucaagggcuacgucaaccacagccuguccgucuuccacaccaaggacuuccaggacccugaugggauugagggcucagaaaacgugacucugugcagguuuggaacuccccaucccccaagaaugcccucugaacuccugaccccugaccucagguacuuccuuaccccagauacagggacuaccgcaauccccccgauuacaacuucuccgagcaguucugguuccuccuggccauccgccuggccuucgucauccucuuugaggugagccagaaccgggagaggccucggagugggucugggcagugcucuccccaguccuucuccccggcccugaacccccaaaugccagcuggcaccugaccgugcugggccucuccugugcugccgcuagcacguggccuugugcaucaagcucaucgccgccugguucgugcccgacaucccucagucggugaagaacaagguucuggaggugaaguaccagaggcugcgugagaagauguggcauggaaggcagaggcuggguggggugggggcaggcucucggcccccaaugccugcccaucccaccccagcauccaucuucagugccaggagcacagacguguagggccagagcccguccagaggccaccaggagcugagacagugccaccaccagcaccucccacaagcccaccgcugugcguguugaggggugcugugagaaggcugugcccauguggggccgcaggaauccccuguauguucagggcugugagcugccacccuauuccgccugcuccgucuuugugggggcucucaggcuuggcacagcccugacuugaacucugggugacccugggcacccacagaacugggagugagggcuccucaggcagccacaaggcaggaaaacuggcgcaaauuuccugggccucccucugacuucugggcgccagauccugccgugcccccauccuggcuguuggggguguccugagcccaccucgcuggccuguucccuucagccaacccguuucugcaguaaaauuaagccugucugucuugcuuuccuggccucgc

SEQ ID NO: 15468 - RNA, 690 nt, Homo sapiens
uuuuuuuuuaaagcgcugauccuguuuauuuggcaggaaaacuagacaaugcagcagcccaggagggacaggugggcuuaauccuccuccuuguggucuccagccccagccccacccuggcccuucuuggcauucuuccucuucacgcggcccgggcggccacccccauagggagagcacagagagaagucgaugugcuucugggaauccaggcggacaaugaaggacgggauguucaccaccugcuugcggacccugaaauggcgcuggcggaucagcacgcgagcgugguggauggacuuggccaagcccagcuugaagaccugggucuguaggcgucucucuaagaaauccucuaucuucaggcccaggauguaauccagcuucaucuugcccucauccagcaccccaaugcagaccagccgccacagcagggcauugccuucgaacagacgccguggguccuucugaucaagcgucagcaguucccgggcggccuugcggaucuuggccaggguaaauuugacccuccagaccucacguuuauuccggagcccauacucuucgaucagcuucagcucuuggucgagacgagauuucucaaaggaucuccgcggggucacguaaguuuugcgacaaacccagcuccgggccacuggcauguuggcuccccuaacccgucugcgccua

SEQ ID NO: 15469 - RNA, 4569 nt, Homo sapiens
ccucaguggccuugugagcggcauagcgaacaggacgggggucucacauagguggggcggccucugccgccgucugucugcgugcugcaccuagggccugcuccugagcagggcaggcgagggagcccagcuuuggcccugggcucuggcccggaacaucuggaugugaaagggcauuuggugauugcaccucuuucuccagaucugccacagcaagaguggagagaucaaccccgugaagguggccaaccuggugaaggcguacguggacaaguacaggcacaugcgcaggcacaagaaaccagaggccggggaggagccgcccacgcagggggccgagggcugaggccaggcaaucacgggcuaugcccggggagcugucgggaguggcgggaaucggggccaugcccggggagcugucgggaguggcgggaaucggggccaugcccggggagcugucgggaguggcgggaaauggggggcaucaccaugccugccgucggguuccugcgcugacaccuggucugugcaccuguguugcucacaguugaaaacuggacacuuuuguauguauauuauagagacacuguuuccauucuaauuuaucaaaaauggauuaucuuuagaaaccucuugauugacuuacuacuuggaagauaaagcacuuggugaucaagaggggcuccuggugggguggcgcguccuugauaaaucucuagguggccucccgccaacagcugcuguguaccuuuggcucugaauuaggaauaucuuuacuuucucuuuuccaauuauguugugcucuuguaaauaauugcucgaguuugcacucaacaccguugccuccuggaggcagggugcagcaguggcagccugagggcuggcgacagguguccugcauggggaaaugcugucccugcccuuggcacagcuggugggaguggcuuuggcggccacuggccugucaagggucuuguucuuugagucaaagcuuggcugugauguguguggugaagacagaagugaguuggugugcagggaggccguggagguccccucccucccugggccucacccguguucagccuggacccaauuccccaccagccaagaugccaguacguguucuggaguucuuuuuauuagacugggcggccgcggccagcucuaggugggcugcuccagcuuucuggaguucucauuagacuggguucuaggcgggcugcuccagcuccauaaggaagcacucgaugucgucauagaggcuguuggcgcuggacaggcagaggcugaggcugcugcuauccagggaagacacacccucacgcugcgugcccucuaggugcacucggcacagccaggguuccagcugccaggagggaucgggcgucugucagugacccggcguguguccuccccucccccuccccaggcucugagggcgucgggcgucugucagugacccgguguauggccuccccucccccucuccgaggcucugagggcaucaggcgucugucagugggccugagcacauggccuccccuccuugaggcucuggucucaccuucaccaggaccaggcucuucuccuugggccucccagcugacagguccugcccgaagcccagguagaugguauagcguggggagccacggcgcugccgugcccggaauuccaccagcucugaagaaggggacucugcugaguaccuggcaggcaggugcucccaaggaccccuggagacagccccccaggcaagggccucacugaccuuggaagaagacucugaagucgaagaugggggugucacaguuccgaggcagcaggcaggcugggguggaggggcuggcggagccuggggguccgcccaccucccaguacaccuugcacuugcccaugcgccgggcccacagcuguggcccccgaagcuccaggugcaacccaggggccacgugccgcagcaguuccuccguguagcgcagcugcuucugguccgggagcucggcagggcuggggaaugcuaccugcugggggucuguggcccggacagcugggucuggggggccguauaggaacgugcagcucgggugucccaccaccuucugcagcaccgugcggcccuuguacaugauggucacguccagcgccccugggcugggcucuguguggagaccaagcugugagugacgggggugggcggggacaggcugugagugacgggggugggcggggacaggaugugagugacgggggugggcggggacaggaugugagugaugggugggcggggacaagccgugagugacgggggugggcggggacaggcugccccuuccugggaugcacucaccuugcaccgcggugcaggcgcuuggggagggugacagguacggcucugccuggugcggggacucuggggccgcggccucgccugcauccggaagggaauccugugcuggcaccucaucccuagccucucccugugccccaggccucccaaccccuaccccucucaccugucguuagugccgcgggcuggggcccggggcugggggucgucucuacugcccacccguacagcuccccagcagggagcccugggccugaggaggggaggacagugggaacggugguccccuccuaauucuccagcuccccaauccccagcccccuucuaaaguguccguccaggugcacuggccccucccgcgcucccccccuccccgggcacgcccacaccuccagcacaggccccagucaggggaagcccuucuugucccucuccaggagccuugguugggacuggaucugccccccaugacgcugucagcagauggucugccaggcagcucuguugcacugccuggagcaggaggucccccuugucaccagcuggggcagggagggggccuggggcuuggaguccagcaugugugugugccaggaauggcccugggggcccacccugcagggaaaagucagggugaacguaagcagcuccgcggccuggcaggaggagaggcaggcagagagaaggguaccugugguggugggacagcugcgggggccucugccucagucugguccgugccugggccuucugagagagaauggggcaggcguuaggccccgacaccagagugagagauacaaggagagccugguguagcccccaccagcuuccuggcugugaacccuuaggcuguggccugaggagguggggauguggcucuccaccuguccugggccugcuggcagccucucccagaacagcuucuaaaaccacaaaucugacccagagaauguuccccuuugcccaagcaggacgaaugccaacgcccuuggcagccggcgucgcucaccucgccagcacagcucccggcugagcgcguacaccuugugcgggucggccgggucccccgaguuaucccgcagcaucacgaagcgacgcgugcugcgcagugcgcagcggaaguugguuuuccagccggcgcgcuccgcagucucagccucggggggcgggccaccuccccugcugcuaggcggccaccugccgcgggccacagcccaggccugaagagggggacagaacacgugugccgggcccgcgggguccuaggcgggcucucccacccggggcggggcggggcugggguccccaccuugaagaugcgcgcgucggccucgcucagguccuugcgcgcgaagugcuuccagggcacgcggaaacaggugcgggccucguccagccacugcagccccucauagcagccgcugcugaucucuccaaggagccacucuccgaacagcacgcguggggcugcccugcgggugcccggccgcggagagucagggccggcugcagggcgcucggggacuggcaucuggagagggugggccgggcucuuaccucucaggagccaaggccauugcuccuucugcaggggcaguuagguggcggucagguguuauaacaggggagguaagggcuccugucgcagcagacgccaggccgcggccacaggucguguggccaggugucacagguguccacagguguggacugagggcuuguagccaccgacgcugccucgguauggaucucuuggcagagggggcuacaggugugacugcagguguggccggcgcgcacacaugaagucacagguguugaaccaguguccaggccuggcgggaaggcgcaggccggacccugcggagacgggaaaggcgacgucaggggcgggucaggcucccgggaaagcgaaaccuaaacaguggcgcuucgcacccuccucgaucccaccccguccgguucucagcuccgcggaaccccgccuccgccuccgccucccuccccgcccgacccucaucucucaggcucccccagcucuuggcucuaccccuccggggucacggagcccccacggaggcucucgcucccggccugcaccgcgugggucugggguccccaguaccugggugccagagccgccgggacgggaaguuucgucucgcggggaagcggagggccggcgcuuuuaugguggccaggcgggaguuucc

SEQ ID NO: 15470 - RNA, 4569 nt, Homo sapiens
ggaaacucccgccuggccaccauaaaagcgccggcccuccgcuuccccgcgagacgaaacuucccgucccggcggcucuggcacccagguacuggggaccccagacccacgcggugcaggccgggagcgagagccuccgugggggcuccgugaccccggagggguagagccaagagcugggggagccugagagaugagggucgggcggggagggaggcggaggcggaggcgggguuccgcggagcugagaaccggacggggugggaucgaggagggugcgaagcgccacuguuuagguuucgcuuucccgggagccugacccgccccugacgucgccuuucccgucuccgcaggguccggccugcgccuucccgccaggccuggacacugguucaacaccugugacuucaugugugcgcgccggccacaccugcagucacaccuguagcccccucugccaagagauccauaccgaggcagcgucgguggcuacaagcccucaguccacaccuguggacaccugugacaccuggccacacgaccuguggccgcggccuggcgucugcugcgacaggagcccuuaccuccccuguuauaacaccugaccgccaccuaacugccccugcagaaggagcaauggccuuggcuccugagagguaagagcccggcccacccucuccagaugccaguccccgagcgcccugcagccggcccugacucuccgcggccgggcacccgcagggcagccccacgcgugcuguucggagaguggcuccuuggagagaucagcagcggcugcuaugaggggcugcaguggcuggacgaggcccgcaccuguuuccgcgugcccuggaagcacuucgcgcgcaaggaccugagcgaggccgacgcgcgcaucuucaagguggggaccccagccccgccccgccccgggugggagagcccgccuaggaccccgcgggcccggcacacguguucugucccccucuucaggccugggcuguggcccgcggcagguggccgccuagcagcaggggagguggcccgccccccgaggcugagacugcggagcgcgccggcuggaaaaccaacuuccgcugcgcacugcgcagcacgcgucgcuucgugaugcugcgggauaacucgggggacccggccgacccgcacaagguguacgcgcucagccgggagcugugcuggcgaggugagcgacgccggcugccaagggcguuggcauucguccugcuugggcaaaggggaacauucucugggucagauuugugguuuuagaagcuguucugggagaggcugccagcaggcccaggacagguggagagccacauccccaccuccucaggccacagccuaaggguucacagccaggaagcuggugggggcuacaccaggcucuccuuguaucucucacucuggugucggggccuaacgccugccccauucucucucagaaggcccaggcacggaccagacugaggcagaggcccccgcagcugucccaccaccacagguacccuucucucugccugccucuccuccugccaggccgcggagcugcuuacguucacccugacuuuucccugcagggugggcccccagggccauuccuggcacacacacaugcuggacuccaagccccaggcccccucccugccccagcuggugacaagggggaccuccugcuccaggcagugcaacagagcugccuggcagaccaucugcugacagcgucauggggggcagauccagucccaaccaaggcuccuggagagggacaagaagggcuuccccugacuggggccugugcuggaggugugggcgugcccggggagggggggagcgcgggaggggccagugcaccuggacggacacuuuagaagggggcuggggauuggggagcuggagaauuaggaggggaccaccguucccacuguccuccccuccucaggcccagggcucccugcuggggagcuguacgggugggcaguagagacgacccccagccccgggccccagcccgcggcacuaacgacaggugagagggguagggguugggaggccuggggcacagggagaggcuagggaugaggugccagcacaggauucccuuccggaugcaggcgaggccgcggccccagaguccccgcaccaggcagagccguaccugucacccuccccaagcgccugcaccgcggugcaaggugagugcaucccaggaaggggcagccuguccccgcccacccccgucacucacggcuuguccccgcccacccaucacucacauccuguccccgcccacccccgucacucacauccuguccccgcccacccccgucacucacagccuguccccgcccacccccgucacucacagcuuggucuccacacagagcccagcccaggggcgcuggacgugaccaucauguacaagggccgcacggugcugcagaagguggugggacacccgagcugcacguuccuauacggccccccagacccagcuguccgggccacagacccccagcagguagcauuccccagcccugccgagcucccggaccagaagcagcugcgcuacacggaggaacugcugcggcacguggccccuggguugcaccuggagcuucgggggccacagcugugggcccggcgcaugggcaagugcaagguguacugggaggugggcggacccccaggcuccgccagccccuccaccccagccugccugcugccucggaacugugacacccccaucuucgacuucagagucuucuuccaaggucagugaggcccuugccuggggggcugucuccagggguccuugggagcaccugccugccagguacucagcagaguccccuucuucagagcugguggaauuccgggcacggcagcgccguggcuccccacgcuauaccaucuaccugggcuucgggcaggaccugucagcugggaggcccaaggagaagagccugguccuggugaaggugagaccagagccucaaggaggggaggccaugugcucaggcccacugacagacgccugaugcccucagagccucggagagggggaggggaggccauacaccgggucacugacagacgcccgacgcccucagagccuggggagggggaggggaggacacacgccgggucacugacagacgcccgaucccuccuggcagcuggaacccuggcugugccgagugcaccuagagggcacgcagcgugagggugugucuucccuggauagcagcagccucagccucugccuguccagcgccaacagccucuaugacgacaucgagugcuuccuuauggagcuggagcagcccgccuagaacccagucuaaugagaacuccagaaagcuggagcagcccaccuagagcuggccgcggccgcccagucuaauaaaaagaacuccagaacacguacuggcaucuuggcugguggggaauuggguccaggcugaacacgggugaggcccagggagggaggggaccuccacggccucccugcacaccaacucacuucugucuucaccacacacaucacagccaagcuuugacucaaagaacaagacccuugacaggccaguggccgccaaagccacucccaccagcugugccaagggcagggacagcauuuccccaugcaggacaccugucgccagcccucaggcugccacugcugcacccugccuccaggaggcaacgguguugagugcaaacucgagcaauuauuuacaagagcacaacauaauuggaaaagagaaaguaaagauauuccuaauucagagccaaagguacacagcagcuguuggcgggaggccaccuagagauuuaucaaggacgcgccaccccaccaggagccccucuugaucaccaagugcuuuaucuuccaaguaguaagucaaucaagagguuucuaaagauaauccauuuuugauaaauuagaauggaaacagugucucuauaauauacauacaaaaguguccaguuuucaacugugagcaacacaggugcacagaccaggugucagcgcaggaacccgacggcaggcauggugaugccccccauuucccgccacucccgacagcuccccgggcauggccccgauucccgccacucccgacagcuccccgggcauggccccgauucccgccacucccgacagcuccccgggcauagcccgugauugccuggccucagcccucggcccccugcgugggcggcuccuccccggccucugguuucuugugccugcgcaugugccuguacuuguccacguacgccuucaccagguuggccaccuucacgggguugaucucuccacucuugcuguggcagaucuggagaaagaggugcaaucaccaaaugcccuuucacauccagauguuccgggccagagcccagggccaaagcugggcucccucgccugcccugcucaggagcaggcccuaggugcagcacgcagacagacggcggcagaggccgccccaccuaugugagacccccguccuguucgcuaugccgcucacaaggccacugagg

SEQ ID NO: 15471 - RNA, 7121 nt, Homo sapiens
cccggccgccagggcacgugacccgcgaacucccgggcgcgcccagacgccgcgcacgcgcagacccagcgccgagcccgagccauggcguccgagcggcucccuaacaggcccgccugucugcucguggccagcggcgccgccgaaggugaggcccggcggccggggccaguguccgaagagcguccgcgagggggcugcccggggcgggagguucgggacacggugggcgcgcgucacguggcgccggaggccgaggccgcugggggcgccgggcaggggccgggggagggcggagcggggucggugucgggauggagcucggggcggggacgggggcggggguggggucgcggguuggugggauggagcucggggcggggucggggggucgugauggaucccggcgccgcgucgcuccuccgagucucgucugcccggcgaggcggcccgggcccgacguuucuagcggagggagccgcgugccugggccuggucucugaggccgcugcgcugcgagaggggagcccggguguggggaggggccauuccgggaguugacccagcucugaggucgggcggccgcggggacccugaccuucugagccaccggcuucugaggagacccggagcccccuccuggagaaggcgccccgcggcccccguccuggggcaaggguaccagggcaguacuggccuggggcucacgcgggucggagcgcagcggggugcguccccuggcgcugagccugcagggucucagggcagcaggggagggaugagcagcggagcacgagggugccuggccuuguucugagccuuuuggagagggaagugagcagcccaaggucaccgcaccacggagaggugggggccgggguugcgacccaggggucugccucuugaagucuguagcuccucaaguguggacggggagauggggcugugggguuguggcgucacgaugugcugagcuccagggguccugagugaugcccccagacugcgggugggaggagccucgagugggguucaguccuggggggguggguuggggcuuguuuccagagcagguaggcgugaggagguccggcauguugaggacguggggucuuagcgccagcaggcugggggcagcacuucaggaggccggaagggcgggcagcugggggaacagagccugcggcagucuacugggcacuuuguuuuuccucgauaaguggacauuuuacagugaauauguauuaacuuauauaagaaugaagagucugggcgcaguggcucacgccuguaaucccagcacuuugggaggcugaggcgggcggaucacgaggucaagagaucgagaccauucuggcuaaaacagugaaacuccgucucuacuaaaaguacaaaaauuagcugggcgugguggcacccuccuguagucccagcuacucgggaggcugaggcaggagaauugcuugagccuggaagguggagguugcagugagccgagaucgcaccacugcacuccagccuggcgacagaccgagacuccgucucaaaaaaaaaaaaaaaaaaaaaaaaagaaugaagauaaaaaugaagcugagggauugggccccagaguuaaaauaaauguagagagauacagcucacgcuacuuuggaauaaacuuguaagugcucuccggcaggcagggugggcggggcuguguccuuccccugguaggacagaggcccccagagccuucuggauugggugugguguguugaguuucuuuuuuaaaaguuuuuugaggggccgaaggaugcuaggaagagcuggcgggggagggguauaaucccagaacccuugugaggaaagggucccucugagcggcuucccuggaaggggugagggggggccaggacacuucugcguucuccauggugccugagggccugagucccuggugguucagugagaggaugagcugaacucugugacccucacacccggguuugccuuucagaaaggucucucguggcucuguuagcacuaggaugaggcuggggugugggaguggcauggacaguugaggugggcugcauccucucccagcuucuggcugaggcuggaggugacagugccaggcuggggaaagagcccgccaugggggaugcaggcccggggauggccuaccguucuggcagaccuggcugugccccucugacucaugccuucccagcuuccuucuccuggacgugaauggguggcuggcccugccccagggcuucaaguagucguucuuggguguaggggagagggcugcuccucagcguguucuggggucagucgaggccaugggggugucuggguagcccccugaggcggggcacgcuaguccugucgagcccacacucacugggaccuucugcaggugugucggcccaguccuuccuccacuguuucacgauggccagcaccgccuucaaccugcagguggccaccccugggguaaguccagccucuccuuccccacuggacacuuggggucugucuccaccucuccgggggcaaggucaggagacugccgccgcggccugggaggaguggggagccccugcaguugguggaggggugaagagucuguaaccaaacccugguggcgucccccugucccaguccccauuuccugggcucugaucccccaucugugaugagggagaccuuuucuuuuccuuuuuuuuuugagauggaguuucgcucuuguugcccaggcuggagugcgguggugcgaucucggcucaccacaaccuccgccucccggguucaagcaguccuccugccucagccucccgaguagcugggauuacaggcaugcgccaccacgcccagcucauuuuguauuuuuaguagagauggguuuucaccguguuggccaggauggucucgaacucccaaccucaggugacccacccgccucggccucccaaagugcugggauuauaggcgugagccucugcacccagcccaagggagaccuuuuugcugugggucugugcuucugcacgugugugaggaggagaccaaggcgcagcccuggugugaggggcacauguuuccacugggaggaauucuccacccucugaucgugggggacccagggauaucagauguacauaagucauaguaaggaugcauuauguauuugucacugcggguuuuuguuuauuuauuauguauaaaaauuuuugguugguggguuggcuaggaaauaaaccacugaggcugcugcugggacaggcuccccgacccugggagaucccgugaaggaggcuggguggucgggggccuuugugccucagggggaugcuguugggucccuugucagcuuuuucaggcucccucugagccgacagggauaucccuggugcugacccucggccccugggcucugcuucuccaggggaaagccauggaauuuguggaugugacugagagcaaugcacgcugggugcaagacuuccgccucaaggcuuacgccagccccgccaagcucgaguccaucgaugguaggcccgggacccacuccuuggggguggggugccugggaccuuggagggucaaggguuccagauagguuuggggucuuagugagcucccuagcucagccccugaagcccugugaccauuuggggcagccuccagccccacauccugggccccagaguuucugagccccucuggggaggagaguuggugaguguguggagacaggaaagucaggggggcccuugggagcuguagcccauggaggaaaagggacagaugacaucaccaggcuggcuggucccuguggagggucuguccuggccacgcacucgggccugguccugcagguagucucacuuugacauguggcugcuaccugguuuguggucuccccccaggugcccgguaccaugcccuccugauccccagcuguccuggggcccugaccgaccuggccagcaguggcucccuggcccguauccugcagcacuuccacucugagagcaguaggugaccccugggacccaggggagggguuggaugugcagugucacaagaaaugggucucccaccagcagaagagaggugggaagacuccagguaggcguuucuggaucucuggucaguggccacugcagugguugugggcaggaggcagggacugccccuucccccgacacacacagacuuugucgucuccuggugaccaucuugcaggccucugggugggcucccgaggguggguggccaugcccuccugagcaaggcaggacaccggccugauuccuucugggaaagccuggcauccagggcugggcuuggggcucaaggccagcaggggugcagggaggaaggcuguuugaggagaccuggcagcugccccggcuccggguugggcugugaugaguguguccacuggccgggguggacaagccagcgcucuacacagcacccuuuguguguuggaguggggccgccguccccagcauggccuggacaggcagcaauuguuuguggccaccucagccgugggaacacacucagccuuucggauggagccaggauguccccacugcaaggcacaggcauugccucaggcuaccucccaccugcccaggggcguccugucuagccggggaggggccuuucccacagugccugccaggcuaugcaguggggcugccgggcagcguccuaggguuugguaaacagaccuggaaccucaggaccuccucucugcgugugucucggcugccaaaaccugagauuugggcucuaaaccagagccuaguccugaagcaccagcucccccgagcagauuccugaugccagcugugcgggcugagccaggacacccgggugcugaguccaguuuccagggaaaccugggaggaggggccaggcaggcggcacaagccugggggagccacaagcaggggcaucugggaggggcuucagggugcggguggcgggguccagggccucaacgccauguacggcuuucagaacccaucugcgccgucggccacggugucgccgcccugugcugugccaccaacgaggacagauccuggguguucgacagcuacagccugacaggggugagugucuggaggccgaggcacgcugugcucccugcucuguccucccccaucacagccagaggugaggucggaggcuccagggugagugccuggaggccgaggcacgcugugcucccugcucuguccucccccaucacagccagaggugaggucggaggcuccagggugagugccuggaggccgaggcaggcugugcucccugcucuguccucccccaucacagccagaggugaggucggaggcucccgaaccucuggccccuagucucccggaagcccaggcccacucaccaggggacguggggagggaggggcaucagacuugcgugugcagucaggaggggcugagagcccagccaggguguccucggagacacagccuuugucaaucugaggcccaaaggcugugaagugggcucuguggacacugggggcggcugugggaguggcugauccacaggcccugaggcagggagagguggcugcugugcggaggcugguuucacuggaaguuaaacaggccuggcccccagcucagaugucacuuccccugcugaggggacccuuccucaguggguacucaguggugcccuccgaggggugacaccaacccagucucagguuacaagugggcgugaccccuugagugagugguuagauucacuccugcccagagggugccccgccccagcacucugcccaaggggcucaccccaccaagcccuucucauucuagucaccugugugcuccggugcugggggagcuggcccguccuccuguaguggccgugucgcucucagggacaccccaugggaagauggcuagacuuugucaucucuccgcccuccagccuuagcagcugucccuguuaugagcagugacacccccggucccacuugguugggugaggcucccugcccugacuugaccuuccugaccccuggggugggccgcagggccugggccugucucaggagcccccaccccgcucccgcagcccucugugugugagcucgucagggcccccggcuucgcccgccugccgcucgugguggaggacuucgugaaggauucgggcgccugcuucaguggugagccucgagggugcccccugcacuuacagaagaugggguggggggcuucccugcugcagccugggggagaagccuccugggcccuggguucuauagacccccauggcacugacucagacccagacaggcugaccuacugcugacccugggagcccgccuggaguucgaggcucucagugggugagguggacauugccugagguuggugcccucgguccuccccagcaagcgagccugacgcuguccacgucgugcuggaccgccaccuggucacaggccagaaugccagcuccacugucccggccgugcagaaccugcucuuccucuguggcagccggugagggcaccagggugggcacauuccugccacaucagagcugcacccggugcuuuugcccaagcuuugaccacacgucuguccugcaggaaaugaaccugcuggguagaugcacccccugagacagcccaggugucuccagaggcagccccgucucaggcuucagggaccccgccucuucccuccugacaagggcccuggauggcagccuggucuggcccugaugggauuguuggaggccuccuggaaucagcucugagggggugucggcucuccuggaggguccaaacccccauccuccugcauguucucugguaggaggcagagaaaagaccccacgugccuggagagcugugcuagcugcuaggugguccucgggaauuccaggcuggguuuucuagggaggacugguugucacguguggucacuguugacuagacagagucggcucggggguccucuguguggguuugcccugcuguggccugucugccacccaccaccucuuucacuguuggugggggccuugaggggagggcccagccggcgggagcuggcucagaacuu

SEQ ID NO: 15472 - RNA, 8147 nt, Homo sapiens
uuccacggaucaccugugucugcccuggaggccacgccucccccagggcacccucauccaccggcgcucugccaccugcccgcgccccgcggguccuugugccugcaggggccugaggcccggaaaccaagaaaggaccuuggggacgcgcggcccggccucugcgcgcagaacugccacccugcccgggggaacccacggccagggggcgggugggcgcguggcuguggccuggcugggcgcaguagccucgacggccaggagggggagccgaagcccggaggaggccgagggcggagcgcgcgcggcgccgagcggacgcgccuccccgccuaggugcuggccgagcgcggggcgggcaggcgagcgcggcggcggcggcgagcguggugagugucugcccggcggcucccuucugcugcgcccauccgaacgcggccgggcugcgggggcgagaggugcugcggcggccgagggaggugacagcugcccgaacaacguggccuggcgggcgggaggggggguccuggaccagcggaugcuccgauccgcggcugcucuggcgugagacgccgugcucggccccgacgguuccgggcgcgcuccccgcacauacguguccccgaggguggguguccggggcccgagcccaaggaagaaaggccgacccgugugggacgcacacgugggaguucaccggacaucuguggacacgugcguggccggagucgcgguggccaggcggaggacggagcggucggcugagccccagcaguagggcaggggccugagccggccuccgagcgcagagagcggcccccaacccgcuucuccuuuguccucuggccgaggcaucgcgcaguuggaguccccuuccgggacccuccagccagcaggauagaaagcaccgccccaagaggacggggacagcgggagauugaauggggagccgccggccagacucggagccucacccccauugccuuucuuggggguaggaggagccuggcggcuucuuggguggaggauuuuaccccugcagauucggaagcagcgguaucuuccugugggguggucucugcucuccugcugucucccuggcuugccuguggccucaguucaccugacuaugaaggggggacagugacggcucacagcccggggcccggcuggggcugcaggguuucuauagcaacaucagugcagggggagggcccuggccagcugucucauaaaccaggggugggaacugccgagugagggcagagaaaggcgggguuggcguucagagggaaccccugccgguucuuccccaggcagagccccucacugucaucauucuccacccagaagcuccucuccgcugcacugggugacgugcgggcccaggccugccucuccgcccugggaucucugggccugcuucucuucuugggacgaauggccgcuccccaccucggucggccugacuuccaggauugccccuaucaugcagguguccucaucccagacuggagauaggcucccaggaggaaggggguugcucagucccuggagggccaggguacaccccugggagggacuagaguggagaugaagggcccagcgcagcccggagagcuguggccagucugcacccgaagaguggggcggcagggguggggggggcuaggagggaucagguagaaguucagaggucagcuugucaccaccacuggcugaggcagggaaaggcaggucugacggugaagcccugagugggacgggugguggggcagagggcucugggcaugccagcucgugugcccucuggaccugccaggugagcagggccuguggguggcaacaguggccucuggcacccagcuagcucuucccuguggacagcaggccuuuuuuguggcccagcaugaggcuucccugacaugcaucugccccuagcagacacacaucccacagacacgaguggguguuagcccaucucugcuccacagcaccggauucccuguccagguacauacaggguacccuggcccggagaaagccucauucucagaguaccagcccuagacagauccaggccaggaaaugcuauaggguucaacccacaggcagcagacaggaacacaugugugcugggggugugguggccacgcgcugaggucccugucgguggguggccucgcugugccaggucagccugagucagacccaccccugcucaucucuccucucaaggcugccggaagccucugcuugcccaaagugaaagagaaagugcccccccacccaagcccgccccaccccgccccacggccaaucccugcggccccucgccuccucccccggcagcuuccccuucugugugagugcugggcuggaguguggaagagccauccagagugagugccuggggcagagugagagcaggaccagcgggcagguggcggagcgggggucggugguggauggcccagcccuggaaagccgaggugaagguuacgagucccugaggaucugugggugugagccagccgcguggcccugggcaacggcgcugccggugggugaaacagcuggccucuggggggcccagggaggggggaaaggcccccgaagcugggauuuuauggccaugacccuaugggaggccccugaggcuggcuguggcuccccagccuugcugcuuagugggagaggccuguccucuccuccucuguaguggaugggggugccagccacagggggccucagaaggccagccaucccccacccccaaggcuuccaggggucccaucacuggcuucuguguguccaugagugaaacuccugggagggguggaggggaggaaggggcgggcaaggggcuggcuguggggggugugggcaucguggggaggagcucugcaggcccuagguggagcugccaugggaggagagcuauaccugggauagcugagcccaggucggggggucuuagggcgcccgggaccccagccccuagcucgaagggggcaggugccggcugcugcucucucugugcugaaggaugugggggauggucaccacagcuguccaggucgaggugcuccgguaggcacccuggccccggccccuggcacugcccccagaggugccuggcccuuuaaaagccggagcuggcuggggugcacgugagccccgagcgugagcggcgugugaggcuggcugggaagacgcuggcgguggggagggggggacugaaaggaagccagguggucccaggggugagcaugggacuggguggcaggugccucccgcugcugcacccucaggacgcagugacggcuucagucugggguggugggugaggggcugcgugagagagggaggcugggggaggauuacucuucggguggccccacccucacucauucccauucccucauccuucuaggacagaaguggcgguugcugacgccuggaaauuccccugaagguggagcaccacccaaccccccugggucccacccucccucaaggccuccuccaccuccaccuccaccccgccuggccuggcguccaccucugcggcuccuaccugggugcaaucgaguuaaauggcugauaagcagaucaggucagacuccaguccuggcugcgugccucacccccacccugacccauggucaaggaagccgguccugacaccccuguccacacagccugccagccaagcucaucaauggcggcaucgccgggcugaucggugucaccugcguguuucccaucgaccuggccaagaccaggcugcagaaccagcagaacggccagcgcguguacacgagcaugugagugugccgggcggucgcggggagugggcccagcauguggcagcaggagaggugggggcucugcuccugugccccccacccuguuugacagaagggaaacgggaggcaggcgggccuaggggagaucccacgugggucaggacuggggucggggcugggcugaggacuuggccucuucuaucagcccuagacaguccagggacccuggccuccggcuggccccagcuggcccuggcucacccuguccccuuggccacagguccgacugccucaucaagaccguccgcuccgagggcuacuucggcauguaccggggugagguuuggcucggcugggcucgauaugggcaggccuggguagcgcccgcgagucguggcagggagcggugggggaggcagggcagggcggccagccugggccuggugugugagcguggacguguuugugggggcugugccugugcaggggggacuggaucucuggugagugguaguucucagccucucccguggcagcuccccacccccacuuagugccuggugcgugggaugccaugguacaucugucucuucucugguggccacagcugccucugccuucugggccaggcuggaccccguuuguggcuggggaugggagggaguaaggggcauuaccgcaaagcagcuuaggacacaauccagagccuagauuuggcagaagcucuccagcccugagccuucggcacugagaugggggcucuccacagccucccccgagcucuggcccaguccagaccacacacuccugugaccucuggccccagcccccugccagcacaagcaccaucuguccuccagggagggagagguauccuagggaggccucaggggcuccggggcaguccucaugcccugagcagcaagaugcugcccagaaucagagacagauggagcugcagugggcaugggagagccugagccugaggugcugccccaucccugccuggccccgccccaccuggcacacaccaggcccaaaugugggugagagaacagaugguggccaggagugacugggacaggguuuugccagccaggaggcaaguccuggccaagcgccuccccacucaggccaccgagcauguccccccagcugacccccugccccacaggagcugcugugaacuugacccucgucacccccgagaaggccaucaagcuggcagccaacgacuucuuccgacaucagcucucuaaggacgggugaggguucugccuggcagacacucgaggggucuuuggcuucagauaaaggauggguccacccugccagcugggucccaccugggggcucugccugucuucagccccuugcuuggggcuucuuugaccucguggggcacccucccuccuuuccccugaccaggggagcaaagcagaugucaaaucaguggggcucuggcuugguagcccuuggccugagggcacugaccagcucccccaucacuggagggggacugcaagggcagccccuuuuuggggcacuugacccccaauuucccauuuuccuuugucgcagacagccccacugcccuccccaggccccugccuguggggccgucuguccaucggucuccucccugccugcugcugcaguggcggaggcugggggcuguacccccacaggccugcaucugccuccacggcucccaccauccucugcgcccaggcauggugggcagccccgaggguggcagguagaccugucucuucccacuuacugcggccccgccccuaccacaggcagaagcugacccugcuuaaagagaugcuggcgggcuguggggcuggcaccugccaggugaucgugaccacgcccauggagaugcugaagauccagcugcaggaugcagggcgcauuggugagggcggggggagggggaggagagggcagaggugcgggaagaggugagggcgaggggaggguggggacgcagggagggccagagcguguccccugcccaguucgcacagaagaggagacagcagccucuuuguccccagccgcccagaggaagauccuggcugcccagggccagcucucggcccaggggggugcccagcccucaguggaggcuccagcugccccucggcccacggccacccagcugacccgcgaccugcugcggagccguggcauugccggucucuacaagggacucggggccacgcugcucagguaggaggcacagggcagguggggggagggaagggggaggccggccugcccaccccaccaccuccuguccccacggccaccucccuccccacagggauguccccuucucugugguguacuucccgcucuuugccaaccugaaccagcugggccgcccggcguccgaggagaagucgccuuucuacguguccuuccuggccggcuguguggcugggagugccgccgcuguggccgucaaccccugugauggucagugcaugggauggcgcccggcuggggauggggcgggacugagcccuuggccaggcucacacugacccgagcgccccuugcaguggugaagacgcggcuccagucacuucagcgaggcgucaacgaggacaccuacucugggauccuggacugugccagguggggaggucccacggcggguggggccugggggccugcguaccgggcugacccuuucguccuuccuccacaggaagauccugcggcacgagggccccucggccuuccugaagggcgccuacugccgcgcgcuggucaucgcgccccuuuucggcaucgcacagguggucuacuuccugggcaucgcggagucccugcuggggcugcugcaggacccccaggccugagcccagcacccgcuccaccccagccagcugggcagggccgguguggggcuggagccaggcagcuagcccaggacggagcaagggaagaccccuccccagcccucccgucggcaggggcagcagggggcagggugcaggguccacauagguggugcacacgcaagccccccggggugcugccugcaccguugggaucaaugucucauuuauguagaaaaugcagaaaucuuuacauuccucaagcuagccccugccccaauccugcccuggccugaacacccccagggacagagcuggucucugggcugggggcccccgggccugggccgggcaggcuggaccauacccccaguccaccagcuccagucuccacagccauccuggcccacacaggcaccccacacaaaccuauuuauugaaucugcuggacccaagcggcucuccagcccuuccguccuuccccagccgcucuugucgccuuggcaggacuugacucugccucccuggccagccuugcaagaggacuggggucuccugcccucucuguugagccaggaaucccaagugagggguugcccugaggucugacucuuggggcaagcccgccacccacugugggacuuucuggugggcuccucagcucccaccccaggcuggggcccagauugugaggucugugugcauguguguguguaugugugugugcaugcguguguguguuguggggaucuggccuggcccuuggggauggggcugcuggggacugccccccuucccgccguggccaggcgcucugugugcugugugugccccaggcucuguugaccccguccaggaacuaacuuacccagcuuggucucuccugaguccuccacccuggccugggauuggccagggagcagggcgggcauugggaccaguguggagccugagggugccugcccugcucuggagggagggccaggagcugccacacccccaaguccucucagggcccacccuccuuuuucagccucugcauaaggccccuggguacacugcagaagccccauccuucccgccuccgggcauaaggccccugaccacacuucagaagccccauccccccugccaccgggcgaucccugcugugagccgaagcucucccugccccgcccuggccaugugaucguguuggugacagacccugaugugcuggugcuguguccccaaaaccggggcccuccacagaggccccuucccagcgacacuaccuggggcucaggccuggacccccccaguucacgguugcuccugggagcugccccucccgucacaucagaaccuuggaagcugcugcugcugcuuacagaauuauauuuuuuucuuuugaagaguuuuaagaaguuguaacuuuuugugucuugucaugucagagaauaaauaaauauucuaaguagaugcugcugucugucug

SEQ ID NO: 15473 - RNA, 6296 nt, Homo sapiens
cgccgcccgcguagcuucuucgccuccgccagcggggaccccgagcuagagccgcagcgggaccugcccggcccccggcuccagcgagcgagcggcgagcaggcggcucacagaggccuggccgcccacggaacccggggcccggcggccgccgccgcgauguuuccccgcgagaagacguggaacaucucguucgcgggcugcggcuuccucggcgucuacuacgucggcguggccuccugccuccgcgagcacgcgcccuuccugguggccaacgccacgcacaucuacggcgccucggccggggcgcucacggccacggcgcuggucaccggggucugccugggugagcggggccgggggcggcaggcggggggcuggcgggaaggccgugcggggccgggggauggucuccgugagcggaggggccccgcggcgagucgguggguaccguggggaggguuccgguccgcgccuggggaacccggcgaggauccaauccgggucgcuggccugggggcggggccugguuuguuuugcuccgagggugcccggggcccgccugucuggcgcaaagguuugggggcgggcaggugcagcaaaagcugcuuaauuggacagaaaaaguaacucgugggcgggaccgugagaauccgaggagggaccuaagucaccccguggcccuggauauuacaaccggugccagcgaucggucacaguguccugggcuuccgcaguugcaggcugcuaucagggggccuggcauggggguagccucuugagaggcgucugggaaccgugaccugguccuucccaagggcccggaggaggagccccgcugaggucagggcugggcgcgaaggggcucuccugcccucuccuugcacacggugcccuguggccuggcuccccgcugcggcccaccgcguuugcacacuucaugggugagggugcuucugggcucuggugccugggucaggaguggaugggucucugugugcugggcuggccucggcucgcaccaucggcugccaugagggagugauguuuacagcacacgacuucaggagccugugaggacacccaagaugacaggggcacucugcucagcaggagccuguccggggcucaccccugcccucuuccucugaacuuuguccugggagggagggggcuggaccacagaagugaaccucucaggucccaauaacuagagcuauuauugggaacagcccccuccagcccccucccucucauggaggccuucagacaagcgccucagucggcccccuggcuucaagauacaucaaggucccugcuacccgagccaaggacaccucucccacagugcuuccccacccugcucccaacaagacuccuucucacggguggucuugcacagcuggagcccauagugcagcaggugcuggcugaagagccccuggcuccacacugccccacuccugaccagggugaugcacuggaggagggcuuggaccucagcuccucccucagugcucccgaccacuuccagggacuauccccaagcuggccagcacuccugcgccccaagaggaguguuuggggugcuuccucuuggcugcagugggacacaggugugccuuccuaggaacugggcccugacuacuuccagcccaacacucccgggccugugaacugugaccugugugccgggauggguuuugugggucugccccauccccgcacugcuggaucuggccaagugggugaaggcuaaggccggucagaguugaguuucugccuuguccccucuccugggcuagaugccacaccaggcccagugacucauagggcaggcaguugggaaauaccaggcagagggcagguccuggucucagcuggccagccucugcugucugccaucccaggggagguggccaaagucccaacugugagccaggccccacauucacugggccuccuccagggucuguaugccauggaacccuggacauggggcuaugaaggaagguggguguugcuaagcccaggagcaugggccccuaaccuuggcccugugccccaggugaggcuggugccaaguucauugagguaucuaaagaggcccggaagcgguuccugggcccccugcaccccuccuucaaccugguaaagaucauccgcaguuuccugcugaagguccugccugcugauagccaugagcaugccagugggcgccugggcaucucccugacccgcgugucagacggcgagaaugucauuauaucccacuucaacuccaaggacgagcucauccagguggggccugguggagccaugcuggguggcgguggggggggcagugggaaccucaaggccucugcucauucucucccacucugucccugcccugaaggccaaugucugcagcgguuucauccccguguacugugggcucaucccucccucccuccaggggguggugaguauuccuagcccuggacaccuucuauggggugggccgugggaugagggacagaggaggaggccgccuagagccauccuucaggcccuugcucugccaccgccuguuacccacuuccccuguguuacucaagaaacagcuguggcaacgcacgcuuccuggccccccaucccuuccuccgucccugcccucccccgucuaccaucugcucagugcccaggcuggcccacagccagugcccaguggguaaaacgcucaaaugagguagccacugaauggggcccuugguggccgggugggguggcugggguggguggccagugcagccacaggcccucacauacgguccugucugugugucccguggaagcgcuacguggaugguggcauuucagacaaccugccacucuaugagcuuaagaacaccaucacagugucccccuucucgggcgagagugacaucuguccgcaggacagcuccaccaacauccacgagcugcgggucaccaacaccagcauccaguucaaccugcgcaaccucuaccgccucuccaaggcccucuucccgccggagccccuggugagcucugcuccgaggacuguggccuucccagccacuccucacugggcaccaagggagaacacugauccuuugacuucugagugcccaggguaggguggugggagccucuucugagggcuggggaaagcgcacaaccuuucuaggggcagauggcccauccaaccucucugucuagcugcucuguccaggcucccuguccagucucucucucuuuuuuuuuuuuuuuuuuguuugagacggagucucgcucuguugccaaggcuggagugcaguggcaggaucucagcucacugcaaccucugccuccaagguucaagcuauucuccugccucagccuccccauuagcugggauuacaggcgccugccaccaugccuggcuacuuuuuguauuuuuaguaaagaaauaggguuucaccauguuggccaggcuggccucaaacuauuuuauuuuuuuauuuuuuuuuugagaugaagucucacacugucacccaggcuggagugcaguggcuggaucuccucucacugcaagcuccaccucccggguuccugccauucuccugccucagccuccccaguagcugggacuacaggugcccaccaccacgccuggcuaauuuuuuguauuuuuaguagagacgggguuucaccguguuagccaggauggucuugaucuccugaccucgucauccgccugccucagccucccaaagugcugggguuacagguguaagccacugcgcccggcuuucuguccaaccucccuguacagcuuugaucuuguucuggaucuaggauagguuuugggguugggagcugcggguagugaagggagguggcuguugggggugccagggauuccaggggcagaacgggcaucccuggcucccuccgcuccauuuaacccuccucacugcaggugcugcgagagaugugcaagcagggauaccgggauggccugcgcuuucugcagcggaacggugcgcggacccgggcgggagagggcggggugggcucggcucugcuacccccugcgggccgcggccgcgcugaugaacugagaaucccuucucuccccaaccccaggccuccugaaccggcccaaccccuugcuggcguugccccccgcccgcccccacggcccagaggacaaggaccaggcaguggagagcgcccaagcggaggauuacucgcagcugcccggagaagaucacauccuggagcaccugcccgcccggcucaaugagggugcgcaccugggggacgggaggggaggaggggaggcaggagggaaagagagagaggagaggacggugagcaggggagggaagccgagcggguccugggccccgcugccuccacuggccgccgaccucccgcccacccgcagcccugcuggaggccugcguggagcccacggaccugcugaccacccucuccaacaugcugccugugcgucuggccacggccaugauggugcccuacacgcugccgcuggagagcgcucuguccuucaccauccggugugagggcuggggggucgggagaggggcccaggggacggacuuugggaucauccgcgagugaugguuaccagggaaggugggguggggugagcagugccaagucagggcacagacagggcccggcgggugggcaugugggucuggccaagucccugaacgcgccgcucgcccuguccccagcuugcuggaguggcugcccgacguucccgaggacauccgguggaugaaggagcagacgggcagcaucugccaguaccuggugaugcgcgccaagaggaagcugggcaggcaccugcccuccaggugagccgccgaccgcgcguccacccggggcccgcggugcuagcgccgggagcugaagcccucccugccgcaucccugccccgcaggcugccggagcagguggagcugcgccgcguccagucgcugccguccgugccgcuguccugcgccgccuacagagaggcacugcccggcuggaugcgcaacaaccucucgcugggggacgcgcuggccaagugggaggagugccagcgccagcugcugcucggccucuucugcaccaacguggccuucccgcccgaagcucugcgcaugcgcgcacccgccgacccggcucccgcccccgcggacccagcauccccgcagcaccagcuggccgggccugcccccuugcugagcaccccugcucccgaggcccggcccgugaucggggcccuggggcugugagaccccgacccucucgaggaacccugccugagacgccuccauuaccacugcgcagugagaugaggggacucacaguugccaagaggggucuuugccgugggcccccucgccagccacucaccagcugcaugcacugagaggggagguuuccacaccccuccccugggccgcugaggccccgcgcaccugugccuuaaucuucccuccccugugcugcccgagcaccucccccgccccuuuacuccugagaacuuugcagcugcccuucccuccccguuuuucauggccugcugaaauaugugugugaagaauuauuuauuuucgccaaagcacauguaauaaaugcugcagcccagccucugcccacuuuguguguaugugaccgccugcuuacuugcagugagagccugguggccagggucuggcccuaccuuggcugaccagccucuccacagcugcaggccaggucucccagcgucgcacuccugggccuggcauuuggaaccugccaggcuggccugggaacaccccccuacaggcacauaugaacguacugcauuccugccgaccccccugucuaggaugcauccacaccccccccaauuuugcccagcagccuccuggcugacccuuggccacagccuucugagggccaauggaaauauuugggaccaagauucuugguaaauaaaaacgaaaauguuugcaaaaggugucgccugccccuccccucacacggugacacaguggggugugugacuguuuuggggcuuggccagcugugggggcugagguuccugaaaccaagcacaggggaccugggaaagcugggccccugcuccacuugggcguuuggcccaaaguucucuguccccccacccucacaagccucucuggccuggugcacauaccuucuuguuccccugcccagccuccugccaguacacagggcagggcugggauauggaggcaggugagguccuagcugaaggg

SEQ ID NO: 15474 - RNA, 12729 nt, Homo sapiens
gguccuguccuauaagcccagccuuuugugguucagcugggucgcacgcuggaucccaggccccuuccuugaaaagcagaggccuuguaccccccaggguugccgggcgggacagugauuccagcccuucaggugggugcaggggccaggcuggggcuggggcuggggagggcuccucggucugggguggaauuuucuccccccacaggaggguuucacucgggccucaagcagcuccuccuuccaauccucccccaaggggagccccagucagggcugggccccagaaggagagccaggaggggcuacugaggugggaccugccugaguccccagcucguucacccauacauauacacugaauacugcuaaguuaaacauuuucuagcauuacacguucauuguuuuguuuugagauggaguuucguucuuguugcccagugcaauggcacaaucucggcucacugcaaacucugccucccgaguucaagugauucuccuggcucagccucccaaagugcugggauuacaggcgcccaccaccacaccuggcuaauuuuuuguauuuuuaguagagacgggguuucgccauguugggcaggcuggucucgaacuccugaccucaggugaucugccccugucucagccccccaaagugcugggauuacaggcgcccggccuacauguuuauuguuuaaaaaccgggaaaguauagagaagaaaguaaaggcuccccaccccuagagauaaccgcugaaaguauuuggucuguuuccugcccggcuuuuuccuacacacacuuuuuggcgccuuaagucgggcuccccccggacaggaggggccccucccaggcgcuggugucugcgcccgccccccgcagccuugucccugcuccggggggucccugggucucuggggcauaucguugcuucacugcucgcucgagccuccagggaucgggccgccggggcagcgcagagaggcggggacaggcgacagcggcgcagaguggcuccucccggggccggcccaagcgggggucucggugccugcgaagcggcaggggucgcucggggcccagugcccucuacgucccguccgggucccagcuggggcggggcgcgcccaguguuuccgggaggagcggcccgggcgcgcggcaggugcggcggcgcaacucgcggguaggcgaccgcuggucccgccgcugaggccccuccacugccgcccgcccggcacccccuccgggccgccguggcccgcgccaaaccugagcgucucggucgggaacuccgguuacccccucggggcgcaaggcggcagggguaagggcgggguugucccccagaguuucggggagcacaggaggcuggccgccccaccccaccagcccauccucccaccucccuggggcccugcugccgcgcggcuuccggcugggguggaccucaggucuagccggcaagccggagggcgggcgagacaacaacguggccuggaggcaauggcccuggccucucguguccccuucucucacccgcccagacuugcccucuuuggaggucgcccgggcuaaggaacauggaaggacgcuggguggagagugaggggagaggaucccagcuccccggugggggaaggcggguguugguggggagcagcuuugggaaauccgggaucaggacauugugugaaggacagguggcucugguuagggggcggggcgucccugcaaggaggugggaagggaggccccagggaguucugaaacggggaagggccucaguguuguggggcaaggguguuaggucucgaaucuggaaguguuccugaguggggcgucagaggcgaagggcucugcaggcugggaccuugccccugcacucugugggcucaguuguggggagggaggggccggugggcaggagggagaagucugcccugccugccagcugucaugaggcugggccacacaggcccaggccaggggcuaaggacuuggucaggacuggcugagcccucacuugggaucagaucuccaguugcagagugugaggggcuccucccucacugaccccaagccugcuccucucagcuuucaggaccccaccuuccuuaucaccaggucuucuccacuggccccugagauugccaucaccuccagcuccuccucuccugaaguuggcagccccuccuggguuccagccuccugagaugccagacccacuggggcaguacccacaggcccugagccuacaucaaccaccccagugacaccccaagccugcagcauuuuccacccccagcccccuggucccaccuugccuuccgcccaccuucccaccugcugcagggagggcccucggcugagccuucagacacacuugcaccccauccgcuccccuccugaauuucuucugacccucccuuggcuucacagcaccugaaggccaggcugaggcccccugcucucauggccagcccuggaaagccuggggcugaugaggcccaggaggaggagggggaacucgaggggggcucugcagggccgcgggcugcaauacuggagcaggcugaggagcuguuucugcugugugacaaggaggcuaagggcuucaucaccaagcacgaccugcaggugagucccccaccccaagagacugcuucggcccuggguugaccgcagcggcucaucucugcucuccuuccccgaccagggucuccagagcgaccugccccucacgccagagcagcuggaggcuguguuugaaagucuggaccgggcucacacuggcuuccucaccgccagggaguucugccugggccugggugagccuguggccugccuaucccccacugcccagagcuggaggccugaucaggaggccuggcacuuguggcgcccugagggcugccggugccucucguccuccucccuccagggcccgugcuuugucugcacgcacucgcgccugggggcuccuagcugcgguggaguguguggagcugaccuuccuggcccccagcuccucuccugugcuaagcuccgguagggcugggagcuggccugucaccucuuguuuccaggccaauaggaccagaauaaggaaggaaaacaggaaacugggcccugagagagggcaggauacucguugggagggugaacggggacacagccacgguggcgacccacagcccugguaaucgcucgcuccaugcccgcagggauguuuguggggguggcgucagcccagggagcgaaccccugcaggacucccgaggagaccuuugagucgggcgggcucgacgugcagggcacggcgggcucucuggaugaggaggaggaagaggaggagcgauuccacacugugcuggagcagcuggggguggccccgguccugggcaagugagucggcgcuggccccgcucccacugcccgcucugcuguuucucugccugcaugcugucugcccuugucacccgagugcugguucugcacagggucucuaggccgggucaggcccagccuagcgucagcugcgauucccugggagggacccggcaugauuucccgcagaauuugcauuucaugaggcagcagccagggcugcagggaggaggggcagcgccgggcgcggggccacauaccggcacugcccaggguacacacaccucaccgaccacgcacgccgggcaggggcgaaagcgcucacgggagggaugcccugcacgcagcaagugcuccuguccugcccaggggcgaagaagucuccuaaggguuugcugcuggcggagggaagccugcuucccgcuucugccagcuccagccucaguucccgcccgcccuccaggcagcgggcugugaggacgcucugggccaggcugcagcgcgagcgccccgagcugcugggcucuuucgaggauguucugauacgcgcgucggccugccuggaggaggcggcccgggagcgcgacggccuggagcaggcgcugcggaggugagggccggggugggguaugggggccaauggagggccucagggcagcagcagaggcggugccagggggcuguagcgcuggcaaguucucauccggggucgcccggucccccgaaggcgcgagagcgagcacgagagggaggugcgcgcucuguacgaggagacggagcagcuucgggagcagagccggcgcccgccgagucaggugggccucgggccccgccccucccgccaggcccaaucccaccucgcuggccucccuggcuccgccuucucugaauuaaucccuccccgacggccccaccuccgcggguccaggcugcccucagcccgaggagaucccacugggccucacguaucacccccguccggucuucuccacccgaccccgcuccgcccgggcccacucccagccccuggcccuccguguaccucuuuugcauggccgagcggccggcggaggcucagugguccuccgugcgucccagaacuucgcccgcggggagcggagaagccgucuggagcuggagcugcagagccgcgagcaggaccuggaacgcgcgggccugcggcagcgggaggugagcacccggccccugcccuguccccacggucacccgugcacucucccccugugccuuagcguccccggguugucgggagccuggggcacgcgcagcaccccggggaagagggggcguuccucgccggucuccauccuuccacccuccaguuagagcagcagcugcacgcccaggcugcggagcaccuggaggcacaggcccagaacucccagcuguggcgggcgcacgaggcgcugcgaacgcagcuggagggggcgcaggagcagauccgcaggcuggagagcgaagcacgaggccgccaggagcaaacccaacggugccgugggacggggcugggcgggccccggugcgugucccgggggcggggccgacgggcgcucaggucugggccacuuucauccccaucucaagucccaggcccgccccgugggaaggaggaucuucuaggggguccgggggcuccccaaggagccuuccugcagccgggucaccaccucccauccacagagacguggucgccgucuccaggaacaugcagaaagagaaagucagccugcuacggcaacuggagcugcucagguacggucaggcucaggcccgagagggaaugggcucagcggagcuugggggcucccagcuccccaacauucuuggcugccgcucuacuccauuggaaguccuuccuuaugccugccuuucaccccucacgcugcagccucagccagacaccucucuucgcucugaggggagucggagcucaccuccccccaccuugagcucccucagacccucucagugucggacuccuccuucccuagggagcugaauacacggcugcgggaugacagggacgccugcgaggccaggcgggcgggcagcagcugcaggaaggcucugacaacagcccgccugccugggcccaccugcugcugcugcuguugcugggcucggccccccagacgcggcucuggccaccuucccagugcccggugaccagccccgagugacucacggaccaugagcuagaagcugcccuugcaggaggcuugucaugggucgggggugcccacucaggaugcaggcucuccccagugggccccaggcucgccugacugaagacaugaaggaccuagccuaggaguggucagggucccgggaguggccagggucccgugugugcccucugccagucuucgcucuguccccguucaaucaaccccaucucaguucagcagaaaacccccucgucaaauaaaacccacugacugcacugcguccuccugggccuuccgugugucugggagccacagccugugugugccacauggaugaggugggcaccugugcacgcgugcugugugggugaauacagggagcgcgggccuguggcgauggggcugagguccugcguguccucuugugucccuggucaugccccaaacucacacuacccaucaaggcuggagccccucggggcccucgccaguguguggaucagggcuccccacugucucgccagggaggccgggcagguucccggccucagucggccacccccucccaugcugguccuccccuguggcugugaugaaugagcuuggugggugggcagcccccuccuuccucacucccacucuuggcgucuuggugcagcccuaggccggcccugcccuucgucccucaccuccucgcaccgcucccaguggucccuuccagucuggagggcaugggccccccaggaccccauggguaugucucgcugggaccccaggccugcccgggucuccaggcuguccacacugcacguacaguagcccuucucccgcauuugcccacagcgcuaggcccucccacgccccaggccggcaucgguucugccgaccccugcagccucugggcgguuccugggugaggagaaagagauggggguugggcauggaggagggccgggucgccacagcccagggccucuggcuaggcuggucgccgucuuaccuccgggcccgccucccgcccagcuccuccguccuuggacgggaugggcccuugcugggcuauuggcgcccccagggcugcagcucgcccggccuccgcagugccaggucgacccccagcgccuacacccacgcggguucagaccugccgagcgcccgccgccgcgggaggggcuugaggccggggcggggccggggcggggcggggcggggcgucccccucguaggcuccgggccgcgcauucucagcgcugggagccgccgcccccgcagcugcugccgccgccgccagggcccggacucggacgcgugguaggugagugcgcggccacgacagcucggccgagcggggcgagcggggcgaggggggcgaggggcgcgaggggggcgaggggcgcgagggggccgaaggcccugcgcgccccagccccggaggcccagccgcaggcgccgggagguuccgggaggccgcacccaccgccuggcccagcucccucgccugccccagcucccucgccugcccuuccgcgggaggcggacuccgggcggguuggggaggcgcagcgggaaggagaggcgccucccgggcccuuggaccggccugacggcccccuucagcccaggggucccgggacgcgcagccuggacacccugcucauugucccuggacacggcagucuucccuccgcccgcagcagcccccgcccgcgugcaagugggcgcgccauuggccgcgccgggcggggucggcggcggcggugaccucauugcagugccccggggacgcuuggcaggcgcggagucccaggucccccugacuggggcucccccugauagggcgcgggccgcccaggggccuggugcaggucccggggacuuggggaggaacagacaacuauuucuggaaggcccuuucccaggggguccagagggaccaggcauuccugggaagaggggccacuccucagcgggucgccuguguccucgcgguggaggacgcaucugugcccagaaccaacuucuccagaaagccugggaccuuacagccaggccaggggcagguccuugaggggcucacacauccccccaucgguggcagacgcacaccccgccccccgguggcagacacauccccccgcugguggcagggucugccugugccacccuuccugcguguauuuaggcccuggcuccuucauggagggugaauauccccucucagcucagugguaaggucugucccccuccagcuccauuccaugaugccucuuucccaggcuguagcugccgcuguuugugggggaagggccagugaugggucuggagcgaaggccaagaguggggcaccugggggaagguaugaggucccucccaggaucagacugucccgaaaugucgucugccuugggaggccaaggcggguggaacaucuaaggucaggaguucgagaccagccugguccacauggugaaacucugucuguacuaaaaauacaaacauuagcugggcgugguggugggugccuguaaucccagugacucaggaggcugaggcaggagaauugcuugaacucaggaggcggagguugcagugagcugagaucgugccauugcacuccagccugggugacagagcgaaacuccaucucaaaaaaagaaaaaaagaaaaaaacaaaaugucuugugccuugccccacccuagcccagacuaaaauaccgggcuuggccacuccucucucugccuccagaaugaacccggcccacucuggcccuugggccagaccuguaaccugugaccugacauguccuugccccucuagccuagaguccuggggagcuucuguccaccuguccugcagaggagucguuuccagcccggcuggugagugcuggccaggguggggcagagcaggcggggcggcgaaaguccagaccuggcugugcugucuggaaacguggcccagggcgcucagcugcugucugcaccccacgcccucccuggcuuccccaugcucacagcuugcccacugcugcaggucgggcgggcacggggcaucuggggaggggcauagccugucugugcugcccccucagguuggugugggucgccuguccaggaaaaacccucccagucugccaggcuccaccugccuccacgcuccauucuccccaccccggccaggaugaaggaagggcugcccuuuaacagaccguaaacaggccuggagagcuuaggaaggggcugagcuggggccugucugagccccuaccccucugcugucugaguggccuccuccgcccuuacugcaggcccauaggcuccugccagccugugacgugcggccccgggaaugccguggggagcgggcaggcuggcaugagcucaccggagguacccgcuagggcuuccucccccggccgcuagcaggggugagucagcagugauggcgggagguccuccaugaccccuguccugucugugggcaccaggggucuguccuggcugucagggcuccugagucgcuaggaagugacacguccuguucccacaggggcucauucacaggccucccaggacaguggcuggcucugccccgacuucugggcuggcuuggguaucuguguccccucuuuuuuuucuuuuuuauugagauggagucucacugucgcccagccuggagugcaguggcaccaucucggcucacugcaagcuccgccucccggguucaugccauucuccugccucagccucccaaguagcugggaccacaggcgcccaccaucacgcccaguuaauuuuuguauauuuuugauggagaugggguuucaccacaauggccaggcugguugugaacucccgaccucaagugauugcaccugccuuggccucccaaagugcuggcauuauaggcaugagacaccgcaccuggacuccuuuccucuacuuucuuuggguuaauuugcuagucucuuuuuauuauuuauuuauuuauuuugagauggagucucacucugucgcccaggcuggagugcaguggcaccaucucggcucacugcaagcuucgccucccggguucacgccauucuccugccucagccucccaaguagcugggacuacaggcgcccgccaccacgcccggcuaauuuuuuguauuucuaguacagacgggguuucaccguguuagccaggauggucuugaucuccugaccuugugaucugccugccuuggccccccaaagugcugggauuacaggcgugagccaccgcgccuggcccuguguccccuccuauccgucucccagucaggggcccggugcuguggccccgcugaccccuccccugccuccucagccccaggaugggugaguucaacgagaagaagacaacauguggcaccguuugccucaaguaccugcuguuuaccuacaauugcugcuucugggugaggaggggucgccuugcccccacccccacccccaccccucccgggccaccaucagaccugggcagaugcgaugaccuuuguguacugcuuguagcuggcuggccuggcugucauggcagugggcaucuggacgcuggcccucaagagugacuacaucagccugcuggccucaggcaccuaccuggccacagccuacauccuggugguggcgggcacugucgucauggugacuggggucuugggcugcugcgccaccuucaaggagcgucggaaccugcugcgccuggucaggagggcgcagggccacgggguggggguggugcagaugggcccaaggagguugucgcugcaggcuuugaaccugugccuugcugugcucaccuggggggggggucacgguccuuccacaccugccuaguccuguggguccccacguuccugcuggaccagcugagggaagacaccagcuccgcaagaaagcuucagggaggguggccgccccucagcccccaccuggagccuggggagccgggguggggacucugcucugaggugcacuaggucuaggcacuaggccucagaacaagggugcccuugugcugccccccccaguacuucauccugcuccucaucaucuuucugcuggagaucaucgcugguauccucgccuacgccuacuaccagcaggugaggggccugggcaggccauucagagacacagacaugcacaggcggggcggacacacacacaugcacacgcguggcuagccccaacccccacccccauggucccagagcuaaccaaugugccacugggcccuggagauggggucuaggucucugcaggggcacauggggucaggcagguguccaggggauccagaagcucucucugccucugccgcacuucauugucacccuggugacgguccuggcaccacccaaccuccccucaugccgaggugugaccucagcccuucccuguggcucugagcugggccccgggccuccccaccggccauccuggggcucugccagccccaccuuggaaggucuuagacugaggcugaaguuuccugcaccccaaccccagcugaacacggagcucaaggagaaccugaaggacaccaugaccaagcgcuaccaccagccgggccaugaggcugugaccagcgcuguggaccagcugcagcaggagguggguggguggugcugggagggcgcgugcauccccagggccucccuggaccucugcaggagccucuggccccaggucucaaccccagccuuguucuugaugcaguuccacugcuguggcagcaacaacucacaggacuggcgagacagugaguggauccgcucacaggaggccgguggccguguggucccagacagcugcugcaagacggugguggcucuuugugggcagcgagaccaugccuccaacaucuacaagguggaggugggugugcagcgggaucaugccuccagugucuacgagguggugggggggcaccccagugacuggcugugggcagugggacacgccuccaauaucuaccaggagguggggggucaccccaguggccggaugugggcagugagaccacaccuccaauaucuacgaggaagugggugggcagcccaguggcuggcugagcuguugguggccuggcugccuaggugcuagggguggguuuggccacacccuggaggcuggaggcaguaggggccagugggaggugcccccugggcccgccuucaacacccauccgcgccccgcagggcggcugcaucaccaaguuggagaccuucauccaggagcaccugagggucauuggggcuguggggaucggcauugccugugugcaggugagggcacauggggguggcggucaucuuguuggggacacggggcagggcgguggcugguggccccaugacgucugcuuacgcccacccggcucugcacacaggucuuuggcaugaucuucacgugcugccuguacaggagucucaagcuggagcacuacugacccugccuugggccuugcugcugcugcacccaacuacugagcugagaccacugaguaccaggggcugggcucccugaugacacccacccugugccaucaccauaaccucuggggaccccaaccucagaggcagcuucaagugccuuuugcugcgcaccaaugcccagcaggggaggugaggggggcuggcggggcgaaguuugggggguguuuuguggggcuccccagacacacucucugccugguggucagaugcagguuggaaggggccuugcugaguggcgcaaggccgagcguucccagcagggggagaaacccuucacaccccaggcccuucaggaacuggggccuugccuugcagccacauggccccaucccaguuggggaagccaggugagcucugacccuugggccugggccucugccccucccaacccagcccucgucucccucgacagcgccccugcugucuuccccaccgcagucaccaccacccgaaaugccacguggucacugugcacugcccuguucaugugccucugcggggcagggccuuccugguuuuguucacugcuguacccagaugccuacaaccaucccugccacauacaggugcucaauaaacacuuguagagcagauggacgagcucgcugugcugguaacagauggu

SEQ ID NO: 15475 - RNA, 2762 nt, Homo sapiens
ggugggcugcgggccacuggagacuggugagcaccguucugucuugcccagaagacccugcagugcgaggccgccugacugagugccuggagaccauccugaacaaagcccaagaaccgcccaagucgaagaagguccagcacuccaacgcgaagaaugccgugcucuucgaggccaucagcuuaaucauucaccaugacaggugugucggcugccuguggagaggcuucgucucgcgcacacacacacguuccuucucguuggcacgagacugggcggaucaugucugguuuguccacuccaugggccuccccuucguccugccucugugcucccugccggaugcuuuuuuucuuucugugcagcccggccccuccugcucugagcucaccguggauugcuuuggugacuguggucucaucccacacgagggccuuuuccuccuuccccugagcauccccacuccugacuggcuucucauguaguggaacagagaggagacgggugggguggggggugugcgcgcaugucccguggcuuugcuggauguggagccgcacuugguggguccagggucgcagggcagugcuggaaacgucugugcccauccacgaagcgcagaggcgcaggguggcggucgcuccacacagccuggagggucugccuccucugcucccacgccuucucugcucagcaguugcggcgcaccacauguggucuggcgugggucuugcguguggggccaugcuuuaggguccugugagaaugagaucgcaguucucaccaggcucccaauaaugagggcacgugccaggcugugggcagacgcucucuacagcuugugaacaccacccauuugcuacuacagcauuuuuacaaaugaugaaaacucagucugagagucacacuucagaacugagaguuauuaaaacugaaauuucccauuuuggagaaagcucuguuguuaugugaggagaagccacauccugaggagacaguagagucaguggggcagcagccgcgcucccggccuucucggccuucucccugcccugggcuggugccucuggcugagaccccauugccggucacagcuugaccggccucccgcgggccugaugcagauugaggcucaggaggugcugggaaggcuccaguggacacacgggcugcugacucacuguggggaugcacaggauggacacaaaauggaugucaggggugggggucgggcgucaucugcaucuggggaggcccccgaguucccacuugagcagugugguggcggugagugccgugugacuuugcugucugccaucuggacccgucggggaacgcagacucuguccaguuuguguugcacuugcugaggaaaccccacccacuuccccucccuccacacagugagccgaaccugcucguccgugccugcaaccaguugggccaguuucugcagcaccgcgagaccaaccugcgcuaccuggcccuggagagcaugugcacgcuggccagcucugaguucucccaugaggcugucaagacgcacaucgagacggucaucaacgcccugaaggcgagugcccuguccuuggguucugcucacucccugagcaggugccgugggucuuccugugaaggcuggggguacgcagugccuccugacuccccgcagagauggagguggugcuggugcugcuggccuccgccugucaccuacucuugggaggucacaccacuguugagggccaugcugccuggagauggccggguuggcccugcuguccugguuaggcugagcagaggagucucuggcagcccuuucccugcugggggcagcccccgugugccauccugcgcgugcauagugcugacaaguagaaaugguucuucuugguagaaagaugaaauuuuuuucccuuaucuccaagaaaaucccccuuuuacaaaggaaacucacuuuguucggggauuaaaauuucagaguuggggccgggcgcgguggcugacgccuguaaucccagcacuuugggaggccgaggcggguggaucacaaggucaggagaucgagaccaucccggcuaacacggugaaaccccgucuuuacuaaaaaugcaaaaaaaaauuagccgggcgugguggcggccggugccuguagucccagcuacucaggaggcucaggcagaagaauggcuugaacccaagaggcggagcuugcagugagccgagaucgcgccacugcacuccagcgugggcgacagagcgagacuccgucucaaaaaaaaaaaaaaauuucagaguuggaagagcccaguugagguuggccauugccagccuuugcgagucuccagagcgaccccgaggguucguuccacauaggggacccugcgguguguccaccaagucccuagucaccggugcacaugcguuagggagugggaggcggggagcugcaugucccccaucuggcucagccucaggcuguggcagggcugcucccagucccccgcacgucugcgugcagcucacagauauuccggguggugugcaaggggcucguggugggcauuugguauucuggauucuucuugguccugguuuugguguuuguuuuagucaaucccuauugucagaagggcuggacacucauuugcacacggccagugcuagcgcugguggugcccacucuccugccuuuguugggagcagagcucgggcuuucucgugcugcagagccuccugggggcccaucagcacgggcucug

SEQ ID NO: 15476 - RNA, 9783 nt, Homo sapiens
accuaaaccacacaguacagcaugucccccugaguuuauuauuggaaagcaaggacugaacaaagacucagacaauaaauaucugaagagaggaagccgagcuuaggaggcucagaggguccgggggagguaaagcugucgagggcagugaagggggcugugcccaccccgcucacccgcuccccagaugccuaggggagcgccgggcccggcgggaggugccgguggggagcccgcagacgguguccuggcacuggcagcucucgauguggguguaggugugugucagcgagccgccauuggggcagcucaggaccaccucacgcuggcugguuuucuccucuuugcagcaggagcagcugugguccagggccugggccuuggccgaguaccuggggggagggcggagugaggggugaccuuccggggccagcgcuggccucucgccucccuggggucuccaccacccccuccaggcacacucccagccugggacucacaugacaaaugucccgcaggacccggagcaaugauucaugaggacggucuuggugcagccggcguacgaaaccuccguggugacggggacgguggagcagggcacccuggucucauugcgaggggugccuggggagagcgggcagcggcuuagggcagggccuccacaucuucgaggaggcucucccucgcugcguccccuccccaggcucggccucagcccccagcccucacugcccacccagaggccguuguccagccuccagccaccccaggcggggcugagggcaccagcccuugugcccccacccugccuaccccccaggcugugcccuguacucacaggucuugcagcauccauugggcaugaaugugauggagcccuagagggaaaggagaaugagcccgggacccccggacauuccuggggaugagagcaccuucccacgaugccgugggcggggguagcugcugcagaaagccccaggcaaagccuccugcggcagcucagaccaggcccgaggucacugucgcagcacuggggccccagccccccagaacaccaggcacccccacucccggcagaguacacacagccaggccccagguggccaacucaccgggaugcaaaugcuggcaucaaaguuggggcaggugauguuggagacggacgagaugagcugguuguggaucuucacgcagcugaagaaugugcaguuguucuucgggucgcucuugaaguccccgggcuguggggcagggagcucuggugagggagggcagcaggcccagccccagcccggccaggaagacacccuggagacaccuggccggggaggcuuccuggugaggcccagggccacaggacaagugacaugggcggggccccacaucaggcaccagccuggagcccacacaacccucaaaggucugucuguguucuaacucugaaucuaugaaugugaccugccuuggaaagggggucuuugaaggugucauuaagugaaggauccuaagaugagaucauccugcuuggggugccuaaauccuuaaaagggagaggagaggcagacacagggaaggaaaccucguggucacagccaaggggcaccuagagugaccagaggcugggaaagguccuugccuagcgccuccgagggagcacagcccugaggcccuuugcucuauggauuucugggccgcagaaccaggagaaucccuuucugcccugaagacgccugcucauuugucauggcagccccagggcgcccaucacagcugcgcccaggacugggaggacucagcugggggauccuggguggcccgcgccuugcccugggcucaagcaacccggccgcgucggggccggcagugcacaccuaccuucaggaugacgugcugguugucgggccguuugaugauacagugcgucuguucacacuucuuacagcacuccccgggggccuccaugaguucgaagcccugcgcacauagacacgccacugcaacugaacucccaggcuguaccccacaccacacaaagccugcagggcugccgagacccccccaccuggaggaggccccaggcugggcaggugucaggauggagagguggggacagggacagguuggcguugaaaggaggaaagaaagggucacgaugcagacaugggcccgggugcuugucugggaggagggaaaagggcaggcugaaggaggaggguggccgcuuacagggcugcaggagguguugcagggcacgugggugcaggcgaugacguugagcaggguguuguuguccaccuuguccgugcacacgcaguccuggcacuuggaggaauaaacuggagaaccgggcuucgggcacagggagagacaugaggcaggggccucuccagcaucccagccagcccaacagccugccaggacccccacgcugcagccgaccuccuccccuccucccucucacccagcccagggcucaccugguacucagcauucccgugaacacacacccccuuggacucuugggagaaagaacggagaaggccguucguuggagacugccccggggcggccaccuggccagacccccacucccggugcacacccaguggauggagcgagcgcucagggcuggggugggugcaucagccaagcguacagccaucuguguccccagaaucugagacccccaggagggagccaacccccuuacagccaccccaccccgggcggcagccuccucccugcccugcccaccagcccugcuuaccacaccaguagaaaggacagcaccuuccaggcaccaucuugcucuucacuucgaaucccagcgggcacacggagggcuucucuuugcacaggcugguguugcacucugaagacagggugugcacgcggccgugaggguggcuccucccaggccaagcccccggggccacugcacaggcugguguugcacucugaagacagggugcgcacgcggccgugaggguggcuccucccaggcaaagcccccggggccacugcacagggucgggccuccagcaccuccaaggguccccuccccacccaggucaggcccugcagcagggaugccuggacugggcccagcggcccccucccaagcccucucaaggggcacagcagaggcccccaagccagcuguuuccucacuugccaaggaggggacagcaggcagcccagccuacagggaugugugcaccccugagagguggcaugggccccaggggauggccuuacugcagacgguaauguugcagcaggugucggcaggguugaccuccguggcgagguaggugccgucuuccacgcaguggguaacgggcuucuggcugcaccucuuggguuggcagaugaugccacuuccacccuccaggcagacacaguucuugcagucgaacucgaagugcuccccaaacugcagggaaagaagggugaguagagaggacagguggcaccaggcaggccccaccucaccacagccccggagcugcagcuguggucagcggggagaaacagccacccugagcagagugcugagggauccugggggaaaaccaugucccuccucacuucugagcacaccaggcagguucugggauaggacaguagcugcucauucacugauaucacaaagccauuaccugcucaccagcaucgacaagcaggggcuuggcacguggcaaauucuccacucaggccucucagguuuguacagaauuuagcuaaggaaucauccacauggcugcuaccacagguaggaggcaugggcagcacagagguggccaagaugucaugucagagcuucuagacagaguaucauaugaccaauggguggugaauggagggagggagaauggauggauaaauggguggaugguggguggaugguggauggauggauggaugguuggguggaugcguggauggaugggaggguggaugguagauggaugguggauggauggauggauggauggaugguggaugguuggguggauggauggguggguggauggguggauagguggguggguggaugguagacagaugguggguggauggauggauggauggauggauggauggauggauggauggguggauggauagguggguggguggaugguagacagaugguggauggauggauggaugaguggguggguggaugguagacagaugguggauggauggauggauagguggguggguggaugguagauggaugauggguggauggauggaugguggaugguuggguggaugguggaugguagauggaugguggauggauggguggaugguuggguagguggaugguggauggauggauggaugagugggugggugggggggugcauagaugagugggugaugacuagguagguggaaggauggagggguaggugaguggguagaugggugcacagguggaugaguggguggguggaaggaugggugggugagugggugguguccaugccaacucagccauccaggacuuagaugaccucauuccucaaucuuugaggcuccagguuuucauguccaucccucacuccccagaauucagaauuuguggaaggaucccccagcaacacgguggggccuaccucucugggcacauugucaggucccacacagccuaggaagagggaagaaacaaguuguguuagcagaguccuugugcagcagggagcagggguggggguggucagccuccuggucccagccuccauggacacccaggagacaaguuguguuagcagaguccuugugcaacagggaucagaggugggggguggucagcguccuggucccagccuccguggacacccaggaggaggcaggagggaggcaggaggggacagugugaguggguggcguaccgcaggucuucacgcagacaucaaagccaggagcguaguucauggugcccucaggacagaagcagccuuccaccaggacuguguuguucugcugggaggagcugggggcgggagggcauugucagacaggugggguggggcuggggagcuggcaggugggacugcuaugcccagaugaugccacccuccgcacugcagaaggcgagcccacgguccugguggacccucaaacaacauaccuggauuugcacgugggcucuucugcagggccacaggccugguacucccugugagaugggcacuccaccacugagggacaugggcagaggucagagggcugccucaugucaggcggaggagccuggacccccuugagugacagcugcccagugccccacacacggaggagggugaccagcugccugggcaucaaccuccacccucgagguugucccgagcuggguggugggcacccaguugcauuuagcgaugcuggcagaagccccagcaccucagccccuccagccuggccuuccccaccccauggccccagcccuggucucacacccgccaucucugcaucccuggccgcagcccaucuaggucuagcuucaggcugggcacagcaccuggcagagccuagagaccacgucuggccugcaggcccccagcuccagggcaggggcagaugggcacuuacagcaggccccaugcgugugguuccgccagucgaggcagauguucugcugggcacagagggcugcguaggccugcagacuggcgcacuccaggcucgagcccggcaugaagcagcugucgaacacgcaggcaucguaguagugcugcgggggcaccagugcguggcacugggcaaacaggcugugcagggagaggcacaggucacacucagguggcaccugccucuccccugcucucuaccccagcgucucugcccggacuguccuccuggaguccggcacccgccagagaggcgccuguggcugauggagggucaagggacaggccagccagggggacagcucagggacagaccaagggauggccgagcaagguggcucugcagcccggcucccagagauagaaaccacgucuauguggucaucagcuucaggacccccuccagcaacccuggcagauggacacccagccuauaccuggccccuauacuuccagggacaggaugcugaccccccaugacugccagcguuaggagcacccccucucugucaaagcccaaaucugcccucccaauaucagcccugagcucuguccuggguugacugguuuacuccgggccucacacucggccagcccugcaccuucccgggagccaggagagacuggaguucagcaaaggcacaggccgcacguagcagcucagccccguggaacccaagggccuggguccuggaccccacggcgaccuagcgccugauccugguuccgcggcuccgugccuucccagccccagcgccaggccccacgcgcugccuccuuccucuuugcaagagcugggggcuggggcacagaggcccucagcuuauuggugucguggccacaggcaggccugggcggggucaccuguccuugaugagcuggcagaggggagauggggugcaguccuuguguggggucguuuuaccgcccccgggcacagugacggccgggcgcuuggucguggagcugcugugggggcaguguggcuuggaggggucguucaccagccacuggucagccgcagccucacaguuggagacgaucuccccgcugggcagaaugcagucgucggaggugguguuggugcaggugccuguaucagugagagaggccacguugcagacaggguaagcccugcccuucuccagcccagaugcccaggaccggccagccagggccgagggcagagaccaggccaggcccccuccuguuggcuccucacagagacugaacccgggugauggccacagcagccccgagcagcggggcaagaggcccacagccaggcccauggguguuuacacgcagccucagccucagccuggccuggccacccgcccuggggcaggacaugggggcacaggggacggugggagccgugggggccucgggggccaugggggucacggaacucaccacacuggcccuugguguuguugccaaaccggugguagggcagccugacggagaaggacaggccauuguaggagacgaggacacccagcucggggauguccaccacguaguugaugccagacugguacaccuccagcccguacuucuuguagggcagugccaccgccugccuguucaccugcaccuguggccgacacaccaugggagcugcagcugccucgguccucuccuugugagagcuccagggcugccccaccccgccugcucucugaccuacacauguagggagagggcccugccuaccccgcuuuccugcccccuuucuugcuuccacuccacugcucccaaccagacccuggucccaugggugagccagugaaggagcucuccugggagcaccuggggacuguggagcccggcgcaggcucccggggccuccugagccucagaaccaaugauuccccugcaaguaggggcaucucagccaagggugugcagagcccugucccugacucuguccucaggaggcagcuucugcugcagagacugugcccagcguggcauggugccagggcucgaggggcccaggacacaccuggagggccugcaggaagagcugauaugucccggagccagucgcccaccccauccuaccuucuagcccagcucuaggagaggcuaugccuuggcacccccacagcccaguccucuggccccuggggaaccagggugcauuggggcccaugucagcacccgccuccaugccagccuccuguggccacgcugugccuaccugcaccugcaugggcaucauaugcacggucuugaucagcaccuccugggucucguggcgcacgaugagggugcggggacaggacaccuugucguugggaucgcagugguaguugucgauguaaacuccgaaguuguccacggaggggcugaucuccuccaccagcacguaggugcaguugcccugguagcuguaguagaguccgucgaaggugacauagugcgggucgccccagcccgugcaguagccugcaagggagccggagugagccgugccaccugugccccucggccggggucgggugcaagggcugggcuggggcauagucaggaagagccagcaggaagcuggggccugaaaaccccacuccugugcgugggcacggggaugucugagcugcacuugcccuggcgcacccacaguggcccauucugcaggacggaccaggguucaaacuucaacucagcccccucuugccucagaagcacccuuguuccagggaggagcccuaacuccaccaggcaagcccuccaccugcccaggcccuccccacccaaugaggcaaaagcagggcugugagaagacccucagaagucacccagccucagcgaacaccucagugggaucugugcccaaggagccucagcccuuccgcccccgggagacgggcccugcagcccccacccacggagagggcaggagaugcggggagggccugggggccccggacucacagucgcacucccagugccagcagcagccgucgggguccucgacgcgcacggguuggaggccguuggagcaggugggcaugggcggcggcucacacuccaccuucacgaucuccaccguguuguuguacuugcacguggccaugaagcagucgcacagccaccaagucucguucuccuggggacgggaggcaagggacgucagggggaccggcacaggaugggguggucugcgcucaggaggggcgggugcugagccgggaggcuggaggccgaaguggcuuccacggaccucacugcagccagccaccucgccaggcacagcggggcacggugaaaauguggagggcucggcagacccugcacccaaggguugcuggaggccucggcccucagacgaccagcaggaaguggugccuggggccucagcugcccggacaugcugcgcagagugccauggggacaaagccgccugcagcccacugaccugucugggaggaucaaagucugggcacucggggggcuuggugccgggcgucggcuuggagggcguggacgauggcuuggaaggcgugggcgucgacuuggagggcguggguguuggggagggcguggaugggcaggaccaguuauagaacuccaacguacagcucagugagcaguugacgaaauaacaggugucuccguaugugccguuguacaccuccucaccugcgaagggagacagacccacgaucacaccguccagaggcagggcuauccggaggcagggcuagccgcuggaccccguggagguccccacagcggagguccccacagaggccacccaagggaagccgugcccuggacacagccacccucgacggcugcugccuccugagacgcuucuacugcgaucucagcccuggcaccugacccauugguacaugccggggccagccucggccacccaagcacaggaugugaacagccugaguaccuggugcguaguaggugucguucaggacacagcagauaagcacagaggaaggguagggccucaggccugugguccugaugaugcuggguguggagaguggggucggcguugggguccaggcacuggugguggucgucugcacagugcugggggugggggcugaagaugacccggucgugguaccgcgagugggggugccugugagagcag

SEQ ID NO: 15477 - RNA, 14215 nt, Homo sapiens
gguauugagggggaucuggagaaccaagagaaaaucucuuauuaaacgcagauuucacagaaaacaauaacuuuacaaaacuggaaaucuaccagccuuuuaggcaugaggaauugucacgcaggguugccuagcgauggacaggcacauuucaagaaauacgggcucaacccaucgagccguauuaacuuuaauuauuaacguucaguguaauuaugagcuaucuuucuccuugcauccgaggaaagcucuguuccugugcaguggggcuguguggcccuguucugggggugagagaaugucugauguacuucuccuaaaucugaaaaacaaauaauaguaaugauaaaaaacaaauugaaaucguaaauaaacggucucacuacaggcgaggugcagguggaugggaaggcagggcuggggcaccccugcggccgugguggcuguuccccagcggggaccucgccauggucucgagagccauauuucauuaaacaaauaaauacaaagacagucaugcuaaaaauucauggaauguuaagccacaauucaccagacuauaaacaccauuccgucuucauauuccuguuaucggucagagguggaggcuccucauggugcauuuucggcucaauugcuuuggacacaguuucuuucuacaucacuucuucguggcuaucucaggaagggacaggagggaggagaguggccuccugggcuccuguggccucggcaugccgugcuuuguuaguaagccugaugucaggcguggccuccccucuuuccuccuuugcggguggggcccauugucccuccucacuccgcuccgguuaaccaccacgaugcugguuguguggacucggccuguuccucuugaggaaugggauucaugcuccaaaaguauccagccugcaccugggagccccucggagaugacgccuuccuuccugccccucccacccugcacccagcaccagcuagagacagccuggugcagcccccagaaguccauggaggggaaagugggaaaaaccccacuuuuaagaaugugacccccauguuuuucccagcuuguuuaagcauuuaaaaaauuguucugaaauauacauaaaaggcaccaccugacacauucuaaguguauacaguuugggagcauucaguacguuugcacugauacgguuuggcucuguguccccgcccaaaucucagguggaauuguaauccccagaguugggggugaggccugguggggggcgauuuuagugccgucccugggugcuguccuccccacccggccugaguucucucuagcucuggguguuuaaggaugcagcagcucccgcucacucuuuugcugcuccugucagguuagaccagccugcuuccccucgccuuccgccacgauugagagucuccugaggccuccccagaagccaagcagacaccagcaucaggcuuccccugcagccugaagaaccgugagccaauucagccucuuuucuguaucaaguacacagucucaggugauucuuuauaguggcgcgagaaugggcgaauacaugcugcacugcgcagcccuccccccgccccccgcagccugcucucgggcuuucuauacccccaccuccuccuugcucacggcugauggauaccuagcgaggaggggaacugcaggggcucucacgggcagcaggcagagcugugggcuuucaucugaggccgggucugaagguuccuacgcucccagacaucugaccccuccacucccucccacccauguacggaagccccacccaggcugggcugagccuccuggggccccagggcgguugcccaccucugagucccuggaaggucuuucugcagccuguggcuggguccugcccccugggacuugggcccuuuggccucggagccacccaggaacaaggcccccaucuuucuccagcacagccugugcuaaugagaggcagacacagacuccgagcccccuugcaccccuguuucccuccucagcugcccaaagagugggcaggaaccgucacccuugggcuacagaggcugggcccuccaaccccagcagacagagguucugggagccgccucagcacgacccagcaagggugggcaguggggacuggccacggggugcucccagcgccucccacccccucagcucuccuucccgcacccugaguccaggggaugggguagcggccagcccagcugggaagagaguggagcuuucacuuggggugccccagggugagcuggggguauugagggggugacgcaggugggcagcacuuggcccucacaaagguuaucauuuucacagcagagaguaaggcugccagacacagcucugggaucugcucugguccccucgacgguggguggccagugacccaccuggugagcccggcggacaggaucguguccuuggggauacgggacuggcgccugugaggcagggcccggcccgaggagccuccggguccugcuggguucuuggccuccguccaccaugcaccucccauccccucaagccucuucucccacaccccucccuccucgccucucagggccccuguggcaccuucguagcaucccagcuuaugugaccucagguuacacaagcagcagccuggggcaccucugggcuucucuguuaaaucaucaggaggaccuggcgggcugcacauaggcagacgguccacggagccacagccgggacccgcacagaaccacucggggcccagcccuagaugagagcucaacagcgaggagagcccugaccuggagcgacagcccgaggccccugcugcacuugagcugcagagagggaggccaugagcuccgacaucacagauggaaggccgagcgcaguggcucacgccuggaaucccagcacugugggaggccguagcaggcggaucgccugaggucggugggucacgugaggucaggaguucgagaccauccuggccaacaugacgaaaccccaucucuacugaaaacacaaaaauuagccaggcaugguggcagaucucuguaaucccagcuacuuggaaggcggaagcgggagaaucacuugaacccaggcggcagaaguugcagagagcugagaucuugccacuguauuccagccugggugacagagugagacucuaucucaaaaaaauaaaaaauaaaauaaaauaaacacagaugggaaaauguccccagcccccaaaauaccacaaugaauccgaaagccaaacgaucugggaaagaaacauuucuacauguacgccacagagaaugcuaauaucuuccguuuacaaagggcuuuauaaaucaguauuaaaaaccggaaaggacaugaacaacucacaaaagaaaaaggcaaauggcuacuaaauacauggaaaaaaugcggagccucagcagugaaugaaaacgugcaggguaacaagcgucagagcucggcccaugagggcacaccaggguggcugguucacauccacaguugauggaggaaggaacgggcgugagcccauggccguaaaaucagugcaacucggcccggcgcgguggcucaugccuguaaucccagcacuuugagaagccaaggagggaggauuucuugaguucaggaguucaagaccagccugggcaagauggugaaacccuaucucuacaagaaauacaaaaauuagccaggaguagugguacaugcuuauagccucagcuacucaggaggcugggguaggaggguugcuugagcccagaaggcugcagugaccugagauugcaccacugcacuccagccugggcgacagucgccaugcugaccguuauggggucaacugcauccccccaaaauucagagguuaaaguccuagcccccagggccucagaaugugucuguaucugaggagagggucuuuaaaaagguaauugauuuuaaaugaggucccugggaugggcccuaauccaauaggacugguguguuauaagaggagcagaugaggacacagacacacacagaaggaugaccacgugaggaugcagggagaaggcggugucugcaagccgaggagagagaccuugggaggaaccagcccugacaccuugaucuccggcuccagccucgaggacugugggacaaucagugucuguuguccaagccgccugguccugggugcuuugucuuggcagccauagcagaugaaugcacuggcguuuggugaaaaacuggcaggcuuugagggagugagucaagugcaugggaagggaaggcccucugggccaaguccagggugguggccugaggcaagcgugugcccaccacacagcaccgugaggagaagccggccagcuggagcagugcacggcacgugagugagugggagaugaggucagagagauggggggcaccuuggcuuugacccugagugagaagggcucacggaagaguugcaagcagaugggggauggacucugccuuauguucuuagagggucccucggagccuguguuuaccucauaaggggccaaggguaaaagucaaaggccacagagaacucaucaauaugaauauacauguuauaccaacaaauuaaauuauuuaguugaacaaauuagaucauuuaacuggauaaauuagguaaguuaguugaaauggacaaauuccuagaaaaacacaaucuaccaaaauggacuuaagaagaaacagaaacacugaauaaacaagauuaaaggaauaauuuaaaaauuuccugaaggaacaaacucuggaccagauagcuucacuggugaauucuaccaaacaccuaaggaagaauuaauaccaauccuucacaaacucuuccaggaaaucaaagaggaggggacauguccuaauucauuccaugggggcagaaccauccugacacccaaaucagacaacgacaucacaagaaaagaguuauaggccgggugcggcggcuuacgccuguaaucccagcacuucaggaggccgaggcaggcagaucacuugagguccggaguucgagaccagccuggccaacagggugaaaccccaucucuacuaaaaauacaaaaauuagccggacgugguagcgcaugccuguaaucccagcuacuagggaggcugaggcaggagaacugcuugaacccagggggcggagguugcagugagcugagaucacgccacugcccuccaacccuccagccugggcaaagagugagacugucucaaaaaaaaaaaaaaaaaaaaaaaaaggcagcuaugcagcuauagaucaauauccuuucugaauauacacacaaaaauccuucuacaaaauauuagcaaacugaauacagugacacagaaaaggauuauauaucaugaccaauuucuggagccuaucccaggagugcaaggcugguuuaaauucaaaaaucaguuaaugaaauacaccguaucaauaggauaaaaaacaaagccacacgaucaucuuaacugaugcaguaaacacauuugacaacauccaacaugcuuucauaauuaaaaaaaaaucaacaaaguaggaauagaagugaauaucucccaccugauaaagagcaauuuuuuuguuuguuuuuugguuuuugauuuuuuuccugagacggagucuuacucugucgcccaggcuggagugcaguggcacgaucccagcucacugcaaccucugcccuccgaguucaagugauucuccugccucagccucccgaguagcugggauuacagcacgugccacugcgccuggcuaauuuuuuguauuuuuaguagagaugggguuucaucaucucggccaggcuggucuugaacuccugaccuugugauccacccaccucaaccucccaaagugcugagauuauaggcgugagccaccacgcccagcugauaaacagcauuuuuuuuuuaaaagccacagcuaacaucauucuuuuuuuuguuuuuuugagauggagucucacucugccgcucaggcuggagugcaguggugcaaucucggcucacugcaagcuccaccuccuagguucacgccauucuccugccucagccuccugaguagcugggacuacaggcgcccgccaccacgccuggcuaauuuuuuuguauuuuuaguagagacgggguuucaccauguuagccaggaugaucucgaacuccugaccucgugaucugucugccucggccucccaaagugcugggauuacaggugugagccaccgcgcccggccagcuaacauuauucuuaaugaugaaggacugcugcuucuccccuaagaucaggaaaagaccaggauguuugcuuucaccacuucuauuugacauuguacuggagauucuagacaggguaaucagucaaggaaaagaaacgaaacacauccagauuggaaaggaagaaguaaaacuaucucuauuuguaggugacauaaacugguauauagaaaauccuaaugaauccacugaaaagccauuagaacaaguucuaacaaacaaguucagcaacauugcagggugcagaucaauaugcaaaaaucaauucuauuucugugugcuagccaugaacaaucugaaaaggaaauuaagaaaacaauuccggcugggcaugguggcucacgccaguaauccuagcacuuugggaggcugaggcggguagaucacgaggucaggagauggagaccauccuggcuaacacggugaaaccccgucucuacuuaaaauacaaaaaauuagccgggcgugguggugggcaccuguagucccagcuacucgggaggcugaggcaggagaauggcgugaaccugggaggcagagcuugccgugagccgagaucguaccacugcacuccagccugggcgacagagcguuacuccaucucaaaagaaaaaaaaagaaaagaaaagaaaacaauuccauuuaaaauagcaucaaaaggaauaaaauacuuaaaaauaaguuuaauaaaaaaugugcaaagcuuguucucuaaaaaccacaaaacacuauugaaagaaauuaaagaagaccuaaauaaaugguaagauaucccauguucauggauuagaauucuuaccauuguuaagaugacaauacuccccaaauuaaucuacaccuucaaugcgauugcuguuaaaaucucagcugccuuuuuuacagaaauugacaagcugagucuaaaauucauaugggcugggcauggucuacaguuacauggauaaguaaggcauggucuacaguguccgugugacggaacauuauucagccacagaaggaaggaaaugccgacacauuccgcaacauggaugggccucagagacgcugugccuagggaaagaagccagacacaaaaggcuacauauugugugauccuguccguguaaaauguccagaacaggcaaauccacugagugaggagauagaucugugguugccugcaaucgcaggggcagggaguggggaguguguuuaauggaugugggguuucuggggggaugaugaaaauguuccaaaauugauugcagugauggcugcgugguucuuugaauacacuaaaaaauacaaaucacugaauugagccauuuaaauuggugaauggucugggcgcgguggcucaugccuguaaucccagcacuuugggaggcugagauggguggaucaccugagaucaggcguucaagaccagccuggccaacauugcaacacgcugucucuacuaaaaaggcaaaaauuagcgcacgccugcaaucccagcuacucgggaggcugaggcaggauagucgcaugaacccaggaggcagagguugcagugagcccagaucgcaccacugcacuccagccugggugacagagggagacuccgucucaaaaaaaaaaaaaaaaaaaaaaaaaaaaaagaaagauguacaucugucguugccugaaauugcaggggcagggaguggggaguguguuuaauggauguggguuuuugggggggauaaugaacauguuacaaaauugauuguggugauggcugcacaguucuguaaauacacuaaaaaauacacaucacugaauugugcagugugaauuggugaauuguaugauacgugaauuauauuuuaauaaagccguuaaacauuuuuaacggaaaggaggauguuacaaacaucacauuuagcagaagacagcuggcagacacagagcuagaggugaacuagugguuugcucuagguggugggaccagaggugauuuuuauugucuuuucauuuggcuacauuuuucaaaauuucuucaauacccauacauguauuugucaauuuagagccacauagcaucacuuucucaacugucuuuucagacacauuggucccacccuccugucuaaaucuuggcuaucagcucauccugcugccucucccuccccauuccuggcuucucucaacaggaagaggagcaggggccucugcgucaaaggccggcuuuggguaagucaggucaccacucugacccucagaauccucuuccccacugcgggagcuguaccuugcuuccaugacacucuguccccugcuuuccucccgcugcucugcuccuucucucccggggccuucccuuacugcaccaucccuccgugucgcccuccccacccucuggccugucuucucacucugcaagcccuccuugggugucuggcuccugggugggcaacgcuuaccucugugugcuggugaccugcagagcuuccaggacaaugugugcaguguggagcugaccccccugccacccccagcaagggccaccugggcacugcccuucccaggcuucccuccuugucccucagugggggccaucgugggggucugagcacacaugcucggcagaugcuggaucugugcugggcuucugagcaucagaggccucagugugccccuccaggcuuccuggucaccuccauugggugcagcaggaagcccccgggcuggggcagggacaggagcucagauggagacaggagguucaacagcuaauguccccacugugacaggcucugcuuuccaccaguguggcugggagcaccuggugguggggacacccagaggggccugggugggagacccccgcaccugcucccaccugcacacugaccucccgccugucucuaugggggacucuggccaccuauguacaacagagggggaauuagacuguggccacccucuccagaacugcaccccguuccuuucugcagcaggacgggcuggccaagagcaaccgauugucgagauaagaggccgauagcugucgggcacggagcuggugggcgccaggcuggcggggcguggggcaagccuccgggaagcgacugaugagagagcagcgggaggaccagaggugaugacgaaggcagggcgggagugggacgggggccgcacaacagagacccuaaccugagcccgcugacccagccgucugaccccuguccagggacaggugggugcggggugugagcagagaggacggaggcagguguggcugugggcaggguggcuucucuaaggucccccgugguagugggggaucuuuuuguaggacggagucaugggcagccugggccagccagggaggcccugccaguggggaaggagguggcugcuccuacggcugggccagaggugucccugauguccguggaugguccuggcaaccaagaaagcggcugcucuuccuccuccacacagccaccuuggugagggagacggggcgggucagggacggggcgggcgcaggaagcccagcucucaggcggugaagggggcggguccaggagggggugugaggcuggcugggaggccccgggaaugcgcgcgacggcaggccgucugcccacccgugccaccugcccuccccccacgggcccucggcccagcuccugguggccgugagcuugucccgcagcucggagaugcugcuuagcggggcgccucgucauuggucgugcgccugcucagucuggggcaggggcugggacagcgucuuuaauccccggugccggugcggggaucagggcaacguggagugagacagcgaagggauggcgccgugagcccucagcgcggggagacacacgccgggccggggcgccaggagcggggguggcggggaggggagggagggaaggcuggugacgucagugguuccaguuccgcagcagcggaggccgcggccggggacgugagacaccagcugacgcccggagccucacaaccucugcacacacauucuccugagggccggugccuggaaacaaaggccacccccgccggccggaaacuucuaggcuggcaauggagaugggacaucuggugacccccucuguauccuccucucccuugggguccuccaggaagggcugcgugaucaaugacccacuuuuuuguuuuguuuuugagauggccucuuguucugucucccaggcuggggugcaguggugugaccuagguucacugcaaccuccaccucccggguucaagcgauucuccugccccagccucccucguagcugggacugcaggugcgugccaccgcgcccggcuaauuuuuuuuuuuuuuuuugagacggggccucccucugucgcccaggcuggagugcaguggcgcuaucucagcucacuguaaacuccaccuccuggguucaugccauucuccucccgaguagcugggacuacaggugcccuccaccacgccuggcuaauuuuuuuuuuuuuuuuuguauuuuguuuuuuuaguagagacgggguuucaccguguuagccaggugaaacccggccaggucuugaucuccugaccucgugauucgcccaccucagccucccaaagugcugggauuacaggcaugagccgccgugccaggccaauuuuuguauuuuuaauaaagucgggguuucaccauguuggccaggcuggucuugaacuccugaccucaggugaucugccugccuuggccucccacagugcugggauuacaggcaugagccacugcccccagccucaaugacccacuuguccacuggccugcacuuacauccucaggcagcuggagccgccuccugcaggaagcccucccccugccacccacccacccacccacccaaaggcggggcuuccccuuggguugccauggaccuuguggccggcagggcacccggugcacccaggugugucuccccgcguggcccacaggcucuucuggguggagcucagaagagccucugcgcagcuuuacugaaguaagauuguacguauaugauucgaugaguuuagcaaacaagccagccgucaggaugugcaagaauuccuaucgcccuggacccacagccaccccucugccuucuguagcuacaguuuugccuuuuccauaauaucauagaaauagaaucauacagcacauggcuuucugaggccagauucuuucacuuggccuaauguguuugagauuugcccacaucucagccacgcuuccuggcccgcuguggucacggcugagucgcguuccccgugugggugcaccacagccugucuguccagucaucacccaaggacaacgggguucuuuccacuucuuggcuguuacuaauaaaguggcuaugaacauuugcaugcaaguuguguguggccguaaguuuucuuuuucuugggaaaauagcuguaagagggauuguuggaucguaugguaacggugugucuaauuuuauaagaaacugacagacugguucccaaagcaucauuuugcacucccaucugcaacgucugagaguucgaggugcuuugugucgucuaaauuuccgucaucauuuuuuugaggcagggucucacucuguugcccaggcuggagcguaguggcucuaugguggcucacugaagccuccaucucuccaguucaagcaauucucccaccucagccucccagggagcugggacuacaaguguggaguccugguguguagccaugccuggcuauuuuauuuuuauuuuucauagagauaauguguuaggcuguucuuguguugcuauaaauaccugagacugguaguuuauuuuaaaaagagguuuaauuggcuuaugguucugcaggcuguaaaggaagcauggcauccggaagcuuccaauaacgguggaaggcaaagggggagcaggggucucacacggcagaagugggagcaagagagagugggaggggaggcucccacuuaaccagaucucacgaauacucaccauugcaaggacagcaccaagccccgaggaauccaccccaugaccaaaacaucucccagcaggccccaucuccaacacugaagauuccauuucaacauaugucugggcggggacaaauacccaaacuauaucagauggagucuugcuaugcugcccaggcuggucucaaauuccugggcucaagcuauccucccaccuuggccuuccaaagugcuggcaguacaagcaugagccacugcaccuggcagcuugucaauuucuaaaaaaaaaaaaaaaaaaaaagagaaaauuuaaaaaaucaaauuaaaauuaaaucgauuacuugggccuuguuaagucucacuuaauauacugagagauguauaaucguuuuuuguguacagaucucaugcaaauucugauaaauuuaccccuaguauuucgugguuuuuaaauucucuuuguaagugguacuguuuucauaauuucaacuucuaauugaugguuagcacacaaauagaauugaccuuuuuuuggcuuuguacccuguggcuuugguaaacuuacuuauucguuuuaguaccaguuuguagcuuagaauuuucugcagacaauaauguuaucuucuuguuuuacuuucugacauggaguuuugcucuuguugcccaggcuggagugcaauggcaugaucucggcucacugcaaacucugccucguggguucaagcgauucuccugccugagccuccugaguagcugggauuacaggugcccaucaccaaacccagcuaauuuuuguauuuuuaguagagacaggguuucaccagguuggccaggcuggucucgaacuccugaccucaggugaucugcccgccucagccucccaaagugcugggauuacagacgugagccaccgugcccggccauuaauguuaucuucuaauaaagaucaccuaaaauuuccuuuuuggcugggcacgguggcucacgccuguaaucccagcacuuugggaggccgaggcggguggaucaugaggucaggagaucgagaccauccuggcuaacacggugaaaccccgccucuacuaaaaauaaaaaaaaauuagccgggcgugguggcgggcaccuguagucccagcuacuugggaggcugaggcaggagaaugacgugaacccgggaggcggagcuugcagucagccgagaucgggccauugcacuccagccugggcgacagagcaagacuccaucucaaaaaaaaaaaaaaaauaauaauaauaauaaaaaauuuccuuuucaacugguacaaauuuugucuuccuugccucauuacuucggcauguacucuggcacgacacugaaauaaaugaugaugauggacaaccuugccccaucccugacccaaggaaaagcuuucaguuucucaccacuaagccugacauuagcuguggguuuuuguaguuucccuuuguuggguugggagugcaggagcagaauagauucgaaucuucuccuccugguuuacugagagccuuugucgugaaugagugcugaauuuuguugaaugcuuuccuugcaucuguggaaaugaccgugugguuuuucuguguuggucugcuaauagugaaugacaauugauuuugaaauguuaaacuaacuuugcauucccggguacgcuccacaaggucauauguguucucuuuauauauugcuggaauugauuugauguuuuguuaagggauuuuugugucuaggcuccugaguggacuuuaauuuucuugucauguccuugcaugguuuuggcaccagggugaugacaguuucacagaggagcugggacauggcccgucuuccucuguguccuggaagugucuguguagcggggugcuuuuccuccauuaguguuuggugggcuccacuggugagucuuggccuggacgucuuugugagacugggcccuuucc

SEQ ID NO: 15478 - RNA, 1326 nt, Homo sapiens
ccagccaagccccugugcugcugggauaggccugcuucacuuagggagcacugccucaagacagguaaagcccccucguuugcccccacccccauggggccgcucaggagagaaacucccauucaccccuuucccagggugcucucucucuagguggcaugccagcccccaaacacaaguggcuuuugggcccaggugggucagccugcugccccugccccauacccccucgggccauugggaccccugcccuucagauguccuagggucuaggaguggggccagucacugugggaagaggccaggggcuuggccggagaggcagcccagggcaggacccaguccugaguccuggagcagggccagggaggcgcccaucccgccccagccagccgcccucucugcuguuucuucuauuuguucuucuuuucacccacagcucuguguuccugucaucccuccuuucagcaaaaguccuguucccguucccucuguccccacccacuccuguucccccaagaaaauaagcuaucguuguauuugcaaucuauggauuagagguuuaaguauuuauuauuauugguuaauuauuauuaauuauguaaauuugccucccauaugucuguugcguuggguuucugaggagacccugggugaggaggaugcacuggcuucccgcuucucgccccccaccccugugcuguccgggagacaguggucuggggccacugguugggcccccuucucccuucccccuuccccuugucccuucugcaggccguugaggggggcugucugucucagucugucucugcucccacucuugaggcacugguuaccgcaaagugagcagccagcaggggggcgaagguccuguguuggccacugccuccuccagugcugcaggaggcgggcugaggccccaccugguggcuuucaccugacccagcccugaguccucuccaagccucucuccggccccucccaccuggccacugccuccuccagugcugcgggaggcgggccagggccccaccugguggcuuucaccugacccagcccugaguccucuccaagccucucuccggccccucccaccuggccacugccuggcauugggaucgccccaaaauggacccggccccuccuguuauuugcugggaaguccagcggaggagagggugcaggucccccgcugagccuccagucucuguagacugggcugccggcccuucagccccccuuggagccccucccgccacagccgcaccuucugcucccggccccucccuuuguauuuggagacaauguguuguaauaaagcuu

SEQ ID NO: 15479 - RNA, 566 nt, Homo sapiens
cucagaucuugcacuggcagcaaauugggacacagcagcuggacugggaacagcagggcuugcagcagcuggacuggcagcaggaugacccacagccugaagagcagcagcagggcuuacagcagcuggacugggaacagcagggcuugcagcagcuggacuggcagcaggaugacccacagccugaagagcagcugcagggcuuacaacagcuggacugggaacagcaggguuugcagcagcuggacuggcagcaggaugacccacagccugaggagcaacagcagggcuuauagcagcugcacugggagcagccacaagaaccacagccucccuuggagcccccacaggagccacagucccccuuggagcccccacaggagccacggccccccuuggagcccccacaggagccacagcuggagcaggaacaggcuggcacacagcagcacacgggcuugcagcagcagaugggcacacagcagcuagagccacaucccccacagccagagccgcagcccccacagccggagccacagccuccagagcagccacagcagcccaug

SEQ ID NO: 15480 - RNA, 474 nt, Homo sapiens
acuggcagcaggaugacccacagccugaggaacagcagcagggcuuacagcagcuggacuggcagcagcagggcuuacagcagcuggacuggcagcaggaugacccacagccugaggagcagcagcagggcuuauagcagcugcacugggagcagccacaagaaccacagccccccuuagaacccccacaagagccacagccccccuuggagcccccacaggagccacagccucccuuggagcccccacaggagccacagcuggagcaggaacaggcuggcacacagcagcacacgggcuugcagcagcagacgggcacacagcagcuggagccacaucccccacagccagagccacagcccccacagccggagccacagcccccacagccggagccacagccuucggaacagccacagcagcccaugguucugguggauugaggguggagcagguagaggagcaggugagagg

SEQ ID NO: 15481 - RNA, 702 nt, Homo sapiens
cagcaacuagacugggagcagcagggauugcagcaacuggacuggcagcaggaugacccacaaccugaggaggagcagcagggcuuacagcagcuggacuggcagcaguagggcuugcagcagcuggacuggcagcaggaugacccacaaccugaggaggagcagcagggcuuacagcagcuggacuggcagcaggaugacccacagccugaagagaagcagcagggcuuacagcagcugcacugggagcagccacaagagccacagccuccuuuggagcccccacaggagccacagccccccuuggaacccccacaggagccacagccccccuuggagcccccacaggagccacagccccccuuggaacccccacaggagacacagccccccuuggaacccccacaagagccauagccccccuuggagcccccacaggagccacagcuggagcaggaacaggcuggcacacagcagcacacagguuugcagcagcagaugggcacacagcagcuggagccacagcccccacagccggagccacagcccccacagccggagccacagcccccacagccagagccacagcccccacagccggagccacagcccccacagccggagccacagccuccagagcagccacagcagcccaugguucugguggauugaggguggagcagguagaggagcagaugagau

SEQ ID NO: 15482 - RNA, 11390 nt, Homo sapiens
gcacagaggggaggccggaggccaacaacuguauuuccaugucagcuggggcucucagccgcccaaggggaggacaacagaggucagcugcagaggaaggcuggcaccagcccccaaucccaaccccaccuccaggccaauacaugccccugggacuggcucagucccagcaccacccugcaggcuccaacaagguggguuuuguccccucucacuccuuccagcucauccucaggccucuagcggccucauccucaacgggcccgggacacugaacagguaggguggcagagcccagcugggcccaagcugggcagaggggcccucaggcagggcagguuuccaagggagggcccgggaggacggccuggugugggguaggggcucagcccagcgggcgcugguagggccggggaggggacucccuggagaugaagggagccccaggauacacgagcucggcugccaagcuuggguggggucuuccaaugcacgaaacagaucugugcucuggaucagcucuacccccaccaaacagauggagagacagacaggcaggcagcauuucugaacccagggaggggaaaaccacagaacaaaacagcaagucgggcuugggccgccggcuuccagggcgcccaggacagugggcgggcgagugugugggugugugugggaggggccgcugggccaggggccuccugcucugggacucuccucuguuucugugcuggcgcgcggacgccuugggaacuagaggcgggcagccucggcgaagcccacccuguuguugucacggucaaacacaguguaguagcggccgaugaagacgucgcccaggauccagaguggcccgcuggguggcgggauguccaugcccaugaagccgcucaggcagagggucuucccggccugcgacaccugggacggcccugguggucaguacccaggccuagcaccacccgcccccccaccuguugcccgcucaccuggagcgugcgcccccucaccgcccgcucaccuggggcgugcggcaccccauugcccgcucaccuugagcguguaguccucuggggacagcuuguagccuuugccucccagcuucagugugaucgcgggcaggguggacaccuucucacaggggaucauguacuaagaggggucacagcagugucagggugguagugguggccuuggggcucccccugccagccccagccccagccccagcccccggcgcucaccucgcccugaaucagcggcacggccccgauggccuucugcagcucgcgcaccucauccaccgggcccaccaugagggaagugccuguguccacaauggccucacagcccuccuugcacagggucagcccgcuggccaccuccacccugcggggagucagggcgugaagccccugccgggacuggagugugcccugggggcccagugccccucccugggagccccuccccuggcugggcugcacucuccuccccucagggcuccuggaagcacagccggcuguaagcccuccagggaagagggugggagaggagacacagagugguagagggggugggagacccucaggugguggugaggggcauggagggauggaggggauggaggggcauagagggauggaggggauggaggggaugaagggauggaggggcauggagggauggagggauggagggauagacagauggaggggauggagggucauggagagucacagagggauguggggauggagggauggagggauggaggggauggagggauggagggauggaggggauggagggauggaggagauggagggucaugaagagucacagagggaugaggggauggaggggauggagggcauggagggauggacagaagggauggugggucauggagagucacagaggcauggaggaaauggagggauggagggauagagggaauagaggggauggaggugauggggagcauggaggggcaaggaggggcauggagggcuggucugaccccaucucuuucuugcccagcucccacuacuccccacaugcaacccccaccugcagaaccgggguccuccagggucuccgcacaccgcccccgcccacagaacccaggggagccgacugcagccacuacucacugguccagguggaccugccaguaggccuugcgggugacauucagguaggacagagaacccuuguaauacuuggagucugugccacccagcaucagcucacccccaggcugcgcaucugggucccuaggaggaaaagggaggagucagcugccacgccaccccccaagcacaagagugccaggucaggaguaagagggugaauguggcaaucagggagagcuuccugaaggaggggccuuucugaaacugcagggauggaaaggcccagaaggcaggaggagggacagacucccuucuucccgggguagggcugcucugcgugggcccagccuggcccagaagagguuuuccucaacccucagguucuccuggucugcucaggagccaagguucagccagacaucagggucaaggcuagcggcagacaaggaagugagugccaggagcuccacuggggaggacccugucugucugucuggaagaaaaaaccaaagaaggcuuccaggagggagugauggcacaaucugggaaguugggauggcugguucuggccgcagggccucugcacuggcugcuccugggaacacccuccaccugcauccccgagccacguccgcucaucucccccucauccagaccacugauggccagccaaggugcuccugggcaggagcgcacugcacuuccuaggaccugcaacccaugucgcccggguuuguuucuaaacauugcucaaguacagcuuucaacgcagcaaauccugccgguccugguagagaagcucucugugucuggggcgguucugccaucccgccagagcgucugcagcuaagcuggccaccaucccacugccugucacucgaggcagugccaggccugacccaguccucccaacaccgauuggggccuccgcccuccuccagccuccuccgccuuugccucuugucaacaccucugcaaucccaaguguagaaaccugaucagcgccucccaccccuccucuccucaccaaacaugcuuucagaagcccucagacccucccuccugccuggcuccacuuccugcccaagcugcugccuugagacuacaccugggcacucacaaccaugugcaccucccccaccugggcacucacucugugugccccuccuuccaccuggcacucaugccuguguaugccucccccgaccuggguacucauaccgugugccccucccccacaugggcacucaugcugugugccccucccccacaugggcauucaugccugugucccccucccugaccuggguacucaggcugugugcccccuccccaugugggcacucaugccugcaugcccucuugcccucaggggaccccuuuucaccuggcugccuccccugugccccaaggcuccuggggaaauggcccagccgguucaccuguguccuggccucuagugagcagcuuagcccuggguguugcuaaggaguauucacugcccaggcaaggggcagagcaaagaggcccagccagcccuacagccggaauucugccggaagcgauccaagguuaggggucaggcccagagacuccaagugccaagugagccacgugagguaaaccugccccugucagcccuggagaguguggggcagugaccaggcgcagcucagggcaggaggccgccggcugacacgcugcccacccccaaaacaaaagcccccaacccccagucaccccucuuauguggaacccuccacucaggucugccccgagaagaggaaacuaacugaguccgacguccccuucccaaggucaccugaccaugggucacccaagcuggagcagcggcugcaggugggggcccugggggagaacccuuuucccagaaggaagggcccccuauguuccuccucgagggcagccggcaccugcuggggacgcccacagagcugcucgcagcguggugccggggacccauacgcacccaaggucaccuccccggggauccccgguccccugggcaccaugacccucuccaccaucagcaaccccgggaccaggaccacaugugcccaucaccaggucuggggaccgacgggccgacugaaccaagaggaacugccacgaccccugaccuggguccauucucauaggagggaggcccagcugccaaggucccaggacccacagccuggcccgagccccucccacugggagaccccggccaaacagcuuucucugugcugccgcuuacuccucugcagaagggcggccaacccccgccucccggaugcccugaggucagaggucaggagcucuggcacagcagcagggagggggcagcacugagagggggugccuagaaggcuccccguccagccccgcccugccucccagcaacgcggagcgagagggaacccacacgcccaccugcucagguagaaggagaagauguucugguccaccagcuucugcugcaucagguugucgaagacgggcagcacguuguugacggagaugcggggguaggccaugcccaggaugccaucgaacuuggcugcgaugaaggugaugccuggcugcuugguggccuccccaaagaccugccucuccacuuugacaccgcccagggcagaggcugacgacgcugacuggcagggcaccugcaggccagggcagagucagugggcagcagacaggcugagcccuacaccacucccugagcaugaggcuacaaaacccaguucaauggaugcccaucccacacacgauggggcccagagggcccagaagaaagggcuggaaacccugagcugaacaccgcuggggauggggacacgggguauggcggggcccucuucguggaagucaucagggcucgguuuacacgagaugggaaccaggcaggagcacagacgggcaggccccuugcuccgcucccugcuccgaccucuuacucccaccaccaaugacaggcagguccugcuccugcccucagcgcugggaacaagacacagccugggccaggagcccgagagauggggaaccugccgaccccaucccaagcucacagccauacugcccccuuccccuucucugccuguccccucccccagcccuggaugaggcugcagagagagaacacggccagagcaggaugugggaagggaacgacagcuugaggcugacacggggcggagggggcagaagagggcggaagagggcagacggggcaauuuccuguucaggcugagcaggguccagacaggagggcucugaggagcccccaguacagacuggacuccagcccagcagggaacuguuaggagcagcuucagcuggaggaaggggcccucuucccgggucccugggccugcaggggggcucugcugcccuccuggcccgcuccagagcugggggcugugucaccaucccguaacuccugaaccccuuguggccugguccacccccagcagacagcuccgaggugagaacucacugaggcccaggcagggugacaagggccagcucacccucuccuagggcagggaguugcucugcacagggcccugaggaugguggaugcaggcggggcccccaacagccacugcugcucccccucccuugcccucccaggcuccugccggugacucuccgccagcagcccccacagcggguuccugguacauccucccaaccccaagccuccccaagcccucggccugcugcagggacccugugcagccccagguccagcccucaacaccugcuggcaccucaaacccaaugugccaaaaagagcccgaucgaucugcccuguccucccucccacucauuguggccugacuccggggaccccugccccuguacccccuggguuugaggcugucccuccagccugcacacaaccaggcccauucccagaccccuccucacccugcugacugccccggccaccugagggcugggguugggcugggaucaccgagcccucccuuucaaccacauacccacggugggugaaccccacacccuggcacccucgaguccugggaaaggccccagagggacucaccgacacaguguccuggcucagguacccggagaggcugcccgagccauaguggaugucaaacgagguaccauucuucacguaggugcuggacuugucgcuguuguacuugugguggaucccugccccgggcgacaagggggcccgccggucaucccgcagcccacgccacggccuuagcccucccaucccccuacaaucuaccauggagcccgcaccccccaagcugccuccccagggugggauuuggaggggaucugaggcccaccaucaugccagagccccgggacugugggcugugaccccgggccucccucccagccacagccggcucccucuguggccaccccagccccagcccugcugagagcaagaccacagcuggugguucacccagaaagucaguggcuggagcaggguggagggcuggccuggcucacggggccaagaggcaggagaauugcguugcccaagugauuccugaggcagcccugcagcgacaucccggaagggcaggaccugggcgacggggccaggguucgugacucacagcaagcgauguccagcaguuugcaguggauggaggggacccacagguuggaggagcccgugucgaagacgacugugaagcacugggggggcgucccgaugccaaucuccccguaguacugggccuggcaggggacaggguccgucagggaugggagagggggccccaucuccccacugggccucagaaggcccggcuguccccagagccaaggcccauacuggagggaggggcaucacggggcccacagcugccaacagccacccacucccaccugcucagccugcagggaagaugggccagguccccagcccucgguccuaaugcccacggguacuuggggucucuagaccccuggcuucugucaccuaccccugcucaauacauggugaggcugaggacuuccccacggaaaagacaaggccagaggucaagccaggguggggacagacguggcccucagccugagccccgggugcaggaaagcccggccuggaagacuccccugguggcccgcaguccaaggucugagaaaggaagugacuuccuccccagguuggggccaugucaaggucugauucugggugucucagugccugcccugcccuccagggugaaccccaggcuuggagggcuuccaggcagagggguucagcuggucaaggggagaagguaagccuuacaaucacugccugcccagcaacccugccuuaauggcccagggccucaguuuccccguguguacacagggauagcaggcgcaggugggggugcugacucagggaucaggcaaguacaaggggucccaugccgccgagccucucaggaggcagagaguaagaggguccuggaguuuggggucgccugggcgcccgcuucccccaggauuggagccugggccaccgucagccaccagauuccuggcaccagcccagcccaauguuucuccaaccgccuggcuucacggagcagcagcagcugcugacucauggccccacagaagugaccacuggcagggggacacucagcaaauuuccaugugugugugugcaugugugcgcaugcgugcaucugcuugcucgcgcgcuaggacaaucaggaacuggccagucgggaccaggcacacggcgccugguuccccccagggccccccuggcccagucacaugccugugagucuugggcuuccugucacagccaggacucgggccaagcaggacagagggcaaggcucccccacagugggccagagccccgaggcuggacaguaggcccuggccucgaacugaccccauagagcugggaccaggcugaccaagccccagcuugcuagguggcuuccagagugcuccaccuuggauccugcuucccccugaaggaguagugggcacaggaggggcuguugcgagaggaagaagauggggaggggcuggggaggccacgagucaccacaggccucccagcaggacagcagugaaaggcuccaggucagccggccacacucaggcaggcccaaggaccgcccccucaggcgagcuggcaccaaggcccgaggccacucccaaucacccucccaggcccuagcaggaccaagacccugcaaugacaggggccaguggcaggagguuccagaauggggaagaaaggaguguggcugagccgggacgccaccguggccaggugagccacucaaacugcgcugcugagaacaggaggugggaauguuccccauacugccacggagcucuccugacaguggcuccgcuugcagcagggcuaagaccucauacucacguccauguaguucuugagcaccucgggaaugggccccucggucacggcuggcaccgccugggaguacuuugagacggggccuuuggcaaucagguccuccacagagcccccaaccuccgacaugguccggcggauggacgugaacuugugcagcgggauccugucaaccacgggucggggcauaucagggaggcccucccgccugccggccgacgcugccaaugcugcacauccaccuggaggccccuggggaaucucagagucgccacagccaaaaccaaacuccugccugucaccuggaaacugcuggcccagcucccccaagucagugaauggcaacccauugccccccgccagguugcacaggccacaguccuaagaaguggucacccgccacccaccucagccccacacacccaaccugggggccagugugcccaacccuccucuccucagccauucuggaggcuccaaagcccccaagggucucccguccucccucugcaccugcgcuggucucuuccaggaugguggccagcauggcugcucagggugcuggcggguaccugucacuccugcccaaagugcucugaggcagcccacuguacccagcccccaucacaccugcucuccacccccagacaccugcacgaagguggccccaccuccaggcuggcacuggcagcucugccuggccuccucuggccaucagaugggcccuccacaccaccuccagaagcccuccuugacuaccuguccuccuccacauggacccuguggcugcccagugcccucaucccacaucuguuucugggcauccgcaccucuccucacuccaugcggcuccacgagguccaggacugcaccuggggccuuagaggcuucugugcugccccccccaccgcccugccuccuccgacagcugcacucaggguaccccuccagaguccugucacccagcacaccgccagccagggugcaggagggagcuccagacugagaucgggguccugaguucuaaacccaggaagcgaguaagagagagaggggucccugcuccucccccagggccacuggccuuccccuuggugugaacccacuccuuguuccaaggaagcuccccugggcuuuuaaucacuuaaauaaaaccucuucccugccccagggacuugagaguacaaggucauagcuggcuuuuccuggcuugucaggggcgugaucccggaagaugagauuauugccuaagagcuggugggcuggaagagcuccagguuuuguccugggggagggacacgcccuccagggaccaggaagcagguguaauaguaucagucgcacaagagcuggaaucgggugagggcuuggauucagcuacccuucccuccaagaagccccaggaucguuuccccucugcugugucuguccuccuuggagaggggaggccuguggauaggcuggcaaggucaaggcaggcucaggcuuguggcuacucccccacaacgacuuuaauuggggcuacccgcccccgggccauuccccacagccuuuggugaggcucaguccuacccagcuggcccagccagcuccagccccugcagccuucugaccucacccaccugccaaaaggcaguggacccaucgcagaucccaggucucccacaaaggcccagagcaaggguggggcaggugcccaaugggaugggucagcauaccccuccugggaaugcgggcugccuugcaagggcuggggagggggucaagaaagcagacugcagcauggcccuccucugcccagcuggucaggcauggccgggccccaucccauccaggcccaaucgguggccucaccuggcacaggggaucggccugaggagcgugugggccucacuacagcacaaccccaggcccggggugggugagccgacccacuccccaugccuccuccucucucagggacaugggaacuccuagggucucgaggggucucccagcccagggccugugauaagagccgcuggagcaaacuuuuaaagcccccaguucacaggugguaaaggggucccuaaggaaauggacucgcccagacucgggggcucugaggccugaccuaggucuccagcaacaagggcgcucaguacagaccccaauuccaccugccccgaaugagcacuaccuccccccgccccgccccgucuccagggaggcugcggucagucugcaguccucaagguacaacccaggguggcauaugggggagaggcaucuggcgccucugccccggguccccugcaccuccggagcccggcgccccguaggcgggugguccgugcaggaggccgcgcagggcggcacaggugcauuccagcgcggggggcgcaaggggcucgugggggccacaggggagcgcgaaagucaccacaggccccgggaccucggcgccgcgaccccugcccgucccugagccccggccccugaggcuucaccugacgagcgcggaggcgggugcagccagcaggcagagggcgagcggcagaaggcuggagggcugcauggcggcggcggccgggucggagagggucgccgaggccgugcgcuuauagccgggaugacgccgcaguugggccggaucagcugacccgcguguuugcacccggaccggucacgugggcgcggccggcgugcgcggggcggggcggagcggggccuggccugggcggggcaaccucggcgcacgcgcacagcgcccgggcggggggcggggugguggugcgccugccgcgccuacaguucccgccgcucgcgcccgcggggucagcccggcccagcuucug

SEQ ID NO: 15483 - RNA, 11390 nt, Homo sapiens
cagaagcugggccgggcugaccccgcgggcgcgagcggcgggaacuguaggcgcggcaggcgcaccaccaccccgccccccgcccgggcgcugugcgcgugcgccgagguugccccgcccaggccaggccccgcuccgccccgccccgcgcacgccggccgcgcccacgugaccgguccgggugcaaacacgcgggucagcugauccggcccaacugcggcgucaucccggcuauaagcgcacggccucggcgacccucuccgacccggccgccgccgccaugcagcccuccagccuucugccgcucgcccucugccugcuggcugcacccgccuccgcgcucgucaggugaagccucaggggccggggcucagggacgggcaggggucgcggcgccgaggucccggggccuguggugacuuucgcgcuccccuguggcccccacgagccccuugcgccccccgcgcuggaaugcaccugugccgcccugcgcggccuccugcacggaccacccgccuacggggcgccgggcuccggaggugcaggggacccggggcagaggcgccagaugccucucccccauaugccacccuggguuguaccuugaggacugcagacugaccgcagccucccuggagacggggcggggcggggggagguagugcucauucggggcagguggaauuggggucuguacugagcgcccuuguugcuggagaccuaggucaggccucagagcccccgagucugggcgaguccauuuccuuagggaccccuuuaccaccugugaacugggggcuuuaaaaguuugcuccagcggcucuuaucacaggcccugggcugggagaccccucgagacccuaggaguucccaugucccugagagaggaggaggcauggggagugggucggcucacccaccccgggccugggguugugcuguagugaggcccacacgcuccucaggccgauccccugugccaggugaggccaccgauugggccuggaugggauggggcccggccaugccugaccagcugggcagaggagggccaugcugcagucugcuuucuugacccccuccccagcccuugcaaggcagcccgcauucccaggagggguaugcugacccaucccauugggcaccugccccacccuugcucugggccuuugugggagaccugggaucugcgauggguccacugccuuuuggcaggugggugaggucagaaggcugcaggggcuggagcuggcugggccagcuggguaggacugagccucaccaaaggcuguggggaauggcccgggggcggguagccccaauuaaagucguugugggggaguagccacaagccugagccugccuugaccuugccagccuauccacaggccuccccucuccaaggaggacagacacagcagaggggaaacgauccuggggcuucuuggagggaaggguagcugaauccaagcccucacccgauuccagcucuugugcgacugauacuauuacaccugcuuccuggucccuggagggcgugucccucccccaggacaaaaccuggagcucuuccagcccaccagcucuuaggcaauaaucucaucuuccgggaucacgccccugacaagccaggaaaagccagcuaugaccuuguacucucaagucccuggggcagggaagagguuuuauuuaagugauuaaaagcccaggggagcuuccuuggaacaaggaguggguucacaccaaggggaaggccaguggcccugggggaggagcagggaccccucucucucuuacucgcuuccuggguuuagaacucaggaccccgaucucagucuggagcucccuccugcacccuggcuggcggugugcugggugacaggacucuggagggguacccugagugcagcugucggaggaggcagggcgguggggggggcagcacagaagccucuaaggccccaggugcaguccuggaccucguggagccgcauggagugaggagaggugcggaugcccagaaacagaugugggaugagggcacugggcagccacaggguccauguggaggaggacagguagucaaggagggcuucuggaggugguguggagggcccaucugauggccagaggaggccaggcagagcugccagugccagccuggagguggggccaccuucgugcaggugucuggggguggagagcaggugugaugggggcuggguacagugggcugccucagagcacuuugggcaggagugacagguacccgccagcacccugagcagccaugcuggccaccauccuggaagagaccagcgcaggugcagagggaggacgggagacccuugggggcuuuggagccuccagaauggcugaggagaggaggguugggcacacuggcccccagguuggguguguggggcugagguggguggcgggugaccacuucuuaggacuguggccugugcaaccuggcggggggcaauggguugccauucacugacuugggggagcugggccagcaguuuccaggugacaggcaggaguuugguuuuggcuguggcgacucugagauuccccaggggccuccagguggaugugcagcauuggcagcgucggccggcaggcgggagggccucccugauaugccccgacccgugguugacaggaucccgcugcacaaguucacguccauccgccggaccaugucggagguugggggcucuguggaggaccugauugccaaaggccccgucucaaaguacucccaggcggugccagccgugaccgaggggcccauucccgaggugcucaagaacuacauggacgugaguaugaggucuuagcccugcugcaagcggagccacugucaggagagcuccguggcaguauggggaacauucccaccuccuguucucagcagcgcaguuugaguggcucaccuggccacgguggcgucccggcucagccacacuccuuucuuccccauucuggaaccuccugccacuggccccugucauugcagggucuugguccugcuagggccugggagggugauugggaguggccucgggccuuggugccagcucgccugagggggcgguccuugggccugccugaguguggccggcugaccuggagccuuucacugcuguccugcugggaggccuguggugacucguggccuccccagccccuccccaucuucuuccucucgcaacagccccuccugugcccacuacuccuucagggggaagcaggauccaagguggagcacucuggaagccaccuagcaagcuggggcuuggucagccuggucccagcucuauggggucaguucgaggccagggccuacuguccagccucggggcucuggcccacugugggggagccuugcccucuguccugcuuggcccgaguccuggcugugacaggaagcccaagacucacaggcaugugacugggccaggggggcccuggggggaaccaggcgccgugugccuggucccgacuggccaguuccugauuguccuagcgcgcgagcaagcagaugcacgcaugcgcacacaugcacacacacacauggaaauuugcugagugucccccugccaguggucacuucuguggggccaugagucagcagcugcugcugcuccgugaagccaggcgguuggagaaacauugggcugggcuggugccaggaaucugguggcugacgguggcccaggcuccaauccugggggaagcgggcgcccaggcgaccccaaacuccaggacccucuuacucucugccuccugagaggcucggcggcaugggaccccuuguacuugccugaucccugagucagcacccccaccugcgccugcuaucccuguguacacacggggaaacugaggcccugggccauuaaggcaggguugcugggcaggcagugauuguaaggcuuaccuucuccccuugaccagcugaaccccucugccuggaagcccuccaagccugggguucacccuggagggcagggcaggcacugagacacccagaaucagaccuugacauggccccaaccuggggaggaagucacuuccuuucucagaccuuggacugcgggccaccaggggagucuuccaggccgggcuuuccugcacccggggcucaggcugagggccacgucuguccccacccuggcuugaccucuggccuugucuuuuccguggggaaguccucagccucaccauguauugagcagggguaggugacagaagccaggggucuagagaccccaaguacccgugggcauuaggaccgagggcuggggaccuggcccaucuucccugcaggcugagcaggugggaguggguggcuguuggcagcugugggccccgugaugccccucccuccaguaugggccuuggcucuggggacagccgggccuucugaggcccaguggggagauggggcccccucucccaucccugacggacccuguccccugccaggcccaguacuacggggagauuggcaucgggacgcccccccagugcuucacagucgucuucgacacgggcuccuccaaccuguggguccccuccauccacugcaaacugcuggacaucgcuugcugugagucacgaacccuggccccgucgcccagguccugcccuuccgggaugucgcugcagggcugccucaggaaucacuugggcaacgcaauucuccugccucuuggccccgugagccaggccagcccuccacccugcuccagccacugacuuucugggugaaccaccagcuguggucuugcucucagcagggcuggggcugggguggccacagagggagccggcuguggcugggagggaggcccggggucacagcccacagucccggggcucuggcaugauggugggccucagauccccuccaaaucccacccuggggaggcagcuuggggggugcgggcuccaugguagauuguagggggaugggagggcuaaggccguggcgugggcugcgggaugaccggcgggcccccuugucgcccggggcagggauccaccacaaguacaacagcgacaaguccagcaccuacgugaagaaugguaccucguuugacauccacuauggcucgggcagccucuccggguaccugagccaggacacugugucggugagucccucuggggccuuucccaggacucgagggugccagggugugggguucacccaccguggguaugugguugaaagggagggcucggugaucccagcccaaccccagcccucagguggccggggcagucagcagggugaggaggggucugggaaugggccugguugugugcaggcuggagggacagccucaaacccaggggguacaggggcagggguccccggagucaggccacaaugagugggagggaggacagggcagaucgaucgggcucuuuuuggcacauuggguuugaggugccagcagguguugagggcuggaccuggggcugcacagggucccugcagcaggccgagggcuuggggaggcuugggguugggaggauguaccaggaacccgcugugggggcugcuggcggagagucaccggcaggagccugggagggcaagggagggggagcagcaguggcuguugggggccccgccugcauccaccauccucagggcccugugcagagcaacucccugcccuaggagagggugagcuggcccuugucacccugccugggccucagugaguucucaccucggagcugucugcuggggguggaccaggccacaagggguucaggaguuacgggauggugacacagcccccagcucuggagcgggccaggagggcagcagagccccccugcaggcccagggacccgggaagagggccccuuccuccagcugaagcugcuccuaacaguucccugcugggcuggaguccagucuguacugggggcuccucagagcccuccugucuggacccugcucagccugaacaggaaauugccccgucugcccucuuccgcccucuucugcccccuccgccccgugucagccucaagcugucguucccuucccacauccugcucuggccguguucucucucugcagccucauccagggcugggggaggggacaggcagagaaggggaagggggcaguauggcugugagcuugggauggggucggcagguuccccaucucucgggcuccuggcccaggcugugucuuguucccagcgcugagggcaggagcaggaccugccugucauugguggugggaguaagaggucggagcagggagcggagcaaggggccugcccgucugugcuccugccugguucccaucucguguaaaccgagcccugaugacuuccacgaagagggccccgccauaccccguguccccauccccagcgguguucagcucaggguuuccagcccuuucuucugggcccucugggccccaucgugugugggaugggcauccauugaacuggguuuuguagccucaugcucagggagugguguagggcucagccugucugcugcccacugacucugcccuggccugcaggugcccugccagucagcgucgucagccucugcccugggcggugucaaaguggagaggcaggucuuuggggaggccaccaagcagccaggcaucaccuucaucgcagccaaguucgauggcauccugggcauggccuacccccgcaucuccgucaacaacgugcugcccgucuucgacaaccugaugcagcagaagcugguggaccagaacaucuucuccuucuaccugagcaggugggcguguggguucccucucgcuccgcguugcugggaggcagggcggggcuggacggggagccuucuaggcacccccucucagugcugcccccucccugcugcugugccagagcuccugaccucugaccucagggcauccgggaggcggggguuggccgcccuucugcagaggaguaagcggcagcacagagaaagcuguuuggccggggucucccagugggaggggcucgggccaggcuguggguccugggaccuuggcagcugggccucccuccuaugagaauggacccaggucaggggucguggcaguuccucuugguucagucggcccgucgguccccagaccuggugaugggcacaugugguccuggucccgggguugcugaugguggagagggucauggugcccaggggaccggggauccccggggaggugaccuugggugcguauggguccccggcaccacgcugcgagcagcucugugggcguccccagcaggugccggcugcccucgaggaggaacauagggggcccuuccuucugggaaaaggguucucccccagggcccccaccugcagccgcugcuccagcuugggugacccauggucaggugaccuugggaaggggacgucggacucaguuaguuuccucuucucggggcagaccugaguggaggguuccacauaagaggggugacuggggguugggggcuuuuguuuugggggugggcagcgugucagccggcggccuccugcccugagcugcgccuggucacugccccacacucuccagggcugacaggggcagguuuaccucacguggcucacuuggcacuuggagucucugggccugaccccuaaccuuggaucgcuuccggcagaauuccggcuguagggcuggcugggccucuuugcucugccccuugccugggcagugaauacuccuuagcaacacccagggcuaagcugcucacuagaggccaggacacaggugaaccggcugggccauuuccccaggagccuuggggcacaggggaggcagccaggugaaaagggguccccugagggcaagagggcaugcaggcaugagugcccacauggggagggggcacacagccugaguacccaggucagggagggggacacaggcaugaaugcccaugugggggaggggcacacagcaugagugcccaugugggggaggggcacacgguaugaguacccaggucgggggaggcauacacaggcaugagugccagguggaaggaggggcacacagagugagugcccaggugggggaggugcacaugguugugagugcccagguguagucucaaggcagcagcuugggcaggaaguggagccaggcaggagggagggucugagggcuucugaaagcauguuuggugaggagaggaggggugggaggcgcugaucagguuucuacacuugggauugcagagguguugacaagaggcaaaggcggaggaggcuggaggagggcggaggccccaaucgguguugggaggacugggucaggccuggcacugccucgagugacaggcagugggaugguggccagcuuagcugcagacgcucuggcgggauggcagaaccgccccagacacagagagcuucucuaccaggaccggcaggauuugcugcguugaaagcuguacuugagcaauguuuagaaacaaacccgggcgacauggguugcagguccuaggaagugcagugcgcuccugcccaggagcaccuuggcuggccaucaguggucuggaugagggggagaugagcggacguggcucggggaugcagguggaggguguucccaggagcagccagugcagaggcccugcggccagaaccagccaucccaacuucccagauugugccaucacucccuccuggaagccuucuuugguuuuuucuuccagacagacagacaggguccuccccaguggagcuccuggcacucacuuccuugucugccgcuagccuugacccugaugucuggcugaaccuuggcuccugagcagaccaggagaaccugaggguugaggaaaaccucuucugggccaggcugggcccacgcagagcagcccuaccccgggaagaagggagucugucccuccuccugccuucugggccuuuccaucccugcaguuucagaaaggccccuccuucaggaagcucucccugauugccacauucacccucuuacuccugaccuggcacucuugugcuugggggguggcguggcagcugacuccucccuuuuccuccuagggacccagaugcgcagccugggggugagcugaugcuggguggcacagacuccaaguauuacaaggguucucuguccuaccugaaugucacccgcaaggccuacuggcagguccaccuggaccagugaguaguggcugcagucggcuccccuggguucugugggcgggggcggugugcggagacccuggaggaccccgguucugcagguggggguugcauguggggaguagugggagcugggcaagaaagagauggggucagaccagcccuccaugccccuccuugccccuccaugcuccccaucaccuccauccccucuauucccucuaucccuccaucccuccauuuccuccaugccucugugacucuccaugacccaccaucccuucuguccaucccuccaugcccuccauccccuccauccccucaucccucugugacucuucaugacccuccaucuccuccaucccuccauccccuccaucccuccaucccuccauccccuccaucccuccaucccuccauccccacaucccucugugacucuccaugacccuccauccccuccaucugucuaucccuccaucccuccaucccuccaugccccuccaucccuucauccccuccauccccuccaucccucuaugccccuccauccccuccaucccuccaugccccucaccaccaccugagggucucccacccccucuaccacucugugucuccucucccacccucuucccuggagggcuuacagccggcugugcuuccaggagcccugaggggaggagagugcagcccagccaggggaggggcucccagggaggggcacugggcccccagggcacacuccagucccggcaggggcuucacgcccugacuccccgcaggguggagguggccagcgggcugacccugugcaaggagggcugugaggccauuguggacacaggcacuucccucauggugggcccgguggaugaggugcgcgagcugcagaaggccaucggggccgugccgcugauucagggcgaggugagcgccgggggcuggggcuggggcuggggcuggcagggggagccccaaggccaccacuaccacccugacacugcugugaccccucuuaguacaugauccccugugagaagguguccacccugcccgcgaucacacugaagcugggaggcaaaggcuacaagcuguccccagaggacuacacgcucaaggugagcgggcaauggggugccgcacgccccaggugagcgggcggugagggggcgcacgcuccaggugagcgggcaacaggugggggggcggguggugcuaggccuggguacugaccaccagggccgucccaggugucgcaggccgggaagacccucugccugagcggcuucaugggcauggacaucccgccacccagcgggccacucuggauccugggcgacgucuucaucggccgcuacuacacuguguuugaccgugacaacaacagggugggcuucgccgaggcugcccgccucuaguucccaaggcguccgcgcgccagcacagaaacagaggagagucccagagcaggaggccccuggcccagcggccccucccacacacacccacacacucgcccgcccacuguccugggcgcccuggaagccggcggcccaagcccgacuugcuguuuuguucugugguuuuccccucccuggguucagaaaugcugccugccugucugucucuccaucuguuugguggggguagagcugauccagagcacagaucuguuucgugcauuggaagaccccacccaagcuuggcagccgagcucguguauccuggggcucccuucaucuccagggaguccccuccccggcccuaccagcgcccgcugggcugagccccuaccccacaccaggccguccucccgggcccucccuuggaaaccugcccugccugagggccccucugcccagcuugggcccagcugggcucugccacccuaccuguucagugucccgggcccguugaggaugaggccgcuagaggccugaggaugagcuggaaggagugagaggggacaaaacccaccuuguuggagccugcaggguggugcugggacugagccagucccaggggcauguauuggccuggaggugggguugggauugggggcuggugccagccuuccucugcagcugaccucuguuguccuccccuugggcggcugagagccccagcugacauggaaauacaguuguuggccuccggccuccccucugugc

SEQ ID NO: 15484 - RNA, 39497 nt, Homo sapiens
cugggggugggggcucagaagccgccccagaaagcacugaaagccacagcacguacacccacuccagggaucugccagcacccuguggggcccagacuacaggcugauggcggaggcuucgagugacccgggugccgaggagcgggaagaguugcugggguaagggucugcggcgacgcccggcgcccugugccguguccacgggugcauaguccuugagcugcauggaggguggagaacugaggugccugauggggaaucuggggcccccaaugggagaacuuggauguccgauggggaaacuggggacccacagacagguggcaggaagucuugcugggaccccccucucacaacaaggguggaggucucuuccgccugccucugugcccuggacucacugggggaggcgcgugggauccuaagcccaugguggaugccugaagcgaggagaccccaagacguguccuggacugccagggaggagcuggggacugugggcccuguuagcuugggaagaggcaaggugggggcuggggagcagcuguucugggauggguggaacuggcccgggccuggccaccugcccacaggacuaucugagaggggcuauccugccuugagggucuggaggccgccaggcuuggggcccagcaggccucagggcagggcacccaaagcugcccuugaccugcgguaaaggacaaggccaaggauucuggcaggugccugugcugggugccaggcaccguguguugguuggaguggggacaugagggggcauggcagagguuguguguaggacugccagagcugggcagaaaaaccccgcugccaaaggccuccuagcgggcagcuguacucugugguaccaaugggcauccagcccugugcugggguggguggagagggcuagcggcuuaguaacugggcucccuggcagaggggagcugccggccagcaggcauccaggcaucacagcugagccucgccaggggaacccgaguugcccccggugcaggucccagaagagaugggagggcucagggcgugcggugcagggacagguagggcuuugaggggcagaggggcgacgugcuaauggucaggggauggggauccggugcuggggauagaggccggccuaggagcaggucagcgggggcuguggccuggugugcggaagggaaggcgcuggggcccagguugcagaaagagugugaugcccgcagccacacaggacggaccugagaggaggcccagggugacgcucacauaccccaaaacugcagccagggcugcuaccagucucugccuuggugcugacagcagagggucccggucuacccgacccggggcggugcagggaccaccucccggccuucacacaaagcuccugugcuguugguggcugcagucacuguccugugucuguguccuugguggccgucacauugcugugggucugguaugugugaggggucugcaucucugacuucuugcugccaaaucccacuuggguacaggugcggggggccacugaagggaccccgagugccgugaguggaguggaggcuaagcagaggccggggcuggcugagggcugggucgggacguccgugccuguccccagggagaggugggaggaugcccugcccaggccgugugcagggagacaggcuucugggugcacaacagcugugucccagcugcaaaacgggcccuccugucagcaccacccccagcccuggacuaggugcugcuccuggucaccucaugcccauagaagggcaggacaugagccucugggcuggggcacccccgccuuccuccuuggccucauccuuggccacccccucccagcugucucaaaugcccuggaucccccgggccaggagcggggaggggggguuggagcgggcauggccaaggcacagaugauccuggggcaucuuggugcagauccugggaggccagggcugcaccugugccggggcugucaggcgcuccagcuggagagcggcgguucuccugggcucugcaaagccuggacccccuccuuggacauccccugcccccgcgaauugcauggggugcgcagccaagccugaccuuucagaaugaaacugagagccccagugggguaggcuucucauuucacaaggugacuaagggaaccggggaguuuccugucuaggaugggacagaaguccccugcacccaggcagggauguauggccugggaagcccccacacgggaguccccaggaaggcccaggcugggcaggcucagcuggggcuggagcaguggacaagacagccccccgugcaugucacagagugccagguacgccagccugugacggucucaggacaugcccucaacacuagguccagggcaggccaagccccuccagcuggacaaguggguccagccccucagacugucgcaugauguggccccuccccucagacugcccgggacggggccagauuccucagaaccaccccuccaugauguggucucucagaugcccccaggacaggacuguccucucccacgaggccucaggccaaagaagguccccugacccugggcgggguccaggcuccgcuucggcuaccagccaggcuggacugcgguuccuccacucgggggcacuccugucucgccccgcuguccagcagacagucacuagcuuguccuugucccuugggggcagggacgaggauuucacagagcugccuuguggcucuggggggacucucuggugacgcugggggaugccugcccucuauagcccccaagagcaaggcucuccccacacugaggaacuaucuggccuuggaggccuugaggcgaugaggacggggcguccugguccacagcuggggagggucagguugcccucucagaccuuggguucgacauauccagauguuggagcccagcucugcagggguguacccucccuggggucacacugcauuuuuggcugcagugccuguccuuggcccagcugcccgggggugcccacccgcccaggcgugcccaccccauguccacaccuagaaggcaagucugccugccgccacccugucccacagacacccuggcugcccucucagucugccccuguguagcccaggcccccaucaggaugacccuacccccagucuguuccccaugagcgaccaggccgugucucccacggaaagaaccauucaccagcuacaggcaaacuccaugccccuggguggccaugccaggcccuccuggccugguugaacucacuucccaucccaccagcuuucccagcucuucccaguuuuggaaggugucagagcccuggcacaugccccuccuagcaucacccaaccgcccugcuccucugcagaccuucaaaggccugcccagcccgcggugggaggccgcugcccagggcucuggcagcaccugccauggacagggccaguccuggagccccgccuggcccaucggagccucccucgcuucucugugugcugagcugaguugggaagggcagggaugaccugaggggcugcucuggcaggguuccuucuggccaucugucccuggagacccucagagcuccagauucugaaggaggaaggggcuggaggcccccggcagcccccuggaagucuucaucugagcagcaggagcccaugggauggaaccccccaggcagccaggcccuugggcagcccucccgcccaccugcccuccgagccaaggccaggcaccaccuggaggaugugcaaugcuccacgcuggggcagguggcccugagagcccccagcggugcccacgacugcucaggaaagagggcagagcuggggacaguuggggaagccaccucagccccagcccuagccccacaggggcugcugagggagguuaggauugagggcuaagcccuggggcucccucccuacaccuuccuguggucaagaccugaugucuggacccaggaucccuggggagguccccuuccuccugcccuggguaaggggucugaggcaucuggaaguuucccagggaagcagaaggaugucuucuuccucgugggcuggcaggcgcugcuguccaccgacacccagcugggcuggucgcacaagugggagcaucacaggccccacccccgcugauucuggaagccagaauccuuucuuccugcgcccccuuccugguucccucgugucuccuaaaacaauccuggagccacacaagggcagugccaggagggucugggguccagcugggacaggcccuggccggugacacccugggguggcaggauggugggccucugcuccgcuacccuacgggccagccugucuccaccucaguucccugagaacgugccagagggaugggugagcccuagagaagaggaggguguuggcaguggaaagggcccaguggucucccgcucugaguccucagccuggugaggggugggggcgugagcucugccuugcagucccagccccugagaucccacugcuggggcggcgggagggggaugggcugcaaggccccagggcuggccuugcuucggcugcuauaggcccucggagugcuuucuggaugaguaagccgcaccccucugaagccucaguuuccccaucugcacacucagaauguagccacucagaccaagcguucacuccaugccagucuuugccaagcuauuuauuuauuuauuugagacagagucucgcucuguugcccagacuguagugcagugacacaaucucggcucacuggaaccuccgcccuccagguucaagagauucucccaccucagccuccugaguagcugggauuacaggcaccugccacugcccccggcuaauuuuuguauuuuuaguagagaagaggcuuucaccauguuggccaggcuggucuugaacuccugaccucaggugauccacccgccccagccucccaaaguccugggauuacaagcaugaaccaccgcgcccugccuuugccaagcuuuuuaaaccaaggcucuuguuucaucccccggagcugugaggcaggucccuggagccucccauuucacagacggaaaccgaggcucacaggggccaagugcauuguccaagggcugcucccugccuggggaggggccugaguccuugccccugugggguucgggugcugagggcccacaagaccugcgggcaccaggagggagcugggcugggcugcccuucccggggucucucugaccccacaccacacaccagccacucuggacucaaaggcucccaagagcaccagagcacugcucauggcccaagcucagcaagcacuuaaagggaccgucccgaaaagcggaacugggaccgggcgcugcaggaccagcaagguccuccacuucccuccagcccagccccgcccaaaucccagcccucagcaucuuuuugggggccacuaaagaccuucugggagauggcagcccaggaccauaaggcaaucgaagagggcuuuccacaugcgcugaggcagacagaaccaggcccuggcuguggacgaggcuguauugauacuuagaagagagggaagcgagcgggcuggagaggcucggccagggggcagcccagcagggccccuuccccaggguuagacucucuacagccggcccagcccccauccccuccccaacaucuagggaccugaaaagagguuggaggggcugcaugggggugggguugauaggagauuaggggauugagaaagccaggccuccuagccgugucccacccagcacggccccaccagugccagacacaggcagacaagggaggagggagaugcugagcagggguggcaggaggaaagccccuggcccuuucuuggggccaggcaaguccuauccuaacuccaucugcuaacugccuccaagcugcuuguggguugucggggaagggaguuuguggcagggagggccucugaguccccuguaucccccggcaggaggaggcaggcacaugggccccugaccucagugcuuggagcagggccgcucugguggggcauuuguaggucacagcaugaaggguuccagcauacuuccuggguucccaguuucccugggagcagugguauagacgcaggggccucuacacacaccacacgcucagggagaguggcugagguguccaggauacucuguccacuggggcaggggguggcuucuaagcccaguacccuucccagaguccccagucuccagcugcucaugggcugcagaugaggauucaagguuaugcaggggucacucuccugcuccaucccuggcaggugggaccucaccuacugcuucuuucugcuccagagaagagcacgucccccucaucucaaaagugccugugcuccuccuuccugaguggaaccuacacuuuugacaguuugguuucugaggcaaggcugccuccuccuccugucccagguaccuccccucagaaaagcaaugggacuugggauagaaggaucuagccaauucguuccagaugaaucuagaaauaauccuuuagccuuucucuuagacccagucccaaccaaaaucugagcuucaucaccaccacccagcacccaccauucaccacccagccuccagcccccagcccccagcccccagcccccagcacccaugacccaccacccugcccccuacccguggcucuggcccauucuccugcugucagcagugccugcuugaacagagggccacacugaacagaugcaugcugcaagcauuuggaggcugccuccucuuuaaaucacagacauuuauccaccagggaucacucgggagccaaugaggccaccacccugaccuccccuguccccaugggcucucucagugcucaaagcaccuuucacugggaugcugcucugugaacauacauucgcagguaugugucggggaugaugagaaugugucaauaugaagacagaucccugccccuguagccccugcuuaggcucuauugagguguucagccuccugggccaugguggucugcuuuauccuugggccaugagcuuaugaaccaugucuuaguugcauaagaaaggaaaaauaaagauuagaaaagaaucaauuauggagaacaguaugaaugaauggaaagaugaaugaagaaugauaggaaguaggaacaaauggauggauggauggauggauaauugaaugauggauggauggauaauugaaugauggauggauggguggauggauggagggaugaguggauggauaggugcauggaucgauggacaggugggugaauggaugggcagauggaugggguggaugaaugaauggguuggauggacucauguauaaauagaguauaacucaugcauaaauagaaagaauuauuuaguaauugaugaauggaugaacaaaugagcagaugaacaaaaaauagauggauggacagaagaacaucuguauguauauauggauguuuggaugaaagaacgaauggauggguggauagauaaaugcagaugugauauuuagaauauuuaacaaagcaugugguacaaauaugaaucuacuggaaugggugcugauuauauauauuccuauauugaacuguguuguaccugugcauauuggcugaucaucagcccaacagcuaaaugagcaaauguaccaaaacaaaagaugaguggauuuauggaugaauggaugauggaugaauggguguauaaauggguaaaugaauguauugauggaaggacacaugagauggaauuauguauggguggaugauuggauggcuggaauauggacauauaaaugauuggaaagauuaauagaaggaugucaggagaaguagacauauggauggauauggauaauagaugaauagauggauacguggguggauauaacaagagaugaguagaaagauagauagauaaugaaucaauagacaauugaauccgugcugaguaaacuauuagaaagacggaugugugaguagacacuacuaaaucaggaauuuugcacucucuuccaggaacacuuccucccauuucucucaucucuuuucaaauaagaaaagaauuacuucuuuccaugaggcuuucauauauaaagacccaaggaaagaauuacuuauuuccaugaggcuaucauacguaaaauaucaauccccuccagaacuccauaugccuuuacccugauuuauauuuucugucauauuuuccaucaucugaccuuuauuuauuuauguguuuguucccacacuugaaacaugaucaucauaagagcagggacuuuguuaaugcugaauccccagcaccuucaaagugucugaauucaguacagauuuauugaauaaauauauggaaggauggagagacagauggauagacagauggaugaaugaauggauggauggauagauggguggauggauggauggguggauggauagaugcauggaugaauggauggauagauggauaauggauagauaaauagaugaaugguuggauggauggaugaauggauggguaaauggauggauggauaggugaauagauggauaagugaauggauggauggauggauagauggguggauggguggauggguggguggauggauggauggauggauggauggauggauggauggauggauugguggaugaguggaugaguggauggguggauggauggauggguggauggauagauggauggaugaauagauggaugggugaauggauggauggauggauggauugaugaguggauggauggauggguggauggauagauggaugaauagauggaugggugaacggauggauggauggauggauggauggauugaugaguggauggauggguggauggauagauggauggaugaauagauggaugggugaauggauggguggauggauggaugaguggauggauggauggaugaauggauggaugaauggauggaugaguggauggguggauggacggaugcauggaugaguggauaaauggauggaugaauagauggguggguggauggguaaaauggauggaugaacugauggaugaauggagagauggacagagagauggauggaugaguagauggauggaugagugggugaauggaugagcgcacacauaacaguggaguugacaucaaauacucucccauauugucccucacaggacaugcucuaguuguaaaaccaugaaucuuggccgcuacauguaaauaucuguucuugucacuucccauccaucagcauuucugacagaugaucauucucuagugacagggaaguccugccauuccaagguagcucuuuucccugugggaauauucuuccuucuuuugaacuaaaauaugccuuggccacauuucauuccuggcugucuguggcugggacuccuccagaaguuaaaacaggaggcaaggaggaaauaggcagguugaggugcaaaugaagcacaugcucacugccccccaccccagguaaucucaccuuaccugggugaucuguccucccugagugaucucaguuucucugugugaucuucccuaccccugguaaucucaccuccccugagugauuuagcuuucccugggugaucucaccuccccugggugaccucaccuccccugggugaccuuaccuccccuagguaaucucgccuccccugggugaucucaccuccccugggugaucucaccucccccagguaaucuugccuccucugggugaccuccccuccccugggugagcucacuaaacauuuguccaaccugagguccagcccuggcuaccaucccuccugcuuacuccagaauccuguggucucugcagcuuuguggaugcuggggauguggggccaacaccauggucucuaguggacauucccugcuuccuccuggguugugccgggggaggggagaugcugugggcuccucucuccaggacuggcccugggacccagucugguguguauguagggaguggggacggacuuccugacucccgcagucuccaugggguagcccaccaccugagucaccacagcccggucuauggucccauguggaauuuuccgacuguugccgccacccccggcgugcugcccuccgcggugauucacccgcuugcccgucugcucacagccucacccuugcuucccucaguguucccaaggugcugcgcaaccccaacucccuggccuggccagggucaugauagcuggggaggcaagagguggcuguucuccuugaauguagggacagaggguggcaugggcagaugagugcccgugcacagaugguggcccaggacuaauuggguggccagcggccggcagaucuggcucugguucuggcugugccaggcccucacucugugaccuuggaugccagugcugcuggcuggaccuugguuucuccauccuggacauggguacauggugguucugagugccagcgagcugggcaaaccgccggaugugagacugccgucgcggagcugacccucggugagcccugaacaugcgucccaucccaccccucguccguccggccacuagccccgaguguucuccagugagucacagcagccaagcccaaccagaggaacagagggcugggcugcuccucccugggccagggccagaggacgcgggcaaggggggccuggcuggcgagggcaccaggcccacuuugugcccacuggccaccucuugggaccaugcugugccaauaccaaaccgaagaugcugcguugguggcgucucugccucuugggucaacucugcagucuggcugggggguugggcccaccaggaaaggcagcagccuccccauuuggggaacagagaggguucuuggggugccaagccuucucuggaggugacaacaagagcagaggccgggaaugaacaaagggaaaguggagaaccaggagcgggggagaggggaggaggggagaggaagggaggggaggggaagggagggaggagggaaggagggagggagacagagauagggacagagacaccagagggaaaggagagaggagagaggggcugagugcgagacggggaaggaggggacgggacaaagaggaaccagcgaaggguccaggccugcgaugauggugagggagguggcagguugacgaggggcuggacaagaacggccgacgaaggagaagaacagaggagggcccgggcagggccuggcagagggcaugaggcacuccgaggugggaggcggcgaugggcagaauaggccccugugccuggggcaggggcaccacagagggcuaggggagaccgagaagcgggcagcggcuaccaagguggccugagggcagaggcggagggaggaagggaaagaggaagggagggagggagggaaggaggcagccacgcugcccaucagcgcgccacagaggucuggcugagccccacgcugcugggcugggagaguuuucgcucugacauuuuuacucuucucggaaggaggaggagguggagguggaagagauggaggcgggaggagaagggggcugggggaaacaaaagagaagcagcugcugagaguccugaaguaggagaggggaaagggagacccacagucagggagacccacagggauggggacacagggaccaggcugccugcagggagccggccugcagacccucgugccaggagccgaagggagggaccaggcugcccacagaccccugugccaggugccagagggagggaccaggcugcccaagggagccggcccacagacuccugugccaggggccagaggggccaagacaggcaggcagagggucacagggacaaggagaacaccagacagagagaagggacaggggaggggugacagccagcgagagaccgagggccagggcagagcgccaaggaagugcaggagugagaggggccaggagaggcaggaaagccaaggagagcugggcacaggggggcaggggugcgggaggagggcagcagagaggagggccagcaggacaggagccuuugagaugcugcucuauccccggggcuggggucaggccaggucgccgccugagcagaggcugcagccugggcagucccgggcuucugaggaggaacucuagcagacagggccuggauaccucuugagguaggucccuccugcccuggcugggcauggagggcagggcagggugcccaugcugggcugccacaugcaccgggccacugggccuccccccagcuucgguaggcucugcugccccaagcgugggcagcgagagggugccaggcugguugcguguacaugugugagugcggaggcugcuugaggccucucuuccuccuggcuccuggcagcugcccaugcauucuccuuccccaucccaccugcacugccggcugcgcugucgccugcucacaccgucccacccgcaccgccggcugcacugucacccgcucacaccgucccaccugcaccgccggcugcacugucacccauucacaccaucccaccugcaccaccgacugcacugucacccgcucacgccgucccaccugcaccgccggcugcacugucaccugcucacaccucuccccgagccccagggauucugcuugacucugagcccccaaaaugaagggcccauccucuggguggcuucuggggccucccgugggguccuucggauccugggcacccuucagucacccucacuucacagaucaugaaacugaacuuugggcugagcuuaccggcccuggcugcagccaccaacccugagugggaggcuccucagggccagggaaggugcccgggccuuguccaccugcagguguugggccaguguggugcccucucccagccuguuucuuccucuguaaaguagugguguggcccuucauggggucaggugggagagcagaguuuggagggcccaaggcuccucaagacccagccugggcagucucagagauaucccucugcaccgucagccacucugagccgccuguagugcccuuucuccuccucaacccuuccaggcuuuuaagccaaacugaaacaccaccuccugcuugaaggcugccuugcuucuuccuaaccuggagggcuguccugcucugacuuccuuugauggcauggagcaugcuggccggaccucgagcuacuggaaggcagggcuggcaucggucggcuugccacugcccacccaggccaggcacucagugcugagacucugagaggccagagagccagggaugcccaugggggugagcuaaguggggucugaggaguugagggcagcccggcucaccccuccuccccagcucccacuuguuggguccgugcagaugcagagagauggcuccgaucugguccccaccuggcagggucuccggcugucaccugaguucaggaccagcaccaggaucugcagugggccccuggcugggcacaccucaucccagccucccccuaccccuggccccccauaagccuccuccuccugggcuuccaggcucugcuggucagaccucccucccugcccaacgggaauguguuuucccaggggacgcugcuguccaccaggagcucuguggccugggauuugaggagugccuggggucaaucccccaggcucaccagugcuacuuaacaaaugggcccaagagaaggaagugcagcccccggaggaggggcagagccccugccuggcugugcgguggcucacccccuugucaccaggggcucggccaugagcauccguccagcgggcccagcaccaacugcagccccaggugagcaagccgcacucaggaggcacugaaaccgugugggcccaggcucggggccagucccuguggaccuggggaggagacacugaagccgcgugggcccaggcucagggccagucccuguggaccuggggaggaggcacugaagccgcgugggcucaggcucggggccagucccuguggaccuggggaggagacagugaggaggggaccucacuugcgguggucagccaguggguugguggcauaaggacccgucccuuugaacucccuuggaacuuguccugaugggggcugggcagagggcagcaagagucccuuguccagcuaaggggagccaccaaggugagcuacaugaagcaaggcugacacgugugcacuaauacacacccccuccaggacacagacccagaggccgcugcaccccacccacccaccacacccacacacacacaugcacacacacacgaccacccgggacaguacugcgcucaccaccacugccaugaucucuucucugcagccuccaacagcucggacuuccccagucccagcccugcaggccaggcagacugcccccuacccacucccuguuggauaaaggagugagccaggcucagagaagcugugggugaagagacuucaaggccacucagccgggcaugaugagcccgggucccugggucccuccuccacccgcaucaccccaccccuuucccggggaccccuuggguguccugccaugucaggugcagggcugggagaggcauugcaggcaaagugcuguguccucagugaugaacccugaagggccaugcuaggugcccgcagcugccagggaauaaauucaaugcaguuuacauccauuaaaaauggugcucugggccagugggaaaacguguccccccugccccgucgccccccaccccugccccagcgauucuccuugucuacacccagugcaagcccaggggcucugcauguagucccauaacaccauuuucuccaggucuggcuguacccagccccugccagaaugcggcuucuggcuggcagggucaggcccugggcugaccuacccccaaugccucccugccaagucugcccuuccaggcaccugggagucugcccugugccuccugccugccccugggcaacucggggcucucccagggccagcucgggcaaggcaaguguuagggauggucaggggaccucaagaggacuucagcccacucaacuccagacgucacccggacucagccagcggccuggcccugcuaccugugggguccuggcuuugugagagggcaccaggccggcugagagugccuuguagccuggcccggagugaagaggggggcuggggaucagccuggcagacguucuuaucaagcauugagguccccggagccccgugcccacccuuagccauggcucuuugggcggugugagccccuccauucccuccaucucgggcacacaucugcccacacauauacagauguggcagccacaccgugcuuggcucuccgcagggcucuaaggccccucaggcagggacccacccugagcagccugguccagggaccucuggggcuccugauguggccaguggggcaggaaugggcuggcagccugcugggcuggcccugagggggcugggggaagccaggccuccaaccacaguguccaaaaggguguggcugccuugggcccauccaggccugagauccugagggugggguagcccccgcccuggcagggcuggaagucggucuucggacagagcccguccugcccagaagcccaggcgagccagcagcaggggugcagggaccgaguggcccagcccccugggcagggugucagggccagagcccagaggacggcgguucaggcuucagucccagccggcgaaccagagcugggcagagcggccagcaagcggcagccagggugcccugggcacucgacccccagaugccccugcuggaaccguaaaggggaggcacccugaggccagagggagcauggccccggggacugagcauccggcucagagcggcuuggcagaggucgguggacugggguuaaccacagaggucucuggagggcagacaggagccacugcaagugggagcuugugggagagaagcccuugggugaccccuggauggggcggggaccauuagggagaagggugaggggcuuggccccugccccaggcuccaagugggcugagacccgggaggcuugagggucggcugcuacccaugacggguuggggagguauuggugcgagcugagguggugcuugcggaggugagauugagggccgggccuggccagggaugcugggaggggggcaacccugugccuggggcugugagggucucuugacgagaacaaacccuaccuggggagaagugacagagaaaagaaagaaagaaagcgaaggcacgagaaagaaaugagagaaagggagggaaaaaugcugagagggagggagagcaggggcugccuugaaggaggagggagggggagcagaagcgggugcagggugguggcaggaugggaagggcagagggaggggcugaggugcgaauggaagcugugugagggucccgggcacugccccuugccgccgaccccaggugugggaggaggggucucucccacgugggccgcaccuagcaggugccggggcagaaggcucagagccgcugucucacacagcuucuuggugcuccaaagacgggcgguaggaggaagaucaaagaagcgagaaauggaugcuggaggaacgcagugaggccaggcgagggcuggcgagcuugccaaggagagggcgggcgaggaaaauggggcgccccacagaggagggggcguggggggggcugguuuuccccgagacugagaaaugaauuucugcacccggacugggacccccugggucaggacccuccacucacauucaggagcagcaccucuucuggccucugucccugccuggucuuccccacacccgguucuuggggguugagggguuggagccccagccacgucaucagcucccugggaccccugcgugagacgugagaggugcaccuccgagccuccguuugugcaucuguaauggggaugauaggacugcgccccuggcgaccauugugaggacggaggcgcuggcugcacuggugcucacugugccucuuuaaacggggaugucuggaccucuggugcagaggaccaaggccgguccacuugaccucagccaugaggacaucccaaggccaugugagucucccacggcccacugaagcugguccuucauaccccauuuugcaaacaggaaagcugaggcucagggaggcaccaaagcuuacucccauccuggggcuuggcagggggugcccgcagcacccggggacauacaccggggagucuccugggaaagaagugccggcccaggggcagacucuuuucugcucugccaugucuucccugcacccccagggaugaugagucugggaggggcuggucagccaugaaagcuucggggaggggccgguggccaggccgggcaccccagagcuccacaggcagacauggugugggggugucaggaagagggccuggcugcugggugcuacgguaggaagaucccggugcugugggaguggagcaggugguugaaugccaggcuggcuugguccuucucucugggugccggcuguggcucccgcccaggugggcaccacgucugaauaauguaugaagccucugguugcguggaggaugggagcgcuucgggcagcaucugugggcagagacuucagggaugugagguacaucugggcauggcuagcugggaaggaaagaggauggcagagccucgagccguugccagggacugguugcgugucccagaacgugccaaaagccugccucgugagcacggcaagagcucugccagggcagucccagcuggcccaggcgccgcagcgcucccgagggccgucgagcaaaggcgggaggcgcagccgggcugucgguggaccuguagguaucagggcuccuugguccccuccugcgggaagcaggcaccgaguggggcugcauguagacgcaugcgagggugagagcugcggcggaggacgcugaucgcggagugcaggcgagggccccagaaaggucccgcaggucgccucgcucguggcacgggcucggcagcguugugguuagugacacggaggaagacagaaagccauaugcacagcacgcagaacaggaggaggggggaagaaagagcaggcacggggcaggcagagccgcagccacgccgccgggaugcagcaggcagggccacccacgagcagggcggggcccuaaccuccgacccaggcuggucgccgcagaugggggcagagaugugaaacagcugcagagcgggacaagggugcugccggcacagggcugaccacagagcacaucaaaagagguagggcacccagcgcaagggaggugaugggcuggucagcaggacaucaagccgguucuggacccugcucugaggacggucccugacccagccucugaggaccaaugggaagccagggguagagggguugggggaaaccaggcuccauuuuccagucucagcagggggccaaggcuugcggcucugcggaggccacaccaugagguuuccagggucauagaugcccuuuggucagcgcugucugccgcugcacgggcaccccuccuguugggugucuggguagacuugggggucuguccggcuggcgugggcaccuuugggagggggguguguguggcgggcaggccugggcuguagucaccccagcccgugcugguagaguuggggucuguccggcuggcgugggcacuuuugggacgggguguguguggcaggcaggccugggcuguagucacccuggcgcacgcugguagaguuggggucugucuggcuggcgugggcacuuuugggaggggggguguguggcgggcaggccugggcuguagucacccuggcgcacgcugguagaguuggggucugucuggcugguguuggcaccuuugggacgggguguguguggcaggcaggccugggcuauagucacccuggugcacgcugguagaguuggggucugucuggcuggcgugggcacuuuugggaggggguguguguggcgggcaggccugggcugcagucacccuggugcaugcugguagaguuggggucuguccggcuggcgugggcaccuuugggacgggguguguguggugggcaggccugggcuguagucacccuggcacacgcugguagaguuggggucuguccggcuggcgugggcaccuuugggacggggucucuguggugggcaggccugggcuguagucaccccagcccaugcugguagaguuggggucugucuggcuggcgugggcaccuuugggacgggguguguguggcgggcaggccugggcugcagucauccuggugcgugcugguagaguuggggucuguccgcuggcgugggcaccuuugggaugggguguguguggugggcaggccugggcuguagucacccuggugcacgcugguagaguuggggucugucuggcuggcgugggcacuuuugggaggggguguguguggcaggcaggccugggcugcagucaccccggugcacgcugguagaguuggggucugucuggcuggcgugggcaccuuugggaggggguguguguggcgggcagaccugggcuguagucacccuggccugcgcugguagaguuggggucuguccggcuggcgugggcaccuuugggacgggguguguguggcgggcaugccugggcugcagucaccccggcccgcacucagacuaguccuggcaucaccacucuggggcgaaguugaugcaggagcucagggcccucaugcagcacugggugggucaugaagcucagggggcuucagcaauggaggaggcgacccuaucccaucccaaguuggacagcagucccagcggugggggguggggguauagggggaagcagguucggauuggguggguaaggaacccagaggaacagaccccucccugugcaccucuccccagagguggaggcagggagagauggaggcagggagagguggaggcagggggcagagacaagccucaggucaucaagaguugagggcuggcaucugggauacagggaggauggggagaggggagggcugugcggguggggggcggcucugucuccccuuggcugugccucccuggggaccgcuaggcauacgcacggccacugcaccccuuccucccugccaggacccugcccacugcggcgaccccgaggcucagagcaggcacaggagccccuccuuugagagacuuccugccagcuccccucugugcuucuugauccacaucaugggucagcgcugguuucuuggcaacugcuaagauuuguaagggcagggaggagaucucacuccuccgucuuugggucccuagcaccugacaaaauaaacugcuggcuaaggaaagauggagggagggagggagggagggaggaaggaggggaggaaaggagggaaggauagagggaggagggaagaaggaagagggaggaagaagggaggauggagaagggaggaagggaaggagggaaggagaaggagaagaauggaaggaggagggaggagggaggaacuggaccgaggcuauggcuauggaagaaucaugcccugggccaucccaggcaggcugagaagaaaaagcuggaaccaagucugggcuagucuggugguuguggggcaggaaguagccaucaggguggcaaccagaagagcagggagcccagcagaggagggaggccggcagaggagggaggccggcagaggagggaggcuggcagaggagggaggcuggcagagcagggagcccggcagaggagggaggccggcggaggagggaggccggcagaggagggaggccggcagagcagggagcccggcggaggagggaggccggcggaggagggaggcuggcagagcagggaggccggcagaggagggaggccggcagaggagggaggcuggcagagcagggaggccggcagaggagggaggccggcagagcagggaggccggcagaggagggaggcuggggacagugggggcaggccggggacagugggggcaggccggggacagugggagcagugucggggacagugggggcaggcuggggacagugggggcaguguuggggacagugagggcaggccggggacagugggggcaggcuggggacagugggggcaggccggggacgggggggcaguguuggggacagugagggcaggccggggacagugggggcaggcuggggacagugggggcagugucggggugaggaucuggucucccgacaccccuucccgggagcgagaccucaggcccagucuucacuccccagcugugaaaugggugagaacagaggguggcugagacucagggcuguucaggguggggugggcucuggacccagcaggcccggcacccaggccagggcuccaggggaggccagguggggcgaaggccaagaaggggccggggcuggucagaaagggcuccuggugaccagagcacuuugccugagccagcgugggagggaggugggcuggaugagccagggaggcgccgggaggggccuuggcagaggcgacucccuccggcagcccccaggccacugaacccuggguagugagaaccggcaggggaggcugcagacggaggaguggaggcuccuuggcuuugggggcucugaguagaagcaccuagggggucccucaagagguccccaaaugcugccccauggugaggaaacaaggagaggcccggcagggccccccuugguuacaaagggcugccacugugagaaggcaacacugccggcuggggcugggcuuucuaccucaccaagccucuucccacccaaagggcccagagaggggcagcugccccccacagcgggcacagcaccuccucccugugugaugggguggggcccacagucuccuuucucgcggccucccugggcugacccugggucccagcucggccaugggggcuucggcauguaaagcccauggggggcagagccuccggccccugccagcuucuggcugucugugucgcccccagcacugggcuggugccguggagggaggcuccgcccucccccccaucaacccgcugaggaguucugucuucccaggguugugagggaagccagcucugcaggccgauguccaaguccaggcgcugccuccuccagggagccuuccagaccugaucugugcagcagaggcccagaaggaccuggguguggggauccuaacaggaggcgggggacccagcgcgugcagagagggucccagugcuuccuccugagugagggucacccauccggcuccagcugcacagagccacucccucugagcaauccugcucucugccuuccugcauuagcucuugccugcacccaguccagcaaaucccugcucaucuuucagacccaaguucaaggccuccuccugcuccgggcggcucaucacucggccuccccaggcagagaggcuaggguccugcucacugcggcgucucccuugcccacuggcgugggacuacaaggaaagggguugacccccacccuccccugccaugcccagcagggugcagccacaaccgggaaggugcuagaggccccgggggggaggcugggccagcaccaggcguuggggggcagguucccgucucuacgcccgagccccaggcggacggcgcaugccccucccgcugccccaccugucacccaccugcuggccccgggcugucucugcuccuggcuccccucccagcugcguccccagcugccucuccagggaggagugacagcuggccugugccacacccucgagccccucccuggacugcccccucccuggggcaggaccccugcguguggcacaaccaaggggccugcugaugggggcucaugugagcagugccccagcugugggugugggugcugccagcugccaccgccuuugcccuggcuucccagauaggccccgacacacacuccgaagcuguaucaugaacgcuguggugggcggcuggcggggagcgggguugcugucccacuacccucuggaagccucagccacggagggccccugugggcaccuuuucccggcacacggugcugugucucuccacucuugggcucugcagugacuugaggggucaagucuaggaccccaggggaggcugggcucaugaggggaccagagaccucagugcugugcagggagccccgaaccacccugguggaaggcccagcccagcuccccaggccuccugccagcucccugugguguccaagggaccuguggucaggccuggaggagaagcucccccuccccucgacauccuccccgcagcccuugcucuucaccagagccuccucacuccccaggaccccagagaggacggacccucuccagccgcccucugggcucaggacagccggguggggcagccacaggagcugccugcagggggcagagucgggacggggaccgagccggacacccauucugcaagugucugcagggggaggacggagguggguagcugggagugcugggccgaggaugggcauugucaggcccucagcggggacugggagguagaaguggggguggggguuuguggaggaaggagaagaagggccagcgucccgagucggggggugcuuggcaguggaugaggccggcaggaacagaccugagcuuggggagcuccacuccgaacgaggcauccgucagaguucugugcauacuggugucccuggcugggggccaggccccgaaguggagccugggacugugagggugcgggggugugcuggggugggagguggauggagcccccccaccgccuggccccuugggcugaaccuugggcuucggagccagaacagacacaggaaaucgccuaauugcauuugugcaggaacaccaaaucccucgcagcugcacggggcugagccagggccacgggcggggucggccaucccagaguccugacagcuccguggugcaugccaaggggccugggccgcuggccggggggcgccuuucccaggccagaggcccccaccccaccccaggagagcugccccccuuucaguucccagaacggagcccagcuguggaauagugagggggugaggucauggggagggggcccgcaugacucauauccugggguaggggaaagggaggagacguagaaggggcccagaggccuccacguccucaggcugcugggucagaggccaggggcuggccgggcuucuccccagcacuggguuuuaggggagacaccaggagaugcuuacucugcauccccuacucugucccccaggccccuagccagggagagcucagucggagugauccuccaggggcccagcucugcagggacgauguucccagaguacacaccugggccucgugccagggccggcaccgccguugucggggcaauggcaaggcaaacagucaacguuugccucacuaaagugaggcugcggcacccugaagggaucccuggagggggacgugguccccuuguucccaagccugucugcacacgcacguggaugucaaagguucccgugugugagcacgugcauacuuguaugugcauggggugcgggcauguaugccuguguggcuggagcgugggcucguggagaacgugugugaguugggugugcaccugcgugugccccaggccuagggaguccugcgcccggccgcacuccauguguugggcaugagcugugagcagagugagggccuuuguggggcuguuggggcccggacugcuugcccauagggguggaccugaggaaacgugugcacacgagcuucuggggucucugcgccaauguguacuuccaagccccgccuccccuauggcuugguggagggggucuguggagcuggagugagggcccuggacccaucggaagcccagguccaaggaggagcaugggcucccucucaugccccaggcccagggacacacaccccagcuaagcccuugcucacauggaggggcugggacaugggaacacggggagcaauauggccaggcuuccccuccauggaaccccuccaccuccucaacacucugccccagccugcgccgcccucuguguggaggggcuggggcgugagugagcacgagggccccugcgccccaggcucugccuccucagguggaacaaggcccagcagcccccagccaugcggaggccggcagaagcgggaagcugggccucaucugcccggaugaugggagccagguguggggaauuaaguggcuuccucgggggccgggaguugaaggcacuucugaggagcaggacaggcaggcggauucgggggcgcggggggcggggugcacaggcggcuggguuugcguggcuggaguccccuguggcuucgguggggggagugggccuugaacucgggccuguggaagggccuggcuuuugucugagaggcuuaggggagaccuaggagagauuagaucacgcgcuggcagggcugucuggccaggggacuggggcccaguggggaucaggcugcagggucaggcagcggccacuggccgggaagaacugagaccccaguggggagaccccagcccugcucccuguucuggccugggcucccucccugggucugggauaauaagcccuguaggaguguagagacccuggacccccucucaggcucuaggagggcgaugggaggcagggccaugacagcugaggcugcggugucugcaggaccuggaccaucugagagcugcugggccggggcucugaugcccagguccaggccagccugugccuaccucugucccugaggggggcgcgugggaccccaagaagccaugguuucaggcucugagggcagaagcacucccuuaccucaguuuccccauuuuugaaauggcucaaucggcugggugcgguggcucaucccuguaaucccaccaccuugggaggcugaggcgggcggaucaccugaggucgggaguucaggaccagccugaccaacauggagaaacccugucucuacuaaaaaauacaaaauuagccggguaugguggugcaugccuguaaucccagcuacucaggaggcugaggcaggagaaucgcuugaacccaggaggcggagguuguggugagcccagaucacaccauugcacuccagccugggcaacaagagugaaacuccgucucaaacaaacaaacaaaagaaacagcucagagagacuccgcagagggcucugaaauaaggauggggugggguugggugagccgacccuguaaggugcccccagcuaugggguuaggcccaggcaggacccaugagucugcggagcuucugugagcggggcugguggugggacaggagguguccugccuggacgugcucaggcccuccuuuccucagccuucgaccuccccuuucuccaacacgcccugccuuuggggugcaggagggagcacccgcaggugggguggaggugccgccuggcggugggcugcggccagucucccuggacuccaguaucuucuuccugggcccuccagggucaccugggucuagguccugguucuacuuagggagggaggcaggcugggagagggggacagagggccuuuuguccuguccuugaguuucuucaggcuugaaugggccuuggagucccaccuucauccccacagggcacaggggugcccagauccucacagggccccaggacccucgccugggccagagggcaccucaugaccacgugggcagccucuauuuaaagauggacaaggugaggccugagggccggccugggacugaccucguggacagggcugccugcaccguguggccccagcaaggccuguguagaugggaggaaugggugcaaaacagcaccugugucggcuguggcgugacugucccucugugucccccacuaggcccacugcucaguggagcguggaggacgaggaggaggccguccacgagcaaugccagcaugagagagacaggcagcuucaggcccaggacgaggagggaggcggccauguccccgagcggccgaagcaggagaugcugugagcagccccauaacgcgugccugggcucuagccccuauccguguacccuggggccugggcagagggggaggucaagggccugggcuuggggguuccagugcaggaugagagcgaggaagggcccccaggagcaggcgugggagugggugagugcuccuggggcgaggguggccacagcccuagaggagggucugccaauaccuggcugccuccugggcgcugacccaggcucuguguccgugcccuggcccuugcucggaccgccucugaccccagccacgcagccuggccgagccccccaccagacucccccgccagugacucacagagccacguccaacuuggcggccaggcuggcuugcuuccuccuugggcccaggaggccuccgcggcugggcugggcuguuuuuccaauaaugcuucccuuccuucuggccucuuuuguuccauuuucuccaagucagcagccuugggcagagugggguucagcggucaccauagucaggcccuuggccacccccaccaagggccccagcuauccaggggcucccccugccacaugggaggccugagaagucggggcuuaggaggaccucauguaggguccucauguggggaccagggcagcccuuggggagccccaggaugaugggggaggcacagcccugcccuagggagccccagacugaugggggaagcacagcccugcuguuagggagccacaggcugacgggggaggcccagcccugcccuagcgagucccagagugaugggggaggcacagcccugcucuuagggagccacaggcugacaggggaggcacagcccuguccucagggagcccuacacugaucgaagaggcacagccuuacccucagggagccccaaacugaugagggaggcauagcccugcccucagguagccccaggcugauggaggaggcauagcccugcugagccucaaggaguccuggacugauggaggaagcacaguucucaggcugccccagaacugacgggggaggcauagcccugcccucagguauucugaccacaggagacacagcccagagccagcucuguggcagacagggucucccacacuuggaguccagggccugagcgggcgccgugaggugagugugggcccugggcagaggaggcagcagccgcccaggccuaagcuccccccugcuacccucagccucagccugaagcccucggaggccccugaacuggaugaggacgagggcuuuggcgacuggucccagaggccagagcagcggcagcagcacgagggggcgcagggcgccuuggacagcggagagcccccccagugcaggaguccugagggggagcaagaggacaggugagugagggccucgagggcgggcgcugggcagagcagggcucccucuggaccucgagggcgggcgcugggcagagcagggcucccucuggaccucgagggcgggcgcugggcagagcagggcaccgcggagcucccuucaggcccucaaccugcgccugagcagccaccccauccuccccuuuccaagcagagccugaaaugcccccauggccaggaaagggggagacaggaggggagggaggaagagggcgagacagcaugguggccggcgaggggccgcgaggaaaccucauucuggggcuccccagggccccugggccccauccaggcagcugcgaggccaggccgggugcugccacaucagcacacagcugcggccgcuuccguaauggaggcugagagcccgccgccgccccuuccucccucggggcuggcugaucuccauucccacggaggggagcagguauuuccagaugugcaugccggagagucggccgggaggacgcacuuuccagauguggggaugugugugccugucucaaccccaacaggcccaacaggggcugcucccgagccccacuucacuaccccugcucgggguccuugccgcucucagucaucuguggccaugauggggcugaccccacccgcccugcagggccugggccaucugggaccccagcccugcucaggacccccuugccuugagugggaccagagcccauggcugggcugacaguucucccuggucaggguccuuccuggccccucugaggcccuaaaccagccuggagcucuagggaccaguguugcugagcgacgcucccuuguccuccuacaaccaggcucccacuccccaagaaccacugguccuggccuggcgcagugcccaccgccccccucccugggccucagucuccccccuacgugcuugggagucagcggcucugcuuuucugagauggggcagcucccuucucccuuggccucaggccuaggcgggcgaggcugcucccaccagcagggggcgcuuugacucuuccguggagcccagcucugcggccgccaccccacccccugcaccugccuggcugcacagaccugcuccugaauggccccucuguguggcugcugcuggcucagaccccugcccaccuugggcgggugggucugggucuuggcuggcacgcacacccaggggccugaaaucauggaaaauucgagaauuucccaucuucuccuccagguucaguccugcucaaaugcagagccgcucaaagcugccagcuggcuggccuccccucccccgcagccggcagccccuuggcccugcuccucagugaccuggccccuaccccugccuagcccuccaaaugacccagccuccagucccccaaacacccaagggcccccacagggagcagagcaggagugguggccccagcagcccggccucgcggggaccccgucagaccaaccgggugugcaagcagcugccaagcugaggcccagccacaaagcuggggauugaacccagccucagugccugggggacccucagucuguagagcccugucuggcagggacugggcaguuccccaggggccucaggcccugacacaggggcccaagcagacugcgcuggcucugaggccacuggaccuucuuucccaaugggcuugggucucagaucccuuggcacucaaguagccugacuaccuucauuuuacagauggggaaacugaggcuuggaaaaaggaaggggucaaccaagcaauccaauggcccuagaacggcuuugccucccuuuccacccacaggcccggccugcaugccuacgaaaaggaggacagugaugaaguccaccuggaggaguugagucugagcaaggaggggccaggcccagaggacacuguccaggacaaccugggggccgcaggggcugaggaggaacaggaggaggugauggcuccaccucagagggucuggguguacccccaccccagggaugagucugccuuggcugucugcaccacucugugggcccugugggucuagcccagagugggucagcaccccacaccccuagaccuugcagccccuucugggcccacauucucagagagggcaaggcucagugauccucuugcaagauccggagacaucucuccagacuccucagucccuccccaccagcuccagaacuggagcacgucagggccacagagaaccuggggcucaggaaggaacagcauuuguucccacaggugcugggcagggcaggaggggcacaagcagggggucacuugggaugucuguuuuuuuuuuucuagcaccagaaaugucagcagcccaggacacccagccccuuggucuuggaggggaccaucgaacagagcucgccuccccugagcccuaccaccaaaguaaguuaagcugcaaagccugccaucuucuccccucucccguacucauacccaaaaggccaaucccacaugccagccacaggaagaccaggcccaggccuggcuuuugucugcuauccccccauugcccggugcucagcgaacccccaugauauaaggguuggggguuggauuagugguuggaguagcuggggagauggagggugggcuuuaccucggcugcugcaggccugugucucucuccacccucugcagcucaucgacaggaccgagucccuaaaccgcuccauagagaagaggucugucugucugucugucugcuuucugggcucagaucuuagguuuaaccaaguggggguugaagggagucacaagguagagaucuggagaccgaggggggcucugggagaggcuugggcagguugggagaagccuugugggagacauggggccugacacaucuucuacccuccaguaacagugugaagaaaucccagccagacuugcccaucuccaagauugaucaguggcuggaacaauacacccaggccaucgagguaugaccuggcuccccucugcugucaggucccuccugcauccuggcaccauuccuucauccaaccaacgcccuuccauccaaucagugccgccuuauucaaccaacacccuauccaaccaaugcuucuccauccagucagugccccucuacccaaucaaugccccuccaucuaaucaaugucacuccauguaaucaaugcccccccuuucaaucaaugcuacuccauccaaccaauaaucucccauccuaucaaugcuucugcauccaauuaauguuccuuuauacaaccaauacuccugcaaccaauacuccuccaauuauucaguguuccuccauucaaucaaugccccccucggaacaguacuccaccacccaaucaaugcucuuucauccuaucaaugcuccucuauccagccaauauuccuccagucaaucaaucccccuuuauccaaccaguacuccuuaauccaaucagugccccuccauccaaucaagauucaucccuccauccaauacuacuccauccaaucagugccucugcauccaaugucccuccauccaaucaaugucccucccauccaaucaauucuccuccauccaucaaugcuucuccaucugaccaauacccuccauccaaccaauacucaucuauccaaugaauggcucaccauguaaccaaugccagucccacaugccagccccuccauucaaucgguaccucuccauccaaucauccaauacucuuccauccagucaaugucccugcauccaaccaauaguccuucauccaccaacucccuucaauccaaccaauacaccuucauccaaucaauaccccuauucauucagugcuccuccauucaaucaauuccccuccagccaaccaaaacaacuucauccagucaaugccccuccauccaauaaugccuugcacccaaucaauggccuucuaucccaucaauuucccuccauccaaccaaaauaguuucacccaaucaaugccucugcuuccaaucaaugcccuucuauucaaccaauacuucuuuaucuaaucaggacaucuccaucuaaccaguauccuuccauccaaccaacacucuacuaaaucagugccccuccauccacccagugccccuccauccacccaguacucacuuauccaacaagcacuccucuaucuuaccaguauuccuccauccaaucagugcucuucuaugcaauuaaugccccuccauccauacuuuacuccuucacccaaucagcgcccuucuagucaagcaauacuucugauuucaauuaaucccccuucaaccaaccaauacuccuccauccaaccaguacuccuccaugcaaucaauguuccucuauccaaccaacauccuucuauccaaccaauauuccuccauccaauuaaugccucuccauccaaccaguacuccuccguccuaucaaugcuccuguauccuaucaauauuccuccauccaaccaauacuuccccauccaaucaauacuccuucauucauucacugcuccuccauccagucaauaccuuuccauccuaccagugccccuccauccaaccaauacuccuuuauccaaucaacgucguugcaugcaaucaaugccccuucauugaaccaauacggcucuauccaaccaauacuacuccauucaaucaaugccccuccaucuaacaaacacucccucauauaaucaguacuccuccauccaaucaauauuccuucaucuaucaacaccuuucuauacaaccaauacuccuccaucuaaucaaugcuccuccauccaaccaauacucugaaauuuaaccauugucccucuauccauucaaugucccuccauccaucccauggucccccagcccuaccccaugaggagcauggaggcagacccacaucuguccugugcgccaucaucucccugaugcucuucaggacagggaggugucucacaacugcaucgaauggaggaaggcucaucuuuccagugauccccacucuggggcugcauugggaaagcgcucccagggaaaacacaaacacaaagcagacgguugcccagugugacccucugaugugaccacgguggcuguccacuaagguaauccugaugcuuuuccuccucugcagaccgcuggccggacccccaagcuagcccgccaggccuccauagagcugcccagcauggcuguggccaguaccaagagucggugggagacgggugagguacaggcucagucugcggccaagacuccguccugcaagguaagguccccuccaggggcaaggcugggcugcagagccagcgccugggaguuuaguagcaggccggguuuccuuguuaagacaagcaugggacuguccaggaugaauguggguauacagaacccugagguauugcaguaggguuggguucacccuugcugguguagaaggcuguguuguccgaguggagguagauggcaccuuuauuccuuucccugccucuuccacugggaucacacagaaaaaguuuagguaggcagaucccaggcccccuggccagguaaggcaaggcgggagagaagggcccagggcuucuacuccccaagauccaggggucugcccuugugacauacccuucugcugcccccaggauauuguggcuggagacaugagcaagaaaagccucugggagcagaagggaggcuccaagaccucaucaacaauuaagguagagccuaaaugugguuggugcaggcagggugggugcagcaggggagggcaaagagggacuguccucugugcaucugggagggcuucccagaggcggaggcagcaucaucuccuuucugcugcucucaccuucacucuuggucuccuuucccaacagagcaccccaucugggaagagguauaaguuuguggccaccgggcaugggaaguaugagaaggugcuuguggaagggggcccggcucccuaggcgucccaucucggugagucccuggcaacucacagaaggggaugaggugcacacacgugcacugugcugggaacuuggcaaccuggaggcugccuggagcccuguugcaggcuacaaggguggacuccgaguuggccagaacccagaccagcucagucucccaguccugugcagaugcugccucucucaccugauaccagauucaaacucucugcucauuucacuagagucagcccggcucagccacugcuccacuagggaagcucaaggcucccaucugggacuccccaaaagccacagcagggcucgugagggaagugaggggcagccuggccaccacagggcuagcauugaaggaagcagguggcauggagcccagguucccugaccaucuguaugcugaggguccauagaggggcaggaacuuagguccuacucccugucccagccgagagcgauucagagguccugaugcccuccccaucccaugcugcagacagagcagugccacuccugccauggugagacacacauuuauuagugaccugggccccaggcuccauuuccagcacccaucacaccacaggguggggcagcuguccuccuaccaucuuccccugccaaacccugacucucaagcagcuguggcagaggcuuuuucugguaccucugugucccucuccugugguuggccacccccaccagagccuggcugacugcugaguaggccccuccacucuccccaccagggccacagccccuucucugucccgcuuggccaagcuguucccauaggguugggacugagggcucccuccucauccagcugucaaagccugggcauggccagugcugagacccucgcugucccaccagcgaaucccucgaguucugcccccucaggcugucagcccagguaggggaagcagaggugggccgagagagaggucacgcugggcccuccuccaccccugaugagccccucccugccugccccugagcacuuguauuggugccaagucccacgcuggcugagggcuccccccugcacccuagucccaggaucuggcucugccaucaggaagcacaggcagcaaaacugcugacugcuccugacgccgauggccaagccagccugaccgcacccaugccucagcaagcagagaucuggccccaaaccuuugacagcaaaaggugacagcaaaagggaggaucagugagaggcccaggccccugaggagccugggcuaggucaguagaugcaguccucugccaucuuaccuaaaguuuucaucccaaggcccccauccuacaucccgacgcagaccccuucucuguuccccucacaccacugcagcccaggggcuccagcucguccucucugccccguccaccugaccacccuccuaaccaugcagacuucccucagcaccccaugugcccuucccaggcugcccugcaccccaugccccuugggcccuggugcaucuucaugcagcaacuaugggcccccagcuagagccucagccccuucuucuguccaucccaugguccugggcucugggggccauucuggccacuucacuggagccuccagccagucgcugugcgguugaaguucuugggcugggggcucagcuccaggauggagcggacugugggagggggccggguggccuccugcagcuuccgggcguugaagcgaggccgguacaggaagggcaggcgggugaggcuggcuggggugugcuccccaccgcugggcccugccaggcgcccuugggccuccgccacugacaugcgguacagcacggcaucccacauccuggagguccgggaggcgggggcccggggugcggugagggcgggcaccuccugcucugugggggcaggcaccuccugcucugugggggugggcaccucuggcuccaggcucugccgcggcucugggcacggaggcucuggggccuccuccagcagcugcuucuugagccacguccagccacugagccggggcuugggugcaacuuuggggacagggcaugggugagggccugauggugggguaggggaugaggcccaggcagggcuggacacucgcucggccucagcggcggggccagccaucgggggcuccuccaggugcucucugccagggcccauggggaccaggcugugcggugaggacuccagcgagcggcaggucggggcuaugggcaccacaacccuggcacuagccucucugggcacugaggccuggaagccggguggcggccgugguacagggggcuccucaggcaagggacuggcagccuggacuguggugggcagugggcggaugugagccacugggaccaggggcugggcccuggggggacuugggguggcaucuccauccuggcuguuggaucccacuucuggggcuguccugggaggcucaggggucccauuguguggggauggugccagcuggaugugcaccugggugacgugggugcccccacccccagagacagggacgaagccacuggggggccggguagguucuggggccgaggcuacaaccuggggccccauggcccugaauugagcagcuagaauccugcgcugggugaggccgauggagaacguggacuucugcaggggugaugccacgugguggaugaugggggugugcggggagcgggguagggcagccaccaugcggggagccucggcggggcguggggcuucaggaaggcguggggcuucggcggggugcgggcccucagcagcgugcggggcugugaccuccuggucauggcuggccucacucacgggggacagggaggugcggaaggcccuggguggagcgaggugugugccucccaucaucuucuuccgggcugccuuccucaggagcuucugcaaacgcaaguuguccuucccuggcuugggcagcaggggcgguggggguccagggguucccuggaggcuugggccgcacaccucgggugccaucgacgcagccgauaugagcaugacuguguccuagggugggagggacaguggucaggccagcccuccucccuccugaggugggaggccugugucuccugugguccaaggaggaccuggggccagggguguggaggccugaguauucugcuuccugagcacccagaaccugccagggacaugcugagcucgacugugccuuggggacuuugggguggccccaccaucacccuaguguagaaaugaggccacagaggccgagucccuccagggauggggcuagaaccugccuccagggcucuguccuccaugccaccccagcacaaagcaggccccaaguacacagccugggucaggccgcaacaccgugugggcuggggugggagacggagacgcgggugagccccaagugacaggcaugccccuggccagcugcuggccaagcccagggcuggaagagcggcugcccccagacacgugaggggcgcccuguugucgccggcucaaccacaggcgcguccgcugcgagccagcggugagggguggcggccaagaggcuugggaaagccgaggcugcaucaucagagguagauuggccggaaggugggagcaguuuucgcugagcuaugcuaaaugggauauucccgcagaccuccugucugggguggcccggccaagccgcccacccugguuucugggcaccacguguuugcaaggacauugacaaauggcaucuguccgagccagaggcucucugguuuggggaaggagggaguccugggggcugccgcuggugggggcuggcucugccaaggcaagaacagagcugcuggaggggugggggcggaaggagccugcuuaggacugcucucagcuaccggccuccucuggaugacgggacugcaggaaccacgagaaccccaguucuagcucccagggugggcaggcugcuuggcaggcaggccgccuucccuccaccaggagucaggucuccagccagagguccugacccagggcacaagugcucgcacugggaagcaggccucugaggcaggacgucuucuccugugguggagugggggugugggcagggcagggaggccagcagagagaggcucggggagcaggcucugugggcuugcaggaggcaggucuguggccccucccuggacccuagccuaaugcccccugcaccccaugccuauguuccagcuuccugggucugcagguccagccggcuggcacccuccauguacccaggggagauuccagccagacacccgccccccggcccuggcuaagaaguugcuuccuguugccagcaugaccuacccucgccucuuugaugccauccgcugccaccuccuuuugcuccuggacccuuuagccucucugcccuuccacucucugaccaccgcccccgcccuccccacccagcuccgcuucuuguuacuugggggaggaaagaaacuccugaucauuggccaaagggacuuaccccuggagaggccaagugccuucuaggaaguuaggagguugaggcacagccugugcagagagggugggucacccccccagauccaaggagaaacugcaggucaagggcugauaacggccaugcaggaugcuugaugcugcgucccccgcugcuugccgccccccaccccgccauuuuguauaauaaagcucccuguguauucucaugugcuggcugucuuguacucacuaagggggcagggcuggccaggauggaaauguugggccaguggccagcccauucccacacugcacagcaugcuguggccucuggguucaggcagucugaccugucucauggccuuugcaguauaagacgccaggacauaagcucucugguggccuaagucagagcacacacaaugggugggguccgggcuuccuuuuccagaaugucugugauaucccuaccccaaccaggacuagcccaauauaaacu

SEQ ID NO: 15485 - RNA, 9602 nt, Homo sapiens
gucacagcccgaaccagcuggggacgccgccccgccgcgggucgcugcucugccucugcugccucuccuccucgagcaugcuguagaggucgucggcagcgcugccuucagggcucucgucuuucucgggaaacagaucugggaacgugaaggucuguccaugggccuaagggggagaacaaaggcuccagccagagcugcaaagacuccucagcagaggggucugugggggagccucaugcuuucuggcagccccuuucugccggcgccggauucaacugcucagagguaccucccugggccuccuggggcagcgucccugccuggaauguaagcacccccacggccaccggcccccggcugucacgcugcagcagaggccacagcuccaggacagggccgcuuuccccaccauugucucuuuagggccuggugucugcccccgcccugggugcacccauuuacuagcacggggccaccugguugguggggggcagaaacaaggcauggaaaaacaugacacaaaucacgucugguaccaugcugaaccuguccauccaaaaugccucaggcucuacucacauuaaagcucccccuccucccagcccagagccuggcaauuaaagugaacaucacguacgaagaaacaugcacgugcggcaguugauaaaucaggaccggcucugccaauuaacuggucuuacaucuucugcugagaguucagaauauguccgugucagccaagccccagcccaggccacagcauguggcucggguucacgagaaggaggggauacugcuccuuggggaccuaagcaaauacaagaagccaucuuaacuugcuaaugauuacuaagugcuccaaagcuaagaggcagaaagagcagaccagaggagagggaagagaagagggaggaggagugaggauggcacccgaaucuggaacccuuuagugaguaaaaucagucagguacacuuggcucuugcagacccuuuguguguaaauaaaucuggaugugggcaggcagccaaguaugaucugaaacaggcccagaucccacccugcgagggagguguaugcacccugaucccuggcgcagagcgcaggggcuggcggggagaguggcacugcgugcgccguagccggccugcaggaggauugccuuacacagcucugaacuuugcgucuuuuaaaauaccaaggggcagucguuuacacgugaggcugacugcccagaaugggagauucaccuugacuauauggaggugauucugcuaguuuuccgaggcaaggggaacccaaaaugacaguuuaaagcacaaacauggccauuugucacagcuucgggaagaaauggggaaaggugcugagagaaaauccguuucuuacaggagacaaacaccguuuggggaugccaagcaugguuucccaggggcuuccccuuucuagaagaguucaccuuguaccuaaaaaaaaaaagcccuugauccuuccaaaaaggagagagacagcugaucgggguaaagaacaggaauggagaaaaaugucccaaugacaaguaaacaaggcagcccugccuucaggaaucccagggcgcccugggggcugccgccugccuggaccuggaggccggagccccgagcacggagcucggcccagcuggcggcagcgguuuguucuggaguugccucucaugucgugcgcccuucauuccugcgcgcccuucauucccgcgcugcucagcauccacacaagccucggggcagcgggcagucaauggucuuuuuguugugugggucacugaggcgcugcuuucagcucccaggacuuugggccaaggagaugcuuaucagguugucggagaaagaaaugugggacucccgccacgugggacagggccuuuccacagcggccaacuccaaauaacguggauaauuuuaccuuuccaaugcucccucccugggcuuugcaauuagcagugauucuaagcccuggcgcagggcccagggggacacgcugagcaaggucucagcagacacgagacaggaaagggccuugagaguccccucugcgggcagacagggaccaacggccacggcccauuucuaggcugugcaaagaugugcuggaguucaggaaggggggugaggacccguuacaaauuuucauucuggaacaggaggauccaugcccaacugggacccuucaggcucccaguugcccugcccugucucuggcugccuggacuucacagagggagaacaacacgcgggcagcagcugcagacaccggaucccggagcugcuggguucaguuuucaugggagguggggcccagaggaagaacgcaagggcucggaugacuugaaugccacuuguaaccguagcugccucugaagugcccguggcggugccggcacacgggauguccacccacaugccaugacaaagacagaugggcccgacugacacugagcacacagaggccuuuaugaggccaacggcugcucuccccaccuggauuggcugauuucaugcacagcaaauaucaggccaaauuauuccgggggccccuguuuagaacaacaaaugugacuguuuuucagaaaagcugccaugcuaacuuggccuuuuucacaaacugccuccuuagccccacaacaggccggcuggcccaggaggcgguuuccaccaucgugugacugccaucuaguggcagggcccgccggcucggccuccagggaccauuuacaccggaagacaaccccauccccacccaguaaggccagccccaggggcagaguggggaggcccaggaggcggccggggcaggcuguggacaucuuggcccagagagaaagugccucuggguuugccugggacucaaaaugaagagcccaaagaaaggcuuugaaacugugggucucacuccugacaagucuggguuucagaaacugaaggcccaggcaacguggggugaggguucuuccuccccagagccccccaggauacguaagaaagcaccugcucagaagcagccugcugagcccuaacaaguacgugggaccugcuacccugcaaugcaggacaugggccucagccaacagcccggccagccagaccugccuuggcaccaaagaccuuugcccucaggggccucacacucugccuccgaggcugaaacccagccaaggacaggcucuccagaggccggggccucccaugcucugacacccuggugugcguuggaguugaaacccacuaggccugugauggcugccuuugcccacagagaauucaaacuucaaaaucacaaaacggccggacgcugagacgugccccaugugccccagugcucacgugcucccagcgccaccacuaacacccccaaggccgugacggagcaugaccuuauguggagccugccucugcgcugaggcccugagauccggccucacgggggcucccugggccccagcgcagcgucuccggcacaaacauccccaaggacacaguugcgaggagccccucggaggccccgcuggggcuggccagcucacacgcaccagcugcacguaggcgaccuuguaguccggcuucuugauccucacguuucugugaucucuucucuuguuagagccugccggaagggagugaaaaaaaaaucagaacuuuaaaaaaaucagaacuuuaaaaaauuacauccucagaggucaaugccacuaaaacgaaccucugcucucuuaaaaauguaaauauguuuuuaaaaacucaaaaaggcgauuucucagggaaaugggcacuguaaucaaacgagccagcacagcaggcucccaggcuccucccuucucccaacagaggccagcagguucucaacaaaggagcggacguggcaccagccagggcacacgacaggggcuuauggaacagacagcgcuuugcuccccagccucagccacugcagucccaccucgggggcugacggcaggagucagggcucagaauggaccccgggccagcccaguugaauuccaaucccugcucuggcacguaagcaccgugugacccugacaagucacccugugccucaguuucccaugagccacgucagaccaagacccccaugcaguagcugaggcuguggcucggcgaggugggcauguggcacagaugggcacgacaccaacaggagaaccucccaugggcacucaccaugcugcacccguguccgcacagcagccacgggcacguuauagaugcccucgagguaauuccugagguccacccuugucauucuggaggcgaaggagaaagaaaacggcaucuuaaccaggcuaaaagccaaaaauacugucccagaugcacaagcacccgaggcugagaggccgacagaccaagacccacagggggcagggaggagggcuggguacaucagcggcacuagugaggccaggcagccccagcaacaccagugcugcuggcugcaagacucccuacucugggcacaccagcaugggguggcaguggcacagaccccacagagugggagcacugcccaaccaaccccuggccugcuccacagccccacauggcucccugcuccgggcaagugccugugagaggaggugacagucucugcacgcuccuggcuggcaggugccccaccucgucugccccggggcccaguggccgcaucaggguuaggccugcucugcggcugaugggacugaugcgguucuaggaaguaccuucuggaaaggccugccuggcauucggugcguuaacugcaaguucccucuacugcagaaccucacggucacugucaacucagcuucugggccccugcaggcugcacaggccugaccuucgcccccaggggagcucacgcugcugccccgccuggcucgcaucaacccugagcuggggaccugugaacuuaaacacugcagagcagcaccccaguuuugcucguagggacugugcauuucucugaaggucaagcaggcucuucugagcgguucuguacaucacggccugcucccaacccagccucucagggcgccucuccuaaaaagaagcugcaagaacucaacagaagacgcgagcacagagguccaaauuuuaaggcuuccagugaagccguccccggguggagggcggcgugcagccugccugccgggcuccacaccuacaggcacuccaucaauacuugccgggcagggccgccugaggugccuucccagcaggaagaggcuagcacgugagcagaguuguuuuaacucaggacccaggccccccugagggcacucucccaacccagcgggaaaacuuccgggcucacuccacggggauccccccgagggugcuccccaaccccagccggaauccucccggacucacuccauggggauccggaacugcacgguguccucgggcugggccacaccgggccgcaccagcugaaugaagaaguugguucggaacacccgaaguugugggccacccagccgguacaggggguaccuguacagaagagauuggguccaugucacacacuuaggccaaggcagcccgacacaccaacccugcagaccuccgaguguccacucacaacagggugggcagaaaaggggguagcuaacacugcggaucccugaguguccacucccaacaguggugggcgggaaacgggguagcuaacccugcagacccccgcguguccacucccaacaguggugggcgggaaacaggguagcuaacccugcagacccccgcguguccacucacaacaggggugggcgggaaacaggguagcuaacccugcagacccccgcguguccacucacaacaggggugggcgggaaacgggguagcuaucagcaggucaccacccaaggacacagagguccccacagccccuuucucacaugggccugccaagguggacggccagucccuagcaucgacuuaaggagcaugcgcuguugacccccaaggucagacuuuagaaaaggccaauggacaaaaaucagaaccccgcagacagcauucccccaauaagcugauggcaaggcucaaagacguguguuggggcacugauaccccugggagagcagaccccacgcggccggcccacucuccugcugcucgggugaaguggagcugcagagaaccacacaccaugggacagaaaaggccagcuccgcacucucccgguggcagcagggccuagcuccucgguauggagaacgcaggcuaaccaggcuuaggcuccuggaagacggugcugccaagacucugauucaguacacuaaaugugaguugagugcaccacaccccagcacuccacuaaaagccagcagaggcagauggagaggugccaaguggccaccgcaaacuagaccagcacgcugccugggcuggggggccaggugacgaucgugcagaaucucuagccaguugguuucgugcauucucccacguucagcuggguggacaggcagcaccguccuaccgucccccacccccguucccgccccugccacugccggcacacccuggcucuaucugggccucagagcuggggggaggaggggcacaggagaaacucaggccugcugggucucgggggauguggggucugagagccuaggugcaggucuugguggacggggagcacaggggcucuugaggggucucugguggccuuaucugaggcacugcacauggcccuggccuugggagcacccagcaccaaguuaagaggggcuccgugaggccaacgcugccccaggcuucacaugaauuucacgcuggccucugccugucuagggaagaugaggaggaagugagggucagaggccuugggugggguguuccugaagggccaacagugguaggcagcacugagccucugggccugagggccuggcaggggccaggagcugcugggaccucucagaggcaaggcgccuguaacaaagcccgaucacuaaucauguccaccccaggccuccugaugaccacacugacacauggcagccugguggccgggccaguggggcugagucuucacucacccaaccccagcagagccuccucuugggcauggccuuggccuuuccaagccucagagugcagccuucaggggugggccccagugagaggccgagaagaaagggugggcucuggagguggaggggccugacuuguuuuacccacagguucaggcuagccauggccacccgaggggcucacacauucccucuggugaccagcugugggacugcaggaguggagacaaaguuuggggacucccaguaaacaguagaaaagaggguucaacagcucccaggccauuaauuuucgagucuccaggcuuggggccugaagggcacacuuugcuaagggucugaagggccaugugugggcuugagaugagaggcuggcagggguugggccaggacgauucacuguccuuguucccacaggccgagccucuccaggcuggagcgccagcugccugugcauggagccugcagaucuggaacaaucugcacugucgacacccagggccccaggacagggcucuaaggccucucuuuuguucucgaacccuugugggcccaccagcccucaguucccucagucccacucuccccagggagcaccccaagcacuccgcaugggauuucacaagcaccuccacgguaaccuaucucaaguagaacucugcacuaacuucuuccucaaaacacaaaaaccuggcucacugccaccagccugccuccccacggccccacgagugacucacccaggaucccacccucucggcacccccaccccagcugcauccaguccacagcaaguccagucagcgcucccugcaaaggcucccuggcaacaggagugugugcacugcugggcgagcgggccccgcugccuccaaggcaaccacaccugauccguuuccaggggcccaccacccuuggcccuucaggaacaccccacccggguccucugacccucacuuccuccucauucuccagggacaggcgaagggccagcguggaauucacgugaggcucagggcaguguuggccucacucagaccuuuucuuccuuggugcuggguguuccccaaggucagggccacgcgcagcaccggucccaggugucugcugaaggaagccuccuccacugggggucccaccugccacccuccccucucuccccagcuaugugcaggggccuccaaagccacacccuggccccuugaccgucccucuccagaaacacugauuacuguucuccaaaacccacccgggagcccacaucuacugauuacgccugagucauucguucaccaagaaauaugcagggcuuccugcuucaauuuggggagggcgaaguggugcaggacagcgccccgauggcccccugggaauccagagaacaugcagagugggcguggggggucugggcugagcagaaccgggccucccgcccugccugccccaaagcccugagggcugcggucagcugcccuuucccacucaaacccaaucuggauucccagcuccucugccucaggccgcgcccgcgcugcggugggggccgcccgggccuccccgccuggacccaacagccgacguggcccccgccccgugacgaucagaaacgucuccaaacagcucccucggcccuggcugcgggaccagccccgggccugaccccgggccacccucccacuccccacgcgggggcaccguggccuccauggguuuggcucggacccucuguccccagcccggccacgcccgcccccugggguugcccuaaaccuggcggggggcuccuccgccacccgccucgcgugucucaaggcaugacagggggucccggagaacccugccucgcccgggccaggaggcggcccagggacgcccaccccgcuccccggaguccgcgcgcccugugggguccgucugcuugugacacuaaggggcgccccgcgacgggggggugacgaccccuacucacaccacauuccgcgccauggcggccacgcgcgcuuccgggguccgcgaggcggaaggagcagcgcgcccgccccgcacggccgccgccuggcacagcgcccccucgcuuccggaggccgcgccgccccccccgcacgcgccagcgcccgugccgcgcgcccgugccguccccagcccugcgcccgccccgccccgcgccgccuucuucucccucccugccccccuccugucccgcaccccacguuccuccccgccccgacccccacuccccgcgccgcagacuccacaggacgcggggccgcagcagucccgccccgcacucccggccccacagccugaagcccgggcccgcgccccugcugcucgcgccccgcccacgcccgcaccccucccagccccagagaccucccgccgccgucgcacucuuucgggccugucugcccugccucccgggaccccggccugcacgccccccacacccgugccccugcccuuuggcagcuccaggccacagccuggccccgcaccgcugcgcuugcagcugcugggagcuggaagugg

SEQ ID NO: 15486 - RNA, 2673 nt, Homo sapiens
aaauugcuguaacaguguuuauugaugaugaguccagggcuccugcugaagcccugguggggaggggcacagagcgagauggggcguaauggaaugcuugaaggcugcuccgugaugucggucggagcuuccagacuaggcgagggcagggugaggccucgggcacacagccggcgcccagucacccggcccagauggagggcggccgggcccugcacaggcacuugccaagguggcucacacucacgcacacucguacugagacucaaggccgucuccacaacuccaaccagugcaaaugacuuagugcaaauuaaauucagaagggacgggggaaacagagucguggaggcuuugaaucucucagaaaaaaggaaagacaggaaagcucagaaacaaagagacagaaggaugaaaaagaagaagagggaggugguggggacggcgucaucccgcuggaggagcucagcucugggaugaugugguggcugguggucaaccguccgccgcaggggguggccaugaagauggagucgccggugcggggugggugcugcgggcgcugcuguuccgauggugucuuugauguugggcugaugaggucugguuccucuagcuucaccuagagauagcgacacgugggugggaugggggcagggugcucgggggccuggaggcuuccggaaggagcgcuggugcucaccuuccagagccgauuccugagucagguagugcagugguuguaaagugcagcauauucauuuccaagcuagaggguuuuguguccggauucaaaggcccaggcuugagcuggguagcaccauuucuguggauggggaaggagugaggucccacucagcuccucucgcgugccccccaccccaaguguggcaggaagccccucaccuuucauguuguggguucugggagcccagagggcagccauagugugccgacuccguggaggaaguaaagaaacagacccgcuucuugccgcagccccaccagccuaagguguucuguagaagacagaggucggggcagugagaugguggcccggcggggcggucugggcagggccgcguccugacgcagggagggcagacacgcucaccaggaaggccggacgcgccuccucuguccucgccgucacaccggaccaugucauguccugcuugucacguccaccggaccuggcgucuuggccuucggcagcuggugggcacguccaccccagcuggagaccuggcuguggggagaacgagagagucguguggggagaacguguugguuguguggggaggggcgggugggggcugaggguggcagagggggaaaaacucacccucgucuccagcccgaacgcugaggcaccgaucccggcuccgucgccgcccgcgaggcccgccuuggccacgggcucuggaggccagugccucccgcucgccgcccgcugcgcuccucaccccugccugcaccauccucccuccugagagcucauucacuccgccccgcccgccucgccuagucuggucucgccccaugcccuugacuccccuggaugcuguacugucugccaagccagccccaggggcugagcggugagggcauacagcgucaccaaguccacugugggcccucuccgcaccagacccugggccgcagugccucgugggaccggcgcccgcaggccgagccccugcagccuccuugcugcgcaaugucccggggccccccucccguggccgcuucgcccuccuggugacguccugcugcaacuccccgagcacugccugucuucccgcucuccagcccucgaggcuccggcauaggccugagaaagccgugccggagcugccccugugccugcuacuaaaugaauugcggugggugagguggcagcuggggaccccucuguccuguguccccugccaugucccugucugacccaggccugggguaccaccccacgugcuggacccuacgcuggccaccccugugcucccucccugcccucuugcucuuucugccuggaacgggcccauaaccccccagccuugcgcagucucggcuccccccgagaagaugucaccuuugcuaacucuccugcccccauccugccccucugcugggagggugucugcuucuccccgccagcccucgauccccuaaaccuccuucuuucagaaggcuggggaagcgaggccuggggagggaagggacucaccugcccggcagaugggguccucaccugcccgcugcugccagcuacaccuccguugcccaggcccugggaucaaacccugcccaccagcuccccucguccaaccagcugccacguccuguaaccaaaagugaccgggaugaaugccuggcucccccuucuuuccagcccuagcucaggcccaucguccccagcugaugucgcccugucugcacgaugccugggcgccuacuccacacuccucacuggccucaggccccaccagcccugccucgagcuagccccuccacccgucaucacuccugccagacuccagauguccaaggugcuccuuggcucccacaagcucuccuccagcaccccaucuuccccugguugccccucgguuccccacuuccccaguuucccccguuaccccccacccaucccacccccucccucacccugcu

SEQ ID NO: 15487 - RNA, 2673 nt, Homo sapiens
agcagggugagggagggggugggaugggugggggguaacgggggaaacuggggaaguggggaaccgaggggcaaccaggggaagauggggugcuggaggagagcuugugggagccaaggagcaccuuggacaucuggagucuggcaggagugaugacggguggaggggcuagcucgaggcagggcugguggggccugaggccagugaggaguguggaguaggcgcccaggcaucgugcagacagggcgacaucagcuggggacgaugggccugagcuagggcuggaaagaagggggagccaggcauucaucccggucacuuuugguuacaggacguggcagcugguuggacgaggggagcuggugggcaggguuugaucccagggccugggcaacggagguguagcuggcagcagcgggcaggugaggaccccaucugccgggcaggugagucccuucccuccccaggccucgcuuccccagccuucugaaagaaggagguuuaggggaucgagggcuggcggggagaagcagacacccucccagcagaggggcaggaugggggcaggagaguuagcaaaggugacaucuucucggggggagccgagacugcgcaaggcugggggguuaugggcccguuccaggcagaaagagcaagagggcagggagggagcacagggguggccagcguaggguccagcacguggggugguaccccaggccugggucagacagggacauggcaggggacacaggacagagggguccccagcugccaccucacccaccgcaauucauuuaguagcaggcacaggggcagcuccggcacggcuuucucaggccuaugccggagccucgagggcuggagagcgggaagacaggcagugcucggggaguugcagcaggacgucaccaggagggcgaagcggccacgggaggggggccccgggacauugcgcagcaaggaggcugcaggggcucggccugcgggcgccggucccacgaggcacugcggcccagggucuggugcggagagggcccacaguggacuuggugacgcuguaugcccucaccgcucagccccuggggcuggcuuggcagacaguacagcauccaggggagucaagggcauggggcgagaccagacuaggcgaggcgggcggggcggagugaaugagcucucaggagggaggauggugcaggcaggggugaggagcgcagcgggcggcgagcgggaggcacuggccuccagagcccguggccaaggcgggccucgcgggcggcgacggagccgggaucggugccucagcguucgggcuggagacgagggugaguuuuucccccucugccacccucagcccccacccgccccuccccacacaaccaacacguucuccccacacgacucucucguucuccccacagccaggucuccagcugggguggacgugcccaccagcugccgaaggccaagacgccagguccgguggacgugacaagcaggacaugacaugguccggugugacggcgaggacagaggaggcgcguccggccuuccuggugagcgugucugcccucccugcgucaggacgcggcccugcccagaccgccccgccgggccaccaucucacugccccgaccucugucuucuacagaacaccuuaggcugguggggcugcggcaagaagcgggucuguuucuuuacuuccuccacggagucggcacacuauggcugcccucugggcucccagaacccacaacaugaaaggugaggggcuuccugccacacuugggguggggggcacgcgagaggagcugagugggaccucacuccuuccccauccacagaaauggugcuacccagcucaagccugggccuuugaauccggacacaaaacccucuagcuuggaaaugaauaugcugcacuuuacaaccacugcacuaccugacucaggaaucggcucuggaaggugagcaccagcgcuccuuccggaagccuccaggcccccgagcacccugcccccaucccacccacgugucgcuaucucuaggugaagcuagaggaaccagaccucaucagcccaacaucaaagacaccaucggaacagcagcgcccgcagcacccaccccgcaccggcgacuccaucuucauggccacccccugcggcggacgguugaccaccagccaccacaucaucccagagcugagcuccuccagcgggaugacgccguccccaccaccucccucuucuucuuuuucauccuucugucucuuuguuucugagcuuuccugucuuuccuuuuuucugagagauucaaagccuccacgacucuguuucccccgucccuucugaauuuaauuugcacuaagucauuugcacugguuggaguuguggagacggccuugagucucaguacgagugugcgugagugugagccaccuuggcaagugccugugcagggcccggccgcccuccaucugggccgggugacugggcgccggcugugugcccgaggccucacccugcccucgccuagucuggaagcuccgaccgacaucacggagcagccuucaagcauuccauuacgccccaucucgcucugugccccuccccaccagggcuucagcaggagcccuggacucaucaucaauaaacacuguuacagcaauuu

SEQ ID NO: 15488 - RNA, 17775 nt, Homo sapiens
ugccucagccagagggagcucuguagugggggcagcacccauucacuggucaggcacuggggugacaggggaggcuccaggacuuggggagcguuggagcuggaggcacauggauuggagucccuguaccugccccacgacagggccugcagggagggauccagcaggugacucuucaggcugauuugcccaucccagauagaagccgggaguguucuuucaaaggugucuuuaccuuagacacucaauaaaaugguaacacaguggcgccgccucaguccuuuggagugugcaccgucugaaccccucucccagggcccucucccaagcaccccaaccuggacccauaucccccacguacuuuuggcuuugggcagauugagcagccuugggguggucugugcugucugguguggaggguugcaguucggguccuuaguccuacuucccaggccggccgggcugacgccagcgaguguguccuuccccagcgaggggagugagcgcaaggucagcgccucgucugcggcgcccugcagggggugacggaggggcgcucugaggacccuuggagaaaggagcuggguuuguaaaaugcugggcuuggucccacggacggcggagcggugagcucagagccagagcuggggaggaaaugggaaugagaaaggcccacuucagggcuggugagcgaggggauggggagcagccacaggccgaggcuggggcaugggccaggcuccauggggugagucugaguccuugaggggauguucauccucuguggaauguggguuugccaguggagaggagaccagcguugcccuggugaggugcugguucagggcuggggggcggacgcugcuuggggcuaaaguuccugccggccaagcucugggugggaggagacccuggcccccucccaacacccuuggacugcuggcgggacccuuccuaccuccgggggcuggaaguagugggggaggagccagucuugaggaagaaccccgaugcuggucuugacuagaggggagccggugugcuuuucgagccucagggugacccgcgucugccccagccuccagccugcccuggucacuucugacuaaauaaggagagcacucagcaggcagccccacgagggagggggaacaugugugcacccccacucccccaccugcuccucccucccuacagggccacuacacccugcugugggcaccccaaggugacccucagccuucuuccuaccuuaaaaaguccaggcaugcauuuucaagcaugagcgguggcccccugggggaaggcaccucggcagggcagaacaaagggaagggacccccaaacaggucacugguguaauuguccccagcacccccaaagaggaggagaacccacaacucggaacuggggcucacccccgaugcccaaccuguccccagccugggaagcaggcguggaggagaagguggggggagccuagagcuggcccugggggcccugguuuuguccaugacgggagccucggcaaccuaguccgcucucccggggaccagguuugcagacaggcaccuuucaaaugcuccucacccccaaauuuacaagucacccugcagaggaaaacaucaacacagccagggguucucugcuggaggcucccccuucuauaggcacagccggagaggccagagagcuggggacacggggaggcugcagaaggcuggugggaaggggggcagugauggguggggagagaugggccagauguucuuggaaugggacaugggggugauugaugcagacagaaauuugaaggggacauucccacgugucuuguucuguggguggaaaaugggcuguuuuucauggugggggcggguucucccugucuugccaagcuaaugugaaagagaugccucauccugcccagcuccccacaccuguccaaggccauuaacuucugccuccccagugucaggcuuugagaugccccccuucuagccgggguccuccuauggggugacaauggggacaagcaaugcccacuguaguugccccaggaucccccaccauucugcugguccccagcggugcccccucucuggcaguacccccacccaccccacagguccccuuagggccacugccccaucgcccgacauugcccaacgccaaggggugaccuuguuccugccgacagggccguugggcgccugcaugcggguuuaauauuugccuauaaggaacugggcuuuccccagccggaguggacagacuuucccugaaaauucgcuuggagagaacgaaaagagaccccuggcaccccagcggcgugcagcccugcaccccccuccucccgggccccguguuucucauuuuccuccccacuuccucugcucuucaguguuacccaaacaaaacugguuucacccuuguuuggugcuggcgaaggcccgaacggcgcgcgcaaagcuccggggcaggccggagguggccaccgggggugcuccgggcccccaagccaagccggggacuagccugcccccgguggcggcucggccgcggcuucgccuaggcucgcagcgcggaggcgaguggggcgcaguggcgagggggagccugcggaccucccacgcggggaccgagcagguaucugggagucccgggagcgcccgggaagcagcguccuggucgcucccucgcggcccuuggguuucuuccuuacacccggacgcccgcuaagcucgggcugccgccacaaacgcgcucuccguguggagaaggcaaagaaaaaaaaaaauaaaagcaaaaggaagaaaaaccccaaagaacgaaaagcagaauuucagccggccgugcgcgccagggcgcuccgcgcuaccugcccgcgccgcccgcgcucggguucccggggagggcgccagugcuccgcgcgcgccccagccaaggugaauccccggcagcgccuuccuuccgcugcccgggaagcuugagcucaacaauuagcccuugauccucgggggauuccaauccacggaacaacuucccugcuuuccccgaacucggacauuuuacuuuuucugggauccucuaaauuuaagcauugcuucccaagucuucuaaauauacucaccauuucgacgggucacaauaauuuucuuggacguuaauuuccggggacgucaaaacacaucagucccggcgggcuuuuccagacuuacacuauguggccuggggccccagaugugcuuucucccaggcucuggacaguuuuauacacccccuccaggucccacagauuuacaggccacuaacccggcuucccuaauuuuaaagacgaagcccuugguccgugguggucgcgcugaccaauuugccuggcuccccaggauguggacagugccuuuuccacauuuaggcauuguuuccaaaacaaguggaacuuucccgcauaauuuugaauauuaacuccagggucuccuaagcuuacuguuuccggcacacguccgccccauuccgcgcccccccaccccacccccgcgccccuucccguucaccucagcaugggacauuugcuguugggucccgcaaaucuauucacacuaaccuggguucccuaaacuuuacacguugaaucccaagucccucaugacacucagcagggcuggaagguuggaacccucagaguaugaaaauugcuucccauaccuucccccaaauucggucauuacacccagagcauguugaauccuuuucugaaucauaaacgaccugcccucugauugccugaguuucauaaaauggagggauuuccccagugauuccccaaagcuauugagaauguugugggugugugagucacaaagcuuuggggcauuaacgucuauggcucuauaugcugccuggccacgaaucaggucccuuaagauguagacagugccacccaggucccuggagcacacugagcaguuaccaggaggugcucaagugugacccaggauucuccagguccccccaaaucacacagggucucccgggucccucugggcuacaccaagcacaaaaggaccccuugggcagagccuacuuuuauuucuguuaugccagguguugcuaacggccccaguucccaaacauuccgagcacuuucucugcaucacaacauauugacuauuaaacaauucucugggucccaggagcuucauaacaagaaucuugcuuuucuaaaauucaggcauuggucugaaaccccaacggccaggaucacacuggacccuuuuccuggucccccauacuuggauguucuggacgcugcccuccaggcccucuaggaacauucagcauugcccucggaucacaggacagcacugauuucuugggcuccaaacaacccacugagucaucucaaaguuaagcaauauuuccuucaagcacacugcacacucccuaucacaaaaucugaaaauuccuaaguccuaagaccuaggaauucugaauccccuuucuuuaaaauguacauauggacccccaaguccuccaaggacucugagcaacuucccuagaucuuuagauucaaaaacgauuuuccuggagcccccaaauugcgguauugucucccagccuuccaaagcaaauugagauuuuuuucccuucacaaaacaauugagguuuuuuuuuuuuuaauacugauuuaugagucuccugacuuuauggucccugcccugggucccccuacauuuagaaaauguuccauggacccccaaagcacacuaaaaaaugucccugggucccaagaaaucccaggcauggaaaaaccugcgaccuauaaguuuccuagcuacuaacuagguuuccagaaauuuagauaucaaaucuccauuggguaauuuccaugugucccaaaaacuugaaauguguuucacuggggcucccccaaaugcagacgacauccaggaaaauauauagucuuuuucuuauuuaccaaaaauaagcuaauggaaaucauuuaaaaauuagcauagaaaaauaauacugauuuuuuauuuuuuuauuuuuuauuuugcuuuccccaaauguacugaucacacuccaggcucccccaaaaucuagacagugcuuucuuccaucucugaaggguguuaaaaccuuucccugaagccacaguaauuaugaagguuauuuuuuccccggcugcugccagcguccaggccacuaacuuauauucuuaagaugugaaaauuaaucucagcuucccccuaacacaccaagaauguguuuggauccccaaaauguguuccuugcuuucaucugccaauuuuacguaauauggcucuacggcaaaauucccaauuucauauggagaauuuucuuuaacuaccccuccucacaaauuggucccccaagcuagcuggccccuauuugagaccucuuucucuauguucccaauugcauggagcaacuucucucaucccccaaaccuguaaucuauuuuucuggagucucgaguuuagucauuaaucacgguucccacauuaacggaguccccgggguccccuccuccaggacacccauucgcuaagcccgcaaggcagaaagaacucugccuugcguuccccaaaauuugggcauuguucccggcucgccggccacccacugcagcuuccccaaccccgcgcacagcgggcacugguuucgggccucucugucuccuacgaaguccccagagcaacucggauuugggaaauuucucucuagcguugcccaaacacacuugggucggccgcgcgcccucaggacguggacagggagggcuuccccguguccaggaaagcgaccgggcauugcccccagucucccccaaauuugggcauuguccccgggucuuccaacggacugggcguugcucccggacacugaggacuggccccggggucucgcucaccuucagcagcguccaccgccugccacagagcguucgaucgcucgcugccugagcuccuggugcgcccgcggacgcagccuccagcuucgcggugagcuccccgccgcgccgauccccuccgccucugcgccccugaccggcucucggcccgcaucugcugcugucccgccggugcuggcgcucgucuccggcugccgccggggaggccggcguggggcgcgggacacggcugcggacuugcggcuggcggcugcgcucgcuccugcugggcgccccgaaauccgcgccacuuucguuugcucauugcaaagaucucauuuguggggaaagcggcuggagggucccaaaguggggcgggcagggggcuggggcgagggacgcggaggagaggcgcucccgccgggcgguaaagugccucuagcccgcgggccuaggacuccgccgggaggcgcgcgcggagcgcgggcgaagugauugauggcggagcgaggggggcgaggggggccaggggggcgcgagauuccgccggcggccccuuccccuuggcuaggcuuaggcggcggggggcuggcggggugcgggauuuugugcgugguuuuugacuugguaaaaaucacagugcuuucuuacaucguucaaacucuccaggagaugguuuccccagacccccaaauuaucgugguggcccccgagaccgaacucgcgucuaugcaaguccaacgcacugaggacgggguaaccauuauccagauauuuugggugggccgcaaaggcgagcuacuuagacgcaccccggugagcucggccaugcagguaggauuugagcuguguuucccgcccugauccucucuccucuggcggccggagccuccguaggcuccaagccuggcccagauucggcccggcgcagccggccuuccgcgcgucccgcaccuggcgggggcuccggggcuccggcgcggcaccggggggcgcucgggaucuggcugaggcuccaagcgccgcguggccggcuccuccugcuggggcagguggcggcugcgcgccccgcccgagcccaggggcccccucagccgcaacaaccagcaaggaccccccgacucagccccaagccaccugcaucugcacucagacggggcgcacccgcagugcagccuccugguggggcgcugggagcccgccugccccugccugcccggagaccccagcucacgagcacaggccgcccgggcaccccagaaacccgggauggggccccugaauucucuagaacgggcauucagcauggccuuggcgcucugcggcucccugccccccacccagccucgcccccgcgcaccccccagccccugcgaccgccgccccccccccggggccccagggcccccagcccgcaccccccgccccgcucuuggcucggguugcgggggcgggccgggggcggggcgagggcuccgcgggcgcccauuggcgcgggcgcgaggccagcgaggcccgcgcgggcccugggccgcgggcuggcgcgacuauaagagccgggcgugggcgcccgcaguucgccugcucuccggcggagcugcgugaggcccggccggccccggccccccccuuccggccgcccccgccuccuggcccacgccugcccgcgcucugcccaccagcgccuccaucgggcaaggcggccccgcgucgacgccgcccgcugccucgcugcugacucccgucccgggcgccguccgcggggucgcgcuccgccgggccugcggauuccccgccgccuccucuucaucuaccucaacuccccccauccccgcuucgcccgaggaggcgguuccccccgcaggcaguccggcucgcaggccgccggcguugucacccccccccgcgcucccccuccagcccuccccccggcgcgcagccucgggccgcuccccuuuccgcgcugcgucccggagcggccccggugccgccaccgccugucccccucccgaggcccgggcucgcgacggcagagggcuccgucggcccaaaccgagcugggcgcccgcgguccgggugcagccuccacuccgccccccagucaccgccucccccggccccucgacguggcgcccuucccuccgcuucucugugcuccccgcgccccucuuggcgucuggccccggcccccgcucuuucucccgcaaccuucccuucgcucccucccgucccccccagcuccuagccuccgacucccucccccccucacgcccgcccucucgccuucgccgaaccaaaguggauuaauuacacgcuuucuguuucucuccgugcuguucucucccgcugugcgccugcccgccucucgcuguccucucucccccucgcccucucuucggccccccccuuucacguucacucugucucucccacuaucucugccccccucuauccuugauacaacagcugaccucauuucccgauaccuuuucccccccgaaaaguacaacaucuggcccgccccagcccgaagacagcccguccucccuggacaaucagacgaauucuccccccccccccaaaaaaaagccauccccccgcucugccccgucgcacauucggcccccgcgacucggccagagcggcgcuggcagaggaguguccggcaggagggccaacgcccgcuguucgguuugcgacacgcagcagggaggugggcggcagcgucgccggcuuccagguaagcggcgugugcgggccgggccggggccggggcuggggcggcgcgggcuugcgccggacgcccggcccuuccuccgcccgcucccggcccggggccugcggggcucggcggggcggcugagcccgggggggaggaggaggaggaggaggaggacggacggcugcgggucccguucccugcgcggagccccgcgcucacccuggcggcggagcuggggguggggugggggcgucgggaagggccgagggaggugugaggugucugcaggggcgacuucccggucggucugugggugcagggggugccgccucacaugugugauucgugccuugcgggcccuggccuccggggugcuggguaacgaggaggggcgcggagccgcagaagcccacccugguauguugacgcggugccagcgagaccgcgagaggaagacgggggugggcggggccaggauggagaggggccgaguuggcaggagucauggcagacgccacauucgcgacaucucccccacacccccucuggcucuguccgcaacauuuccaaacaggagucccgggagagggggagaggggcugcuggucugaggcuaagaagggcagagccuucgacccggagagaggccgcggccccugcccagugggcagcguggaaguuuccauacaaggaggugggaaggagacccccccccccuucacugcccugugcagagaugagccgggggugcaggaugggagcccauggcacuucgcuacgggaugguccagggcucccgguugggggugcaggagagaagagacuggcugggaggagggagagggcgggagcaaaggcgcgggggaguggucagcagggagaggggugggggguaggguggagcccgggcugggaggagucggcucacacauaaaagcugaggcacugaccagccugcaaacuggacauuagcuucuccugugaaagagacuuccagcuuccuccuccuccucuuccuccuccuccuccugccccagcgagccuucugcugagcuguagguaaccagggcuguggagugaggacccccgcugccaucccacuccagccugaggcagggcagcagggggcacggcccacgccugggccucgggcccugcagccgccagcccgcugccucucggacagcaccccccuccccucuuuuccucugccccugcccccaccuggucucugcucccucaccugcuccuucccuuucuguuccuucccuucggcccccuccuugcccagcucaggacuuuuccugggcccucaccugcuccgcaccgcugcaugcuuccuguccugcuuucugccgguccccugacccggaccuccaaguucagagugguggggcuuguugcggaagcgcggcgagggcuagaguggccagcuggcggagugugcucuuagaauuuggaaggggguggcagagggggcggugagaggacuggccaggguccagucaaggagaugaccaaggaggcuuucagauccucggcgcagcugcccacuagucuuuagagagggcaugcaaaguugugcuucugucccacugccugcucagucgcucacauaauuuauugcaucaaaaacuccccugggucugcggagcgaaggcuggggcugcccgccuggaggguuccaccuucugcaggggcagggccaacuugcugugguggcucccggccucccacccccgaguggguuaacccggcccuguggcccugcagccuguggaggggguguguccuaagacuggccuccccuuccagauuguagucuggggaaccuggugucggacuucccagguggccugagcuggucucuccagcucccacggggagaguuugguagcgcaaauagggagauguucuggaggccccuggccuuacugguucgauuugaggccuggaaaggaggcucugggcguguguguguguguuuggggguacccaaggcagacuggaguuggagaacugggugacugggaaaacaagguuucuagagcauggguggcgugguuguguuaaccauuggaguccuugacccaggccuggcucagcugcagacuggaaagguggaaaagccagggggaggggcggggcuggcccagcaggacuggccugcugcuuugagggcgaugguccuccuggacccccccugcucagcuggggguuguggggaggaagggacugguccuccuggaugcacaugcucuguagggguggggcugucugccaucuuggcuggcgcuggaggccugagaaguggcgaugugacgcugggcuggcccugcccccauggugucauaggacggaggccaggucggguguccagccugggccccugcagcuguggaugccgcugagcuccugcaauaaugaccguggagauggucaccccucguguaaaauuacuagugcuucuugcaaauggaaggaacugggccuuuucugugugcuucuggacgcuucauucugcacauggcccugcgcccucaccucggcauuaugaccuguguguuacuuuuguaauaaaaauaauguuuauaggaaagccgugcuuucaauuuucaacugaauuuguagguuggcaaauuugguuugggaggggcaccucuggccuggggcuuggccuggcugccccgcucacgccacuucucucccgcccccagacaccaaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucaguaaguagcugggaggggcuuccucagaccuggucaggccccuagagugaccggugaggacgcccaaccucaagccaggggagcacacuccuaggucagcagcccagccgcuugcucugagacuuugaccuucccgccgcguuucugagcacgugcggugucccagggcauccacaccagcugccuuucccaucacacgccuccuucgaagggugggccagaggugcccccuagacgucaggggcacucacaggggucucccugggcaucagaauuucuguugggggccgugaggcuccugcuccugaggcaccgcacgccuagugcagggcuucaggcucuggaggaagagccugccuuucuuccugcaccuuuuggacauucugacaagggacgugcguucggugaaugaucagaauuaaaaucaauaaagugauuuauauaauuaaaaucaauaagacaagugcaguugguggguggcaggggugagcggugcaugcgccuccuugggccccaaggcugccguggggggugcccaccugcugaccucaaggacgcuucagccuuuccucauguuucucucuugguucuccagccugggggcuggcaggugggugcauggcccauuguccuugagaccccacccccagauaggggggcuggguggaugcagaggcaggcauggugccugggcaugccugauggggcaggggaggggccgcuccuuacuggcagaggccgcacggcuuauuccaccugacacucaccacgugacaucuuuaccaccacugcuuacucacgcugugaaaugggcucacaggaugcaaaugcacuucaaagcuucucucugaaaaguuccugcugcuugacucuggaagccccugcccgcccuggccucuccugugcccucucucuugccugccccauuuggggguaggaaguggcacugcagggccuggugccagccaguccuugcccagggagaagcuucccugcaccaggcuuuccugagaggaggggagggccaagcccccacuugggggacccccgugauggggcuccugcucccuccuccggcugauggcaccugcccuuuggcaccccaagguggagcccccagcgaccuuccccuuccagcugagcauugcugugggggagagggggaagacgggaggaaagaagggagugguuccaucacgccuccucacuccucuccucccgucuucuccucuccugcccuugucucccugucucagcagcuccagggguggugugggccccuccagccuccuagguggugccaggccagaguccaagcucagggacagcagucccuccugugggggccccugaacugggcucacaucccacacauuuuccaaaccacucccauugugagccuuugguccugguggugucccucugguugugggaccaagagcuugugcccauuuuucaucugaggaaggaggcagcagaggccacgggcuggucugggucccacucaccuccccucucaccucucuucuuccugggacgccucugccugccagcucucacuucccuccccugacccgcaggguggcugcguccuuccagggccuggccugagggcaggggugguuugcucccccuucagccuccgggggcuggggucagugcggugcuaacacggcucucucugugcugugggacuuccaggcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggugaggguccugggccccuuucccacucucuagagacagagaaauagggcuucgggcgcccagcguuuccuguggccucugggaccucuuggccagggacaaggacccgugacuuccuugcuugcuguguggcccgggagcagcucagacgcuggcuccuucugucccucugcccguggacauuagcucaagucacugaucagucacagggguggccugucaggucaggcgggcggcucaggcggaagagcguggagagcaggcaccugcugaccagccccuuccccucccaggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugagcaaaacugccgcaagucugcagcccggcgccaccauccugcagccuccuccugaccacggacguuuccaucagguuccaucccgaaaaucucucgguuccacgucccccuggggcuucuccugacccaguccccgugccccgccuccccgaaacaggcuacucuccucggcccccuccaucgggcugaggaagcacagcagcaucuucaaacauguacaaaaucgauuggcuuuaaacacccuucacauacccuccccccaaauuauccccaauuauccccacacauaaaaaaucaaaacauuaaacuaacccccuucccccccccccacaacaacccucuuaaaacuaauuggcuuuuuagaaacaccccacaaaagcucagaaauuggcuuuaaaaaaaacaaccaccaaaaaaaaucaauuggcuaaaaaaaaaaaguauuaaaaacgaauuggcugagaaacaauuggcaaaauaaaggaauuuggcacuccccaccccccucuuucucuucucccuuggacuuugagucaaauuggccuggacuugagucccugaaccagcaaagagaaaagaaggaccccagaaaucacaggugggcacgucgcugcuaccgccaucucccuucucacgggaauuuucaggguaaacuggccauccgaaaauagcaacaacccagacuggcuccucacucccuuuuccaucacuaaaaaucacagagcagucagagggacccaguaagaccaaaggaggggaggacagagcaugaaaaccaaaauccaugcaaaugaaauguaauuggcacgacccucacccccaaaucuuacaucucaauucccauccuaaaaagcacucauacuuuaugcauccccgcagcuacacacacacaacacacagcacacgcaugaacacagcacacacacgagcacagcacacacacaaacgcacagcacacacagcacacagaugagcacacagcacacacacaaacgcacagcacacacacgcacacacaugcacacacagcacacaaacgcacggcacacacacgcacacacaugcacacacagcacacacacaaacgcacagcacacacaaacgcacagcacacacgcacacacagcacacacacgagcacacagcacacaaacgcacagcacacgcacacacaugcacacacagcacacacacuagcacacagcacacacacaaagacacagcacacacaugcacacacagcacacacacgcgaacacagcacacacgaacacagcacacacagcacacacacaaacacagcacacacaugcacacagcacacgcacacacagcacacacaugaacacagcacacagcacacacaugcacacacagcacacacgcaugcacagcacacaugaacacagcacacacacaaacacacagcacacacaugcacacacagcacacacacucaugcgcagcacauacaugaacacagcucacagcacacaaacacgcagcacacacguugcacacgcaagcacccaccugcacacacacaugcgcacacacacgcacacccccacaaaauuggaugaaaacaauaagcauaucuaagcaacuacgauaucuguauggaucaggccaaagucccgcuaagauucuccaauguuuucauggucugagccccgcuccuguucccaucuccacugccccucggcccugucugugcccugccucucagaggagggggcucagauggugcggccugagugugcggccggcggcauuugggauacacccguagggugggcggggugugucccaggccuaauuccaucuuuccaccaugacagagaugcccuugugaggcuggccuccuuggcgccuguccccacggcccccgcagcgugagccacgaugcuccccauaccccacccauucccgauacaccuuacuuacuguguguuggcccagccagagugaggaaggaguuuggccacauuggagauggcgguagcugagcagacaugcccccacgaguagccugacucccuggugugcuccuggaaggaagaucuuggggacccccccaccggagcacaccuagggaucaucuuugcccgucuccuggggaccccccaagaaauguggaguccucgggggccgugcacugaugcggggagugugggaagucuggcgguuggagggguggguggggggcagugggggcugggcggggggaguucugggguaggaaguggucccgggagauuuuggauggaaaagucaggaggauugacagcagacuugcagaauuacauagagaaauuaggaacccccaaauuucaugucaauugaucuauucccccucuuuguuucuuggggcauuuuuccuuuuuuuuuuuuuuuuguuuuuuuuuuaccccuccuuagcuuuaugcgcucagaaaccaaauuaaaccccccccccauguaacaggggggcagugacaaaagcaagaacgcacgaagccagccuggagaccaccacguccugccccccgccauuuaucgcccugauuggauuuuguuuuucaucugucccuguugcuuggguugaguugaggguggagccuccuggggggcacuggccacugagcccccuuggagaagucagaggggaguggagaaggccacuguccggccuggcuucuggggacaguggcugguccccagaaguccugagggcggagggggggguugggcagggucuccucaggugucaggagggugcucggaggccacaggagggggcuccuggcuggccugaggcuggccggaggggaaggggcuagcagguguguaaacagaggguuccaucaggcuggggcaggguggccgccuuccgcacacuugaggaacccuccccucucccucggugacaucuugcccgccccucagcacccugccuugucuccaggagguccgaagcucugugggaccucuugggggcaagguggggugaggccggggaguagggaggucaggcgggucugagcccacagagcaggagagcugccaggucugcccaucgaccagguugcuugggccccggagcccacgggucuggugaugccauagcagccaccaccgcggcgccuagggcugcggcagggacucggccucugggagguuuaccucgcccccacuugugcccccagcucagccccccugcacgcagcccgacuagcagucuagaggccugaggcuucuggguccuggugacggggcuggcaugaccccgggggucguccaugccaguccgccucagucgcagagggucccucggcaagcgcccugugagugggccauucggaacauuggacagaagcccaaagagccaaauugucacaauuguggaacccacauuggccugagauccaaaacgcuucgaggcaccccaaauuaccugcccauucgucaggacacccacccacccaguguuauauucugccucgccggaguggguguucccgggggcacuugccgaccagccccuugcguccccagguuugcagcucuccccugggccacuaaccauccuggcccgggcugccugucugaccuccgugccuagucguggcucuccaucuugucuccuccccguguccccaaugucuucaguggggggcccccucuuggguccccuccucugccaucaccugaagacccccacgccaaacacugaaugucaccugugccugccgccucgguccaccuugcggcccguguuugacucaacucaacuccuuuaacgcuaauauuuccggcaaaaucccaugcuuggguuuugucuuuaaccuuguaacgcuugcaaucccaauaaagcauuaaaagucaugaucu

SEQ ID NO: 15489 - RNA, 1470 nt, Homo sapiens
gucuucaggugauggcagaggaggggacccaagagggggccccccacugaagacauuggggacacggggaggagacaagauggagagccacgacuaggcacggaggucagacaggcagcccgggccaggaugguuaguggcccaggggagagcugcaaaccuggggacgcaaggggcuggucggcaagugcccccgggaacacccacuccggcgaggcagaauauaacacuggguggguggguguccugacgaaugggcagguaauuuggggugccucgaagcguuuuggaucucaggccaauguggguuccacaauugugacaauuuggcucuuugggcuucuguccaauguuccgaauggcccacucacagggcgcuugccgagggacccucugcgacugaggcggacuggcauggacgacccccggggucaugccagccccgucaccaggacccagaagccucaggccucuagacugcuagucgggcugcgugcaggggggcugagcugggggcacaagugggggcgagguaaaccucccagaggccgagucccugccgcagcccuaggcgccgcggugguggcugcuauggcaucaccagacccgugggcuccggggcccaagcaaccuggucgaugggcagaccuggcagcucuccugcucugugggcucagacccgccugaccucccuacuccccggccucaccccaccuugcccccaagaggucccacagagcuucggaccuccuggagacaaggcagggugcugaggggcgggcaagaugucaccgagggagaggggaggguuccucaagugugcggaaggcggccacccugccccagccugauggaacccucuguuuacacaccugcuagccccuuccccuccggccagccucaggccagccaggagcccccuccuguggccuccgagcacccuccugacaccugaggagacccugcccaaccccccccuccgcccucaggacuucuggggaccagccacuguccccagaagccaggccggacaguggccuucuccacuccccucugacuucuccaagggggcucaguggccagugccccccaggaggcuccacccucaacucaacccaagcaacagggacagaugaaaaacaaaauccaaucagggcgauaaauggcggggggcaggacgugguggucuccaggcuggcuucgugcguucuugcuuuugucacugccccccuguuacaugggggggggguuuaauuugguuucugagcgcauaaagcuaaggagggguaaaaaaaaaacaaaaaaaaaaaaaaaaggaaaaaugccccaagaaacaaagagggggaauagaucaauugacaugaaauuuggggguuccuaauuucucuauguaauucugcaagucugcugucaauccuccugacuuuuccauccaaaaucucccgggaccacuuccuaccccagaacucc

SEQ ID NO: 15490 - RNA, 1470 nt, Homo sapiens
ggaguucugggguaggaaguggucccgggagauuuuggauggaaaagucaggaggauugacagcagacuugcagaauuacauagagaaauuaggaacccccaaauuucaugucaauugaucuauucccccucuuuguuucuuggggcauuuuuccuuuuuuuuuuuuuuuuguuuuuuuuuuaccccuccuuagcuuuaugcgcucagaaaccaaauuaaaccccccccccauguaacaggggggcagugacaaaagcaagaacgcacgaagccagccuggagaccaccacguccugccccccgccauuuaucgcccugauuggauuuuguuuuucaucugucccuguugcuuggguugaguugaggguggagccuccuggggggcacuggccacugagcccccuuggagaagucagaggggaguggagaaggccacuguccggccuggcuucuggggacaguggcugguccccagaaguccugagggcggagggggggguugggcagggucuccucaggugucaggagggugcucggaggccacaggagggggcuccuggcuggccugaggcuggccggaggggaaggggcuagcagguguguaaacagaggguuccaucaggcuggggcaggguggccgccuuccgcacacuugaggaacccuccccucucccucggugacaucuugcccgccccucagcacccugccuugucuccaggagguccgaagcucugugggaccucuugggggcaagguggggugaggccggggaguagggaggucaggcgggucugagcccacagagcaggagagcugccaggucugcccaucgaccagguugcuugggccccggagcccacgggucuggugaugccauagcagccaccaccgcggcgccuagggcugcggcagggacucggccucugggagguuuaccucgcccccacuugugcccccagcucagccccccugcacgcagcccgacuagcagucuagaggccugaggcuucuggguccuggugacggggcuggcaugaccccgggggucguccaugccaguccgccucagucgcagagggucccucggcaagcgcccugugagugggccauucggaacauuggacagaagcccaaagagccaaauugucacaauuguggaacccacauuggccugagauccaaaacgcuucgaggcaccccaaauuaccugcccauucgucaggacacccacccacccaguguuauauucugccucgccggaguggguguucccgggggcacuugccgaccagccccuugcguccccagguuugcagcucuccccugggccacuaaccauccuggcccgggcugccugucugaccuccgugccuagucguggcucuccaucuugucuccuccccguguccccaaugucuucaguggggggcccccucuuggguccccuccucugccaucaccugaagac

SEQ ID NO: 15491 - RNA, 2574 nt, Homo sapiens
uaaacagaacugauuuauuuauaaaguucacgcucccuugaagaggugugccccacacaggcuucucccuagcagagcagcagugcccacaaacccaccccagggugggcugucacgggggccucacgccagggaccccgccccucagggacugcucguguccagaucuuggccagcauggaaaacuccagauagugggggcagggguccaggucaucuuuauuacgccccaggucaaggguucuuuguacaaaaauaggucuccguuugccagcagugucccuccagcagcucaaguuaauguguagaaaauggauucucugugcccuuagaaaauccucuccccuccggaaaaaucuccaaguguuggugccccccgccccacugcagucgagaagcuguggggaggggcggcgucggaggaagccgccagcccuuauggggccagcuccaagcccguuuccaccgcggcauuggucaggcugggccggacgaacgaggcggcgucggcggugcggggggugguggguggguccccggcucgcugggggcggagcgcgggccgguccaccuggcgggcuccccggcgaugagcgcgccggccgcucgcucggcuuccggggcugaggcugcggggggaagguggggaaccaaacgcgcgucaacgcgggcgcgggcccggggcagaccccgcccgggccggcccugcccgcaccucccccaagcgaagucggcaguuucguuugcucgguugguuuuggagucuugaguccgugggugccgcgacucggucugagacacggcgggggcggggcgggcgcucggagccgcggugagucagggcuccgcgcccgccgacucauuucugccgccccggcccgggagcgcgauuugcaaugcaaagucaccccgccuccagcaccccaaucugccccaggauccgccagcacuagagaccucaacggcccgacggccgcuccccuccccucgucuaccccucccucgucggcggcugagccgcgaggggaaguuuugcaaucccggacaaacaaacgccggucuugcacgggcuugaaaaacuuugggggaaaugaagagugagcgaaaucgaagccaucgcucgggccuggcgcucggcuccgcgggcuccugggggcgcgacccgccgggccugcccaccccgucccuccaccccggcccccggcccucccuccucccugccucccggcuguuaccucauaggucgagggcgcucaguagcccccuaaccagcuggagaagucgaguagcucgcgcuccgcaggacucagcgcgccuucgcagccgcugucguccgacgaguaggcggaacgcggggagccgggcuccgagcugcccccgcggcccggggacgaagaagcgcgggagggcgaggcggcgaccgggguggucccuggcggcccgcggggcgcagacggccgcacggccugcggccucagcccucccgccagcgcguugcgcacggcgucgugcucggccagcaggcgcugcagcgcgcggauguacuccacggcugagcgcagcgucuccaccuugcucagcuucuugcuggcgccgccgugcggcacgugcugccgcagcgccuggaagcccaaguucaccagcuucacgcgguugcgcucgcgcucauugcgccgcgcuacggccgcugcgccgccuccggucucugcgguggccggucgccgccgccggcugcagcgcaacaguuccggggacgcgggucuccgccgggcagcgcagccgacagggacggggggcgcagggggcgcggaccugggcagugugccgccguccaucgcgccugcauccacccgcccgcuccaggucccggcgcgccgcaggaaggugcaggcagaggaaccggaggcgacggggaaaacuguggcgccccaagggggcuucuggcacggcgccgccaggcaacuccccagggcacgcguccuaggucgucuggagcccggggauaggaggccuagugguggcaggccguacgcgccagggagcgugggacgcucgugucccgcgcgugcggccggacucucccaggucuccgcaggcgcggcgcaggcggcugguuuuuaaauguauagauaacccuccuccgcgccgccgccgucgccuuucucacgcccuccuuccuucgccucgcccucccgccacgcuucgcccucccccucgcgcgaucacauucuguaaggcccaaagcgugcgcaugucccccuagcccaucccccggacgcaguccacagauccccagugcgcccaacuggcgaaaucugcgaguucccggugcgcccccugcucccggcaggugcuuagugcgcccccaaagcaagguacgcagguccuggguugagccuucccguacccccacccuaaccccgcgcgcagccccgccagucccaagagccgccagaccuucgcacgcgcagcgcgcgcugugggagggaaggcgcggcccuggcgacaacacggcuguucgggaggcgcgcaagauccccgggggcagcacgcgccgcgcagcccacacccacg

SEQ ID NO: 15492 - RNA, 20172 nt, Homo sapiens
gugagcuggccggggcggggccuauggaggggcgggaccgcggcgcccuauaaguacugcggagcgaggcgcgcgcccggccagagagcgagcgcgcaacggcggcgacggcggcgaccccaccgcgcauccugccaggccuccggcgcccagcgccccacgcgcccccgcgcccccgcgcccccgcgccccuuucuucgcgcccccgccccucggcccgccaggcccccuugccggccacccgccaggccccgcgccggcccgcccgccgcccaggaccggcccgcgccccgcaggccgcccgccgcccgcgccgccaugggaguggagggcugcaccaagugcaucaaguaccugcucuucgucuucaauuucgucuucuggguaagggcugcgccgggggccggggcgggagggggcaggcacacacuccacguugggcaggucccgcggcagcgugcuaggccccgcgggcgcagcgcgggccgcgaaguuguggggccaccugugggcuccaggagcgggguggggggucgcccggggccaccgcgccccccgacauuggggcugagggcugcgagccgaguuucggggccucugugcucgggggcccaccucugcggccgggccggggcuucugggggccgccgggcaguucccgcugugguggugaugggugcgguggucgcgggucgggacccgaguacccggccgccccucagcuaaggaggggccugcgcgggucccuggccgcggauuccggacugcugcuucgcggggacgaggggggggcucgcgggcgggacuccuggcgccccgcccccaugagcucaucaagagccgccgccccuggaugguggggcgggggcgcacacuuugccggagguugggggcgauccgccucacucuuuccccagcccagcucacucuccaaucugcggucaccacccgagaccuuccugggggucgcgccuaaaaggagcgcagacucccgccgggauggcccagaagcuggggugcgcgcacccuggccgucccugccugggagccgaucucccucuccucacccagacacguuccagcggaggccuccucccagaagggcucuggaggccucgcaggaguggggaucccgcgguucugaguuggcacaaggaagagaguggcaccaggggccuggaguggauggcaggguccgggaguggggccgcugcuuugcaagaggggcccccacgcugggcaucuuugggugccagcguggguggaggagggucuuuugcugagaauggcuuucuccugaccgcagucuuugcugcugggaagugacugaugggcuuucgccuuuuguuuccauuuccugucgguguuagaauuggggaggggguggaaaucccuucuuggccuggaaggacuggaguggguguccauggccgcggccuccccguggccacgccccugggcauagacugcaagccccuccccgugccccccaggcugucacccccuucucguggaagacucggcugaugucccaguggaccgaguguuucucaaguugaggcagggagggcaaacuuuuuaaauggccccuggagccagugugugggaccagagacaucuguuucccaucuggacggcugaggaucccagugcggaugauuauuuggagggggaaggacggaggcugaacugaacucucagcugggagaugaguggggcagucacaucccaccuuccccaagccgggcuguucugcacagccugcuugggacgcuggugggagucacuguggccuucggcacugcccuggcagugggggcagcuaggccauuugggaggggcucgccuuccccaggcccggcccugggaccucagccguugcuuagugguggccugcuucagcccaggcaugugggagaggcaccagacacaggaugucccucugccagccccugaagccccguccccugacgaggcgaguguggaccugggggugggggcugagggagacuguggaccugggggugggggcugagggaggguguggaccugggggcaggggccgagggaggguguaggccuggggguaguaggggcugagggagaguguggaccugggaguaggggcugagggaggguguaggccugggggugggggcugagggagaguguggaccuggggguaggggcugagggagaguguggaccuggggguggggguugagggaggguguggaccugggggcaggggcugagggagaguguggaccuaggggcagaggcugaaggggagucacgggaggggacuucuccggagguggauuuuugcucucuggacggugugucagcacugggugagccccuccugccugcccaggcugagaggucucccuggcagcccccugggagugucgccagggcgggccuggaaguuucccaggcagcugggguggagaccugacacaucccaagggugcuuguuauuaaggcucaaggaaaugucucugaggccucaccgcuccucuccccagggccugcucccugcaaagcauugagaacugaguccguccacagucacuguggacccacccauccacuggggcucagugguagccagcaaugccaggcugggugaggugggguuggugggcaccacccugguggaccccccuccacccuggugucgcaggguguguggcugagagcacagugccaugggcuugggccuccuugguggaguccccaacacacugcucugguccugggccucggccuuccccgucugcagugggggcccacagugagccuaccuccuggugguguugguggauuugcugacaugccugaguguugacagggggcuuggugcaggaagggcucagggcguggguguuggccagggguccaaagggaccucugccucagagagcccagcccagacaggcaggaugugcaguggggaaggggcugcgggaacccugcaggguccagaaggacacagugcaguccugugggcucuggggaggcugguggggaggagguugacaauggauaucuggguggggcacuuguuagaaguuccauuuuagagaggaaagaggccuugccugugggagaaggcagcugggguagccugaccucuuucccaggaaggagcccacacacacacgcacaggcacucacacacacgaaugugcacacacacacacucccaccuucacacacacucacacucuugcugucucccuucccaagccaaggugcgagggggaaggucugggcagcaugcaccugcgcccugaccgcuuugggggccagugagaacugggcucccugggugcgcggcgggcccaagcagggaggacauugcagaugcccuggccaagcagcguggaaauccugucccuugggugggucucggagccuccaucagaggcggcuggcaccugagacccaccugcugccaggagcagggcaggagaguuugugucccgggacagggaacuggccugugggagccuugccuuccucaucuguguaauggauauaagagucuucuccucgggggcuggccagggaguccagaagaggugucaccaguccccgcagggagaagagcggugucccccgccugggacuggcugcucccccaagcuaaugcagcugguagccaccucccaguggcagggcagccaaacccggccgggaaagagacugauuagaagccucgcucacggguauuucucgcuuccagacagcacaugacugucauuuggcacgucuuucgccguccuuccgggagaggggcugcaacccuggcaggcgcugugggggagggggcuaggacauccugugccugguuucaccaaguggguguguggacuuucccuggcucccccaggcugucuggcugcacagcuuuggggaaacggccacugggucaagcgggccgagaagaggaagucugugguuugucucugcuacagacuggccccagugaggcuguccagcagugcagggcacagagcaaaagcagggagguaugggccuacuuccccggucgccccuguggcuggcuguggcucugccgggugcugacaagucacucgcccucccugcggucaccagggugcaugcccgaaagcccuccauucuuuccuggguuugaggguccuucuccugcacccaccccagcgcccaguucagcucaacuuucagaaaucugguucacccccaaucccuuucucauaacugcuuccaagcccagacaaggagacagaccccaaaagaucccuaccccuauuuccgcaccugaaaucgcaccacgggaagagcuuugcucauagagucaauaaggcuuagaguccaggcgccugugcgagggagcaggucaucacccuuguacccaccgugguuuuagacaggacccugagguugggguggggcuggggcuggagaggagccaggugcccugccccuugcuugggccccgugucccugugauccaggcugggcgugcuaugggugcugggugauauuccagcccugcagguguccgccuuguucccagcaccccucugggcaagaagaaccaggcucucccagaaaugggcuucagugaucuccacuuccaagucguccccaccugccuuguaggacacagugguaccugguaugcugggcagccuuccaggaaccucuggacuuacucagugucccccagcccuacacaccauucuuuguguuucugggcccaaacuaagccccccaaccugggcugcagagcaagugcugaaucaugagagacccuugaggguccuccagguaggcccccagugcuggaggaguccccucaggcagggggccacgcccaaggguguggaaggucagcuggcagccggaucucacuuuuggggcuguaggcuuccugcacuggccgccaaugccauggccgugggauggccaggauaaggcaucugccccccacccccaccccccgcacaaggucuuugagggcugcgggcucaaggaguuggcgguagggcugggggaccaggggcacagagcuuguaagcgccucucuccaggauguggguggcccagcaggggagcuuugagaguccaggugugagauuccaaaugcuaggggccugagaggagggagccaccagcuuggccagagccugguggaucacgcccccaccacgccuugcccuucucucuggucaugugcucucccaccacguuuggaaaguuacugcuucccucuuccucagccccucgggcucccaguuauggaaguggcgugauucagagaagguaaaggaugggagggagagggcugggugaugggggaccccgcagggcgcccugugcuguuacauggagcuccaggaucagggcaggugggcagccugggguccucacuucucuccccagccaggccaggucccucacagcccugccaggagcaugauauccgcugcggugcagaacuaaucucaaagcucaaacccagguaacaguguagguaaaacagaugacagggcaugagacucaccccaggacaggcgaaggacccaggccgaugggggcccagaacaguccugauccuggagcuccuucccgagugggaccccagggguuuccgaggggcuuagaguagggcuuagaggcuuagaguagggcuagggacuuccuggcuucccugccucgggaacagcugguccuggaaggggcuugguccucggggcacuggugcccaccaccccugaugccugggagacaccagcauccucugagcaugugugcguccuccuggucccgagggaagugacuccucacaucccccagcuggcggggccagagggccagcauccucgccugacaccuauuuuuagaugcugagacaggcggcuuccucggggccaggggcccugugaguggagcuuccgcuuccuggccuaggagagaauuccugcuccucuucccuccaugcugccuuuucgccccuggaggccacaacggggucagaggggcagcugcucaccaccuaggagggccugagagggcccuacgucacccagggaggagucuggccccguccccaaccuccacacccaggccuggcacugccccuucuuggugggcagagagugagggguuggccugcagggacccaggcuggaggggccguucaccuccggcccccagcgucccuuccuggaagcaccuuggugagccccuccccuccuucacccaguaucuccagggguacuuccuccuuuccuuccugccucagggccucacuguccuccuggggagggugucucaggccccagcaccucccaguggcugagccgaaugggcacuucccgguguguuucccauaugugcagucccuaggugucggugagcaggcacagagcccgcagcguggcccugccugguggacccccuccccaagagcaucaagggagggccuggacuagagacacacagaugcccagccuguacguaaaggcgggugagcugauguaccaucguccucgucccccacuggggugccugggcaggacuuggggugaccacuuggcccgucuggguggggguaagguauggguggggcgaccagaucccugcccuuuccugcagcugugggggugugugugcuggccuggagagcucccacccgaaguucuggcuccuggcuguccggggccugcgggggcagcgagcagcuggcauggguaggggagcugaccuaggccugcccgggcagcgccugcugccuuuugcucccuuucagcugcuucuuggaaacagcggacaggcugggcaggaacccagugugcuuggcagccccccuuuuaaagucgauucuguuauuuauuaauucccaggaaggagaaagaaagaaacaauccuucauagaguacaaacacugcuuuuaguagccuugcaaggagcccuccaggaaccccacagguuaccugggcuccauccugagagccacccuccauccccaauccccagcagagcaucuugugggguggggcggcuuguggggcggggcgccuugggaggcggggugucucgggaagcggggcgucucgggaggugggguggcuugugggguggggcauuuccugggguggggcgucucguggggugggacagcuugggggguggggcaucucgggaggcggggcgucuugugggguagggcggcuugugggguggggcaucuugugggguagggcggcuugugggguggggcaucuuguggggugggacggcuugugggguggggcaucucgggagguggggcaucucuggggcccggccacuugggaggcggggcauccugggggcggggcaucucagagggcgccuccggaggcuggaguaucuugggaggugggagcagguggcagagaggcuucccacaggugagcuuugagcagggaggugccuguauggauggcucuguggggagaggggugacaggaguuccagauuccggcacuuaugaaaccucacagugauggagagccgagugcugcugugcaggcuaaguugugugcaugucagcuucugcacuuuuauuuccuuguuuguagacaaggcagagagaagcugagaugggccugaggucgccuuggugaaaggcacucagcagccagggccuugggcugcccucccucaucaccgugaaagcgggacucucuuuuaacugacaucgggcuccauaguuacuccaguccuaacuuugauggauccuaaaagugcacuucuaaggacgcggcuucgguguuucccaugccgcugcuugccccugggaagcguuggcucugccucggaagaaguuagcgccaagauggcagccuggggucuuuggggcccagaagaaacacuggccccggggaguucagucaucagggacuuaggaugugggggcuuuucaaacagcuuuauuuagacgugauugacacacaguaaauacagauguuuaaggguacaacuugguaaguuuugacaaauuuauacccccgugaaaccaucaccaacuccccaggugccccuggggcccuugggaucucugcuuccugccccuccuccccgucccagggcaaccacgggccgucgcugugggugcacacagcaugcauuucuucaacaagcggacucagaaggcacuugcacaucguugcuguucugccucuuugcuucagcaugauuacccagaggcgcacccgugccguggccugcccgucgucuaugcacccgugcuguggcgugcccgucgucuguguggcaugccugucugugcacccgugcuguggcgugcccgucgucuguguggcaugccugucugugcacccgugcuguggcgugcccgucgucugugcacccgugcuguggugugcccgucgucugugcacccgugccguggcgugcccgucgucugugcacccgugcuguggugugcccuucgucuguuccuuuuauugccgggcaggguugcacccacaugugcaagccagcgacggaccccagguucacccguucaccggucagugggcauauggguuguuucaguuuggggcauuuacaagaaacgugcuagaacauuuguguacaagucuugugugaaccuaaguucauuucucuuggguaaauaccugugcguggagcagcugggucauguggugaauguggguuucacugcuuaagcagcaguuuuacauaacugccaaacuguuauucaagguggcuggaccguuuuacagcccccguuguaugcgucccaguugccucccccagcagcauguggugugguuggucuuuuucguggcagccaguccacugggugcgcucggcauguggcugcagcuugaccuggguuuccuggucccuggcaagguggagcaucucuucaugugcuuuuuugcuguguguggaucuugcggggaagggucuguuccuguuuuuugcccaucuuucaaagauuggguugccaguuuucuugcuguugaguuuggaaagcucugcauacguucagggcacagguccuuuaccaggcucugccccaggucuuucggagagcaggugucuuucgcauuccugacucuggggaaccucuagcccugccacaugggguuuguuauggggcaggggcaccugugccuuucccaccacggggcuuggggauuuggugcugccauugcccucccucguagguggcccuaggggggucccuccgccuccguuuccucauccagaaaccggcagugaccaucaccaccauuguugucaccuagcuccagcucaaggucccugcugaaggucggagagcuuggcauggccccguuuguccaugcuagggcugggaagaccaaggcucaggugaggccucugcccagugccuggcacuccuucuugccccauuuuuccacccaggguggcucccgacuacuucugguagccucggggacaguugagguggacaggcuggcgucacccccauuuccggcugucccucccacccccuccuggcccagcuguucugcccuauuaaaagucacaugggcccucggguccuuccugguguuggcccaggcucuuucaggcccugcaggccaggaccagccuucccugcaacccucggcagaggccuggggccggggcuugucuaggggcagccuccccauacggcccuggagucugaacagaagccccuucccagagcacagcaagaagcugcaacguggccugaagucccaccauuagcagguuugggguuuaggcugagcuuugccaucacuaccuuucuguuaggacgguaugcccauuagaugggaucauccccucagcgcccaggcuagaggagggguggucccugcccagccagggagggcuggggguggaugggccucuacagagcagcuuccgagccaggcacgguuccaugaucagcucuguuuuauagagggggacacugaggaaccgggagccuggggaccuuccaguggccccacagcuccuguggcugagucaggguuugucaccaggccucuguggggaugaggcucccccauccaccugccccacucuguccuggaacagcucucaaaacggucucuggaccacaguuucaaaagaaaauaagcaauguuuucaaaggcccuggaggaagccagaguuaccacggcaacucucggccucgccaccuccucccgccaggcugcaucuggagccagcucaggagggcagcagggugaggacagccaggcucucuggggccaccccccagcccccacccuuccugccucuccugcacuguccacggcccucccugugcucccacggguauaaugggcacagaagaaccaggagcugucugccccugcaggauucuggaagccaggggccccuggccucccuggggccuugucaugugaggggcacacguggggucccagcugccacauggcuuccagcgcugcccgcagguguauguugggcccuuggugacucuaaugcaccuuccacucggcacagaagagcuucagucuggggccugggcgggggaaguaggcugccauccucgcuaaaccaaagugugaaaauugaguugaaacucccauaggagggcaggaggcacagcuccucagaagaaggucugagaaaccacagcccagguuguuguuucggguguguggagaaggugcucuggcaguccugcuacagggggaccaucaacagccccuuuggggugagagccccguggcugcuggcaccagcagccccuaugaggcuuauuuuauuuuugagacagggucuugcucugucaccgaggcuggagugcaguggcacaaucauaacucacuguagccucaaccuccugagcucaagcgauccuccugccucagccuccaaaggugcugggauuacaggcgcuugcuaccacgcccagcccccucuggccuuauuguuugccaggcccagcucaggucccggaggaggggagacaggagugugagggaaagggggaagagguauagagcccccagcuccuccacccacccgaacccucaccgaggcccuagacccuagaccggccugaccgggggguccucaggccggggacuugggugcaggccauggugcuggggccugaagcucacgcucugcugagcacagcccccugcccaaccccacccuggggcccugcuucccuggccagggccauuggaacaggaguggggcuguccaggugguguucuuggguccagcccucaguuucucuucugcaguugaccggcagcccugcaucugugguggggucggcgccuggugcuggugaggcaaggccucagcugcugggacaggaccugccuggcacccagcugguggcagagccaagcauuccgacucagcucugggagcagcugccuucugggcuggcauucuccgccagggggguugugcccucguggccccccccgggugccuccucaccuggcugauuucaucuccugucccccugccuccuccuccaggaagcccccagggccuggcccuccuugagaguggcauggaggaggaagaagacucgcccaggcccaugggagucggaugguggccgcacuuguggggcccugaccccauaggcuucuucagcacgcccuggccugggugaucccugccugagggcugugcacggcucaucugccagaccagauuuuaggggauucuuguacuguccuccuggagcagcaggggguaaagccugacccacccagacuguccagcaacaagggccuccugcugugggccagggacccuggaacugaccaauuguguccuagggacgcagaguccccaggcugcuagagggcuguggggcccuguuucaugccugaagcaggaagaaaccccaggagaggucugaaggggacccagcccccacccugucuagcagggaggagccucugcaagaggccgaggggugcugaaguggaggaggauagaggcagcaggacucagggucacuggucauuuauggggaucacacggcugcagugugcccugcauggugcuaggcaccagggacagcagaggacaagccuguguccucucccaccaccagagggcugggcacugccccuagggagagagggggccuuggugugugcagaggggggccuggggcacgugccuggccuggucagaugaucagagugggcugggcugggccuggucuggggcccagucucaagggcagaccccaccuggcuagaguugauugugugcacaccggaugacccggcguugaaggccucuccucucugugagccucauccccaccugccagacucccagcacagccugcuuccugccccagcugcugagcgacagcgcugggccggcuucugcgcgccccuucccccagcccaucuuggaaaccacagcagcguccuuccucccaagucccuucccagggcugacaucccacagcagggauguaucccacaaaccccgcaggcccuggugccuacagcuuggccugguaacaucaaauccuacccucuccuccuggcagcaaagauggggugcccccaccccagaguucucagcacccccagacagaagcagucccccagcgaccucagaacucuuggggcgcugccacacccuugcaggagggggcaguguuccugggaugcucagguccugguaucaccucuggccagauacggaaggugaaacuacagggcauccaauucaccuugaacuucagauaaacaccagauuauuuuuuuguaugucccgugcaauauuugggacacacuuacccuaaagaaguauucuguuuucaucugagaggcagauuuaaccggcgucccgugucuuccuggcaguccugcccuggagucacacuccacaggugcagggcagggccaggcuccaaguagauggcggccaaagcacccgccccaugcuccugacucccggggcucuucagggcauugcgaaaaccagcagcagagcugacaccuggucccugcucgggagccagcaaggcaggaggcugcuuaggccuugcguguggggugggcgcacucccugcugcagugcucuucguacaugugacacuguucccgcucuuucccagcuggcuggaggcgugauccuggguguggcccuguggcuccgccaugacccgcagaccaccaaccuccuguaucuggagcugggagacaagcccgcgcccaacaccuucuauguaggugagugcacauguggccgcagacgcauucagggagggcuucuaggaggaggcagguccuagccuuuuggauggggacauggagggugaaagacagucgggcauggcguguccgggcagggaggcggcccuggaaagggcucugggcacaaggguugagauggaggugggccuguggccugcuggcccuucuggucugagccagggcaggggguggcagcuaggccugggcagggacuguguggagaccuugcuuauuuuaagugugggguuauuucgggggaggcucccugagaaggguggggcuggaugccugggccacacagagcagccgaggcagcuggcgcuguggagcccgggagggagggagggauggagcucaagggauggaacccagugagggguggagacggggcaggggagggguggagagggguggagacgccccagaggcggugugacucagcugccccugcaggcagcugcaccuugcugccuuauuaggcugcgugugggggacugggcugcccucccugcccccaggagcaggagcaggagugauggaggaggaggaggggaggggcaaggccaggaggaggaggagggccaucucacugugcagagagcagcacccuuccuccuggugccccuggcagggcuggugcugguggggcucugggagcauuuguugagaugcuucuggccuugaaaggaggccccugggauggcucuguugcccucacaggcugaggggugggugaggugggcagccuguguguccccaguccucagggcuucccucagccggcaggugcccccaggccuggagcugcagggccaggcccccugccaguuacggaggcugcuuggcuugguugcugaaccagggccccaggaggccgaaauagccccacaccugcgccgucccaccucuuuguccagucaccccagggccaggugagggcccuggccacacagcgugcccguuccuucuuccccaugccccgcucaugggucagagggccggugcugggguccagauggugucaacagggauggucccuguccuccccagagacagaagccuguggcccacggaggguuucugggcccagccgauccuagggagggucccauggcccugcccauagguuccuggccucucucggggccguggugcccucacagguggugucaggaaggacgggaaaggcugcuugucccaggggcucauguggagaccacccccugcacgcagcuggggcgcuccugccuguguccucagaagcacucggcuuagcuuugcccaugugccugggcuguggguggcagagcccggccagcauccuccgaucuccaagggugcaucucuacuggaggccccuccugggccucuugcuccccgcuucccagaucauuaggauauuugggguccagaagggccucccagccauccugggccuuguccuccggggccaccaguccagccagugacaaccacagcauccccggccuggaacgaggcugcccccagcacguuccucguacuccuguccagggacaggaggggcugccccugccaccgaguccccuucuccaggaccuggggccugugggugugaggcagguguucuuggaaggggucacucuccaggcacccggcggccaaggcuuguggcuggagcagcucccgcuguggggucggcgucgggccccguguggccggagaggagcugaagggucacuuagcuucgggcuggggcgaggacaggggacaccccagagagguaugccaggccuccuuccugcgccccacucucggcagaagcagaggucacaggcugugcugaggccccauggugcugcccccaugaugccagggugaggcuggcguuggaagcaggugucugaccugcauggugucaccguggccacaucagagcuccagccccagagccgcccacccucgguccuuggcugugguuucccugggcuggaggagccugccguuguguuggccacacgaccacaggaccugccacccccgacgugggcucugccugggcccccacuggacagggaccccuuggagcuccucuggccaccaaguccucgcccauuccagaaucggccuucuggagccucuugcugucccugaugcgggcugggccuugccaagggcuuuuuuuccugcgccgggaacaggguggauuugcugggcucacuccccucagagacgcugcgggugcgguggguuaggcccaagggcguuaagagaggaggcugggguggggcuggggccuggcagggggucuggcagcccugggccucccaccuccugucaggaccaaaaaaggcaacgcgccucuccugaccuguaccccggagugaacccaaccuugcaacccaggagugucagggccugaggggagggagaccuggcuccugggugccgugcccguaaggagguggccaccugcagggcauuccuggcagaggcuucaucuggccagguaggaggcuggguggccgagccccaaaucuggguguguucucugccuggcgguggguccugccccaggcaccuucuccucugggcuggcugggcagggacaaugggccuggcugcgaggagggggccugggcugccuucugcauugccucggugacgggagauggccccugccugcugagggauaggggagugggcaggcagugagagacacugacagcugucccgcggguacagggcccugucuggguggccaggcccaugucucgggcccacagugcgccccccacccuuggacggcgccuucucccuccccaggugcaugcugcccagccagggagcgugggggaguucgggagggcuggccuacacgcccugguccagcugucccagguggggugcugggcuucagcccucagcccagggccuaggaauccaacuugauccuccccacacagcagccagguucaaaugcaggucccguaacggaagugcugcugugcagcccagauuggggggcaggagccagcagggcccccccacccucuucucgcaccacacuggggaggcagcauugguuccaguuccgguuccugggcugcccucucaaccccggccuacaguggggcccacccugugccuucugaugccacucccaccccacgccaagucccagaggcuuugggagcgggugaaggcgguggguggcggguggcaggugcaggcggugggugguggguguggcagguggcgggccccaccgcaggugucaucccugcgaagcaccugucgccagcacucagagcgcucaugaggugcccaguccccauguggccuccuuagucuccguccugugucauggaagagguaacugaggcacagaaaacucaccaggccaggcugggaugugaggucccuugcugcucaucccuggcagucagcaacccuacaucuucccagcugggcggcccgugguggguucggcacccaggacccuccggggucuugggcuguggcgaguguguaggcacccaccuggugucucucuccccgcaaggcaucuacauccucaucgcugugggcgcugucaugauguucguuggcuuccugggcugcuacggggccauccaggaaucccagugccugcuggggacgguaaggcagggaggcgggccugugccugggccggggaggggcugggggcugcgucuggcccugaggagggggcagagcuggugcucagggcggagccuagaauucugggggagguggcuccugugcccugcuuuucccguuugguuuuuaaauuaaaucccaccgugcuuggucuccaucguggccaguuccuacgugaccgcuuuucuuugucaaaaaauagccacaaauauaacagggagcaagccucagcucugaggccagccucggcgucccgggcacaccgcccccugugggaagcccaggccuggcugugccauccagggccuggccaguccaggaagagggagccuaugcccgugucuccagugggggaaacugaggcagaucccauggcucccccuuccguggggagcaggaacaaggggguggggaagaucagucaggggucaugcugcugcacacgccucccugggggcugcagacauccuggacucaccagccugugaccccaaaccacacgccccgccccauccaccccguccuguggagccuggugccgcguggggacauccugggcuuugacggcuccucccugcgcugaguuuuagccucugugccccagggcuccacacaagccgcucacuccuggucaggucgugggcugguggcucccacuagccccucacagacacgccugcugggcaccuggguguguguccuugggccccgccuacagccugcccucuuuccucccucuggccacugcccggcuccaguucuucaccugccuggucauccuguuugccugugagguggccgccggcaucuggggcuuugucaacaaggaccaggugagccugggugugcagggacaggguggggugggugacgggggcacccuccucuccugucgcggguggggguugggcugacucauggcuugugggagcucuuugggcucuuccugggucccacuugccaggaggaucuccaggggcuuuauggaggaggcagcauuggggcugagcaccaggccagccucccgugucccagcacucccggggcagcugagagugcagaguccuuguccucuggggucuagccucgaagccacccugcccagggagagccugggaaaagugcguccgccuggggcggggcggggugggggcaaggagggggagguucccccugugcaugugaccgcaccccucccccagaucgccaaggaugugaagcaguucuaugaccaggcccuacagcaggccgugguggaugaugacgccaacaacgccaaggcuguggugaagaccuuccacgagacggugcggccccggggggcgagggcggggagcagggccccgggaacccggcggggugugucucguccuggaugaauccugccuacgcccagaccucaggagcaggaggugcccuugggaccuccaggaccccuggucucaacugguccucgggugggaaccuagugggccaggguggcccagggugcggaaagcucugagcagcgcagcugaggaggaagaaggcuggccccuggaugcauucugcaguggggagcgcugcguaccccuggccaccuccccauggguucccuagagccaccgucccccugggcacauccagggcugaccuugcaccccugcucucugcagcuugacugcuguggcuccagcacacugacugcuuugaccaccucagugcucaagaacaauuugugucccucgggcagcaacaucaucagcaaccucuucaaggugcgcgaggccgguggggccgcgccugaccccccgcaugucccgccccugggugggguccuaggggugggcaggucacacggcagccccacagggagcgaccacacuggguggcauggccccugucagggcugcucugcugggaggguuggggugggaccgcaucuggcccacgaggaaggcaggcgcccugugcugcgcauuccgggugaagaagguggaggcucuggggggugggaacucaccugcacccccagcuccacgugugcacucguggguguggacgccccugacagccuguagcuggcagggccugcaggccauauagugcccuguggaaguuuccugcugaggccucaguggaagucgucaucagugaugcuuuaggggucuagugacaccaaugaccgugaucucaguggaaaagggcacagugugucccaggcauuucgcguuuauguuaaaacggguggaagauagcaagccggcagaggccgggccgcugcacccgccuguuccgagguggguaggggguggggggcuguucccaggauuccccucuacgcuuucuguggugaccacggauuacugcgugacaacgggaagccgggagccgaggcccggucccugaccacgcgugccuggccaccccugcaggaggacugccaccagaagaucgaugaccucuucuccgggaagcuguaccucaucggcauugcugccaucguggucgcugugaucauggugagcgggcgggggcggagggccugcucucugggcugccccuuccgcggggccuugugcugacugcgccccccaccacccuccugcagaucuucgagaugauccugagcauggugcugugcuguggcauccggaacagcuccguguacugaggccccgcagcucuggccacagggaccucugcagugcccccuaagugacccggacacuuccgagggggccaucaccgccuguguauauaacguuuccgguauuacucugcuacacguagccuuuuuacuuuugggguuuuguuuuuguucugaacuuuccuguuaccuuuucagggcugacgucacauguagguggcguguaugaguggagacgggccugggucuuggggacuggagggcagggguccuucugcccuggggucccagggugcucugccugcucagccaggccucuccugggagccacucgcccagagacucagcuuggccaacuuggggggcuguguccacccagcccgcccguccugugggcugcacagcucaccuuguucccuccugccccgguucgagagccgagucugugggcacucucugccuucaugcaccuguccuuucuaacacgucgccuucaacuguaaucacaacauccugacuccgucauuuaauaaagaaggaacaucaggcaugcuaccaggc

SEQ ID NO: 15493 - RNA, 20172 nt, Homo sapiens
gccugguagcaugccugauguuccuucuuuauuaaaugacggagucaggauguugugauuacaguugaaggcgacguguuagaaaggacaggugcaugaaggcagagagugcccacagacucggcucucgaaccggggcaggagggaacaaggugagcugugcagcccacaggacgggcgggcuggguggacacagccccccaaguuggccaagcugagucucugggcgaguggcucccaggagaggccuggcugagcaggcagagcacccugggaccccagggcagaaggaccccugcccuccaguccccaagacccaggcccgucuccacucauacacgccaccuacaugugacgucagcccugaaaagguaacaggaaaguucagaacaaaaacaaaaccccaaaaguaaaaaggcuacguguagcagaguaauaccggaaacguuauauacacaggcggugauggcccccucggaaguguccgggucacuuagggggcacugcagaggucccuguggccagagcugcggggccucaguacacggagcuguuccggaugccacagcacagcaccaugcucaggaucaucucgaagaucugcaggagggugguggggggcgcagucagcacaaggccccgcggaaggggcagcccagagagcaggcccuccgcccccgcccgcucaccaugaucacagcgaccacgauggcagcaaugccgaugagguacagcuucccggagaagaggucaucgaucuucugguggcaguccuccugcagggguggccaggcacgcguggucagggaccgggccucggcucccggcuucccguugucacgcaguaauccguggucaccacagaaagcguagaggggaauccugggaacagccccccacccccuacccaccucggaacaggcgggugcagcggcccggccucugccggcuugcuaucuuccacccguuuuaacauaaacgcgaaaugccugggacacacugugcccuuuuccacugagaucacggucauuggugucacuagaccccuaaagcaucacugaugacgacuuccacugaggccucagcaggaaacuuccacagggcacuauauggccugcaggcccugccagcuacaggcugucaggggcguccacacccacgagugcacacguggagcugggggugcaggugaguucccaccccccagagccuccaccuucuucacccggaaugcgcagcacagggcgccugccuuccucgugggccagaugcggucccaccccaacccucccagcagagcagcccugacaggggccaugccacccaguguggucgcucccuguggggcugccgugugaccugcccaccccuaggaccccacccaggggcgggacaugcggggggucaggcgcggccccaccggccucgcgcaccuugaagagguugcugaugauguugcugcccgagggacacaaauuguucuugagcacugagguggucaaagcagucagugugcuggagccacagcagucaagcugcagagagcaggggugcaaggucagcccuggaugugcccagggggacgguggcucuagggaacccauggggagguggccagggguacgcagcgcuccccacugcagaaugcauccaggggccagccuucuuccuccucagcugcgcugcucagagcuuuccgcacccugggccacccuggcccacuagguucccacccgaggaccaguugagaccagggguccuggaggucccaagggcaccuccugcuccugaggucugggcguaggcaggauucauccaggacgagacacaccccgccggguucccggggcccugcuccccgcccucgccccccggggccgcaccgucucguggaaggucuucaccacagccuuggcguuguuggcgucaucauccaccacggccugcuguagggccuggucauagaacugcuucacauccuuggcgaucugggggaggggugcggucacaugcacagggggaaccucccccuccuugcccccaccccgccccgccccaggcggacgcacuuuucccaggcucucccugggcaggguggcuucgaggcuagaccccagaggacaaggacucugcacucucagcugccccgggagugcugggacacgggaggcuggccuggugcucagccccaaugcugccuccuccauaaagccccuggagauccuccuggcaagugggacccaggaagagcccaaagagcucccacaagccaugagucagcccaacccccacccgcgacaggagaggagggugcccccgucacccaccccacccugucccugcacacccaggcucaccugguccuuguugacaaagccccagaugccggcggccaccucacaggcaaacaggaugaccaggcaggugaagaacuggagccgggcaguggccagagggaggaaagagggcaggcuguaggcggggcccaaggacacacacccaggugcccagcaggcgugucugugaggggcuagugggagccaccagcccacgaccugaccaggagugagcggcuuguguggagcccuggggcacagaggcuaaaacucagcgcagggaggagccgucaaagcccaggauguccccacgcggcaccaggcuccacaggacgggguggauggggcggggcgugugguuuggggucacaggcuggugaguccaggaugucugcagcccccagggaggcgugugcagcagcaugaccccugacugaucuuccccacccccuuguuccugcuccccacggaagggggagccaugggaucugccucaguuucccccacuggagacacgggcauaggcucccucuuccuggacuggccaggcccuggauggcacagccaggccugggcuucccacagggggcggugugcccgggacgccgaggcuggccucagagcugaggcuugcucccuguuauauuuguggcuauuuuuugacaaagaaaagcggucacguaggaacuggccacgauggagaccaagcacggugggauuuaauuuaaaaaccaaacgggaaaagcagggcacaggagccaccucccccagaauucuaggcuccgcccugagcaccagcucugcccccuccucagggccagacgcagcccccagccccuccccggcccaggcacaggcccgccucccugccuuaccguccccagcaggcacugggauuccuggauggccccguagcagcccaggaagccaacgaacaucaugacagcgcccacagcgaugaggauguagaugccuugcggggagagagacaccaggugggugccuacacacucgccacagcccaagaccccggaggguccugggugccgaacccaccacgggccgcccagcugggaagauguaggguugcugacugccagggaugagcagcaagggaccucacaucccagccuggccuggugaguuuucugugccucaguuaccucuuccaugacacaggacggagacuaaggaggccacauggggacugggcaccucaugagcgcucugagugcuggcgacaggugcuucgcagggaugacaccugcgguggggcccgccaccugccacacccaccacccaccgccugcaccugccacccgccacccaccgccuucacccgcucccaaagccucugggacuuggcguggggugggaguggcaucagaaggcacagggugggccccacuguaggccgggguugagagggcagcccaggaaccggaacuggaaccaaugcugccuccccaguguggugcgagaagagggugggggggcccugcuggcuccugccccccaaucugggcugcacagcagcacuuccguuacgggaccugcauuugaaccuggcugcuguguggggaggaucaaguuggauuccuaggcccugggcugagggcugaagcccagcaccccaccugggacagcuggaccagggcguguaggccagcccucccgaacucccccacgcucccuggcugggcagcaugcaccuggggagggagaaggcgccguccaaggguggggggcgcacugugggcccgagacaugggccuggccacccagacagggcccuguacccgcgggacagcugucagugucucucacugccugcccacuccccuaucccucagcaggcaggggccaucucccgucaccgaggcaaugcagaaggcagcccaggcccccuccucgcagccaggcccauugucccugcccagccagcccagaggagaaggugccuggggcaggacccaccgccaggcagagaacacacccagauuuggggcucggccacccagccuccuaccuggccagaugaagccucugccaggaaugcccugcagguggccaccuccuuacgggcacggcacccaggagccaggucucccuccccucaggcccugacacuccuggguugcaagguuggguucacuccgggguacaggucaggagaggcgcguugccuuuuuugguccugacaggaggugggaggcccagggcugccagacccccugccaggccccagccccaccccagccuccucucuuaacgcccuugggccuaacccaccgcacccgcagcgucucugaggggagugagcccagcaaauccacccuguucccggcgcaggaaaaaaagcccuuggcaaggcccagcccgcaucagggacagcaagaggcuccagaaggccgauucuggaaugggcgaggacuugguggccagaggagcuccaaggggucccuguccagugggggcccaggcagagcccacgucggggguggcagguccuguggucguguggccaacacaacggcaggcuccuccagcccagggaaaccacagccaaggaccgagggugggcggcucuggggcuggagcucugauguggccacggugacaccaugcaggucagacaccugcuuccaacgccagccucacccuggcaucaugggggcagcaccauggggccucagcacagccugugaccucugcuucugccgagaguggggcgcaggaaggaggccuggcauaccucucugggguguccccuguccucgccccagcccgaagcuaagugacccuucagcuccucuccggccacacggggcccgacgccgaccccacagcgggagcugcuccagccacaagccuuggccgccgggugccuggagagugaccccuuccaagaacaccugccucacacccacaggccccagguccuggagaaggggacucgguggcaggggcagccccuccugucccuggacaggaguacgaggaacgugcugggggcagccucguuccaggccggggaugcugugguugucacuggcuggacugguggccccggaggacaaggcccaggauggcugggaggcccuucuggaccccaaauauccuaaugaucugggaagcggggagcaagaggcccaggaggggccuccaguagagaugcacccuuggagaucggaggaugcuggccgggcucugccacccacagcccaggcacaugggcaaagcuaagccgagugcuucugaggacacaggcaggagcgccccagcugcgugcaggggguggucuccacaugagccccugggacaagcagccuuucccguccuuccugacaccaccugugagggcaccacggccccgagagaggccaggaaccuaugggcagggccaugggacccucccuaggaucggcugggcccagaaacccuccgugggccacaggcuucugucucuggggaggacagggaccaucccuguugacaccaucuggaccccagcaccggcccucugacccaugagcggggcauggggaagaaggaacgggcacgcuguguggccagggcccucaccuggcccuggggugacuggacaaagaggugggacggcgcagguguggggcuauuucggccuccuggggcccugguucagcaaccaagccaagcagccuccguaacuggcagggggccuggcccugcagcuccaggccugggggcaccugccggcugagggaagcccugaggacuggggacacacaggcugcccaccucacccaccccucagccugugagggcaacagagccaucccaggggccuccuuucaaggccagaagcaucucaacaaaugcucccagagccccaccagcaccagcccugccaggggcaccaggaggaagggugcugcucucugcacagugagauggcccuccuccuccuccuggccuugccccuccccuccuccuccuccaucacuccugcuccugcuccugggggcagggagggcagcccagucccccacacgcagccuaauaaggcagcaaggugcagcugccugcaggggcagcugagucacaccgccucuggggcgucuccaccccucuccaccccuccccugccccgucuccaccccucacuggguuccaucccuugagcuccaucccucccucccucccgggcuccacagcgccagcugccucggcugcucuguguggcccaggcauccagccccacccuucucagggagccucccccgaaauaaccccacacuuaaaauaagcaaggucuccacacagucccugcccaggccuagcugccacccccugcccuggcucagaccagaagggccagcaggccacaggcccaccuccaucucaacccuugugcccagagcccuuuccagggccgccucccugcccggacacgccaugcccgacugucuuucacccuccauguccccauccaaaaggcuaggaccugccuccuccuagaagcccucccugaaugcgucugcggccacaugugcacucaccuacauagaagguguugggcgcgggcuugucucccagcuccagauacaggagguugguggucugcgggucauggcggagccacagggccacacccaggaucacgccuccagccagcugggaaagagcgggaacagugucacauguacgaagagcacugcagcagggagugcgcccaccccacacgcaaggccuaagcagccuccugccuugcuggcucccgagcagggaccaggugucagcucugcugcugguuuucgcaaugcccugaagagccccgggagucaggagcauggggcgggugcuuuggccgccaucuacuuggagccuggcccugcccugcaccuguggagugugacuccagggcaggacugccaggaagacacgggacgccgguuaaaucugccucucagaugaaaacagaauacuucuuuaggguaagugugucccaaauauugcacgggacauacaaaaaaauaaucugguguuuaucugaaguucaaggugaauuggaugcccuguaguuucaccuuccguaucuggccagaggugauaccaggaccugagcaucccaggaacacugcccccuccugcaaggguguggcagcgccccaagaguucugaggucgcugggggacugcuucugucugggggugcugagaacucuggggugggggcaccccaucuuugcugccaggaggagaggguaggauuugauguuaccaggccaagcuguaggcaccagggccugcgggguuugugggauacaucccugcugugggaugucagcccugggaagggacuugggaggaaggacgcugcugugguuuccaagaugggcugggggaaggggcgcgcagaagccggcccagcgcugucgcucagcagcuggggcaggaagcaggcugugcugggagucuggcagguggggaugaggcucacagagaggagaggccuucaacgccgggucauccggugugcacacaaucaacucuagccagguggggucugcccuugagacugggccccagaccaggcccagcccagcccacucugaucaucugaccaggccaggcacgugccccaggccccccucugcacacaccaaggcccccucucucccuaggggcagugcccagcccucugguggugggagaggacacaggcuuguccucugcugucccuggugccuagcaccaugcagggcacacugcagccgugugauccccauaaaugaccagugacccugaguccugcugccucuauccuccuccacuucagcaccccucggccucuugcagaggcuccucccugcuagacagggugggggcuggguccccuucagaccucuccugggguuucuuccugcuucaggcaugaaacagggccccacagcccucuagcagccuggggacucugcgucccuaggacacaauuggucaguuccagggucccuggcccacagcaggaggcccuuguugcuggacagucugggugggucaggcuuuacccccugcugcuccaggaggacaguacaagaauccccuaaaaucuggucuggcagaugagccgugcacagcccucaggcagggaucacccaggccagggcgugcugaagaagccuauggggucagggccccacaagugcggccaccauccgacucccaugggccugggcgagucuucuuccuccuccaugccacucucaaggagggccaggcccugggggcuuccuggaggaggaggcagggggacaggagaugaaaucagccaggugaggaggcacccggggggggccacgagggcacaaccccccuggcggagaaugccagcccagaaggcagcugcucccagagcugagucggaaugcuuggcucugccaccagcugggugccaggcagguccugucccagcagcugaggccuugccucaccagcaccaggcgccgaccccaccacagaugcagggcugccggucaacugcagaagagaaacugagggcuggacccaagaacaccaccuggacagccccacuccuguuccaauggcccuggccagggaagcagggccccagggugggguugggcagggggcugugcucagcagagcgugagcuucaggccccagcaccauggccugcacccaaguccccggccugaggaccccccggucaggccggucuagggucuagggccucggugaggguucggguggguggaggagcugggggcucuauaccucuucccccuuucccucacacuccugucuccccuccuccgggaccugagcugggccuggcaaacaauaaggccagagggggcugggcgugguagcaagcgccuguaaucccagcaccuuuggaggcugaggcaggaggaucgcuugagcucaggagguugaggcuacagugaguuaugauugugccacugcacuccagccucggugacagagcaagacccugucucaaaaauaaaauaagccucauaggggcugcuggugccagcagccacggggcucucaccccaaaggggcuguugauggucccccuguagcaggacugccagagcaccuucuccacacacccgaaacaacaaccugggcugugguuucucagaccuucuucugaggagcugugccuccugcccuccuaugggaguuucaacucaauuuucacacuuugguuuagcgaggauggcagccuacuucccccgcccaggccccagacugaagcucuucugugccgaguggaaggugcauuagagucaccaagggcccaacauacaccugcgggcagcgcuggaagccauguggcagcugggaccccacgugugccccucacaugacaaggccccagggaggccaggggccccuggcuuccagaauccugcaggggcagacagcuccugguucuucugugcccauuauacccgugggagcacagggagggccguggacagugcaggagaggcaggaagggugggggcugggggguggccccagagagccuggcuguccucacccugcugcccuccugagcuggcuccagaugcagccuggcgggaggagguggcgaggccgagaguugccgugguaacucuggcuuccuccagggccuuugaaaacauugcuuauuuucuuuugaaacugugguccagagaccguuuugagagcuguuccaggacagaguggggcagguggaugggggagccucauccccacagaggccuggugacaaacccugacucagccacaggagcuguggggccacuggaagguccccaggcucccgguuccucagugucccccucuauaaaacagagcugaucauggaaccgugccuggcucggaagcugcucuguagaggcccauccacccccagcccucccuggcugggcagggaccaccccuccucuagccugggcgcugaggggaugaucccaucuaaugggcauaccguccuaacagaaagguagugauggcaaagcucagccuaaaccccaaaccugcuaauggugggacuucaggccacguugcagcuucuugcugugcucugggaaggggcuucuguucagacuccagggccguauggggaggcugccccuagacaagccccggccccaggccucugccgaggguugcagggaaggcugguccuggccugcagggccugaaagagccugggccaacaccaggaaggacccgagggcccaugugacuuuuaauagggcagaacagcugggccaggagggggugggagggacagccggaaaugggggugacgccagccuguccaccucaacuguccccgaggcuaccagaaguagucgggagccacccuggguggaaaaauggggcaagaaggagugccaggcacugggcagaggccucaccugagccuuggucuucccagcccuagcauggacaaacggggccaugccaagcucuccgaccuucagcagggaccuugagcuggagcuaggugacaacaaugguggugauggucacugccgguuucuggaugaggaaacggaggcggagggaccccccuagggccaccuacgagggagggcaauggcagcaccaaauccccaagccccguggugggaaaggcacaggugccccugccccauaacaaaccccauguggcagggcuagagguuccccagagucaggaaugcgaaagacaccugcucuccgaaagaccuggggcagagccugguaaaggaccugugcccugaacguaugcagagcuuuccaaacucaacagcaagaaaacuggcaacccaaucuuugaaagaugggcaaaaaacaggaacagacccuuccccgcaagauccacacacagcaaaaaagcacaugaagagaugcuccaccuugccagggaccaggaaacccaggucaagcugcagccacaugccgagcgcacccaguggacuggcugccacgaaaaagaccaaccacaccacaugcugcugggggaggcaacugggacgcauacaacgggggcuguaaaacgguccagccaccuugaauaacaguuuggcaguuauguaaaacugcugcuuaagcagugaaacccacauucaccacaugacccagcugcuccacgcacagguauuuacccaagagaaaugaacuuagguucacacaagacuuguacacaaauguucuagcacguuucuuguaaaugccccaaacugaaacaacccauaugcccacugaccggugaacgggugaaccugggguccgucgcuggcuugcacaugugggugcaacccugcccggcaauaaaaggaacagacgaagggcacaccacagcacgggugcacagacgacgggcacgccacggcacgggugcacagacgacgggcacaccacagcacgggugcacagacgacgggcacgccacagcacgggugcacagacaggcaugccacacagacgacgggcacgccacagcacgggugcacagacaggcaugccacacagacgacgggcacgccacagcacgggugcauagacgacgggcaggccacggcacgggugcgccucuggguaaucaugcugaagcaaagaggcagaacagcaacgaugugcaagugccuucugaguccgcuuguugaagaaaugcaugcugugugcacccacagcgacggcccgugguugcccugggacggggaggaggggcaggaagcagagaucccaagggccccaggggcaccuggggaguuggugaugguuucacggggguauaaauuugucaaaacuuaccaaguuguacccuuaaacaucuguauuuacugugugucaaucacgucuaaauaaagcuguuugaaaagcccccacauccuaagucccugaugacugaacuccccggggccaguguuucuucugggccccaaagaccccaggcugccaucuuggcgcuaacuucuuccgaggcagagccaacgcuucccaggggcaagcagcggcaugggaaacaccgaagccgcguccuuagaagugcacuuuuaggauccaucaaaguuaggacuggaguaacuauggagcccgaugucaguuaaaagagagucccgcuuucacggugaugagggagggcagcccaaggcccuggcugcugagugccuuucaccaaggcgaccucaggcccaucucagcuucucucugccuugucuacaaacaaggaaauaaaagugcagaagcugacaugcacacaacuuagccugcacagcagcacucggcucuccaucacugugagguuucauaagugccggaaucuggaacuccugucaccccucuccccacagagccauccauacaggcaccucccugcucaaagcucaccugugggaagccucucugccaccugcucccaccucccaagauacuccagccuccggaggcgcccucugagaugccccgcccccaggaugccccgccucccaaguggccgggccccagagaugccccaccucccgagaugccccaccccacaagccgucccaccccacaagaugccccaccccacaagccgcccuaccccacaagaugccccaccccacaagccgcccuaccccacaagacgccccgccucccgagaugccccaccccccaagcugucccaccccacgagacgccccaccccaggaaaugccccaccccacaagccaccccaccucccgagacgccccgcuucccgagacaccccgccucccaaggcgccccgccccacaagccgccccaccccacaagaugcucugcuggggauuggggauggaggguggcucucaggauggagcccagguaaccugugggguuccuggagggcuccuugcaaggcuacuaaaagcaguguuuguacucuaugaaggauuguuucuuucuuucuccuuccugggaauuaauaaauaacagaaucgacuuuaaaaggggggcugccaagcacacuggguuccugcccagccuguccgcuguuuccaagaagcagcugaaagggagcaaaaggcagcaggcgcugcccgggcaggccuaggucagcuccccuacccaugccagcugcucgcugcccccgcaggccccggacagccaggagccagaacuucgggugggagcucuccaggccagcacacacacccccacagcugcaggaaagggcagggaucuggucgccccacccauaccuuacccccacccagacgggccaaguggucaccccaaguccugcccaggcaccccagugggggacgaggacgaugguacaucagcucacccgccuuuacguacaggcugggcaucugugugucucuaguccaggcccucccuugaugcucuuggggaggggguccaccaggcagggccacgcugcgggcucugugccugcucaccgacaccuagggacugcacauaugggaaacacaccgggaagugcccauucggcucagccacugggaggugcuggggccugagacacccuccccaggaggacagugaggcccugaggcaggaaggaaaggaggaaguaccccuggagauacugggugaaggaggggaggggcucaccaaggugcuuccaggaagggacgcugggggccggaggugaacggccccuccagccugggucccugcaggccaaccccucacucucugcccaccaagaaggggcagugccaggccuggguguggagguuggggacggggccagacuccucccugggugacguagggcccucucaggcccuccuagguggugagcagcugccccucugaccccguuguggccuccaggggcgaaaaggcagcauggagggaagaggagcaggaauucucuccuaggccaggaagcggaagcuccacucacagggccccuggccccgaggaagccgccugucucagcaucuaaaaauaggugucaggcgaggaugcuggcccucuggccccgccagcugggggaugugaggagucacuucccucgggaccaggaggacgcacacaugcucagaggaugcuggugucucccaggcaucagggguggugggcaccagugccccgaggaccaagccccuuccaggaccagcuguucccgaggcagggaagccaggaagucccuagcccuacucuaagccucuaagcccuacucuaagccccucggaaaccccuggggucccacucgggaaggagcuccaggaucaggacuguucugggcccccaucggccuggguccuucgccuguccuggggugagucucaugcccugucaucuguuuuaccuacacuguuaccuggguuugagcuuugagauuaguucugcaccgcagcggauaucaugcuccuggcagggcugugagggaccuggccuggcuggggagagaagugaggaccccaggcugcccaccugcccugauccuggagcuccauguaacagcacagggcgcccugcggggucccccaucacccagcccucucccucccauccuuuaccuucucugaaucacgccacuuccauaacugggagcccgaggggcugaggaagagggaagcaguaacuuuccaaacguggugggagagcacaugaccagagagaagggcaaggcguggugggggcgugauccaccaggcucuggccaagcugguggcucccuccucucaggccccuagcauuuggaaucucacaccuggacucucaaagcuccccugcugggccacccacauccuggagagaggcgcuuacaagcucugugccccuggucccccagcccuaccgccaacuccuugagcccgcagcccucaaagaccuugugcgggggguggggguggggggcagaugccuuauccuggccaucccacggccauggcauuggcggccagugcaggaagccuacagccccaaaagugagauccggcugccagcugaccuuccacacccuugggcguggcccccugccugaggggacuccuccagcacugggggccuaccuggaggacccucaagggucucucaugauucagcacuugcucugcagcccagguuggggggcuuaguuugggcccagaaacacaaagaaugguguguagggcugggggacacugaguaaguccagagguuccuggaaggcugcccagcauaccagguaccacuguguccuacaaggcagguggggacgacuuggaaguggagaucacugaagcccauuucugggagagccugguucuucuugcccagaggggugcugggaacaaggcggacaccugcagggcuggaauaucacccagcacccauagcacgcccagccuggaucacagggacacggggcccaagcaaggggcagggcaccuggcuccucuccagccccagccccaccccaaccucaggguccugucuaaaaccacgguggguacaagggugaugaccugcucccucgcacaggcgccuggacucuaagccuuauugacucuaugagcaaagcucuucccguggugcgauuucaggugcggaaauagggguagggaucuuuuggggucugucuccuugucugggcuuggaagcaguuaugagaaagggauugggggugaaccagauuucugaaaguugagcugaacugggcgcuggggugggugcaggagaaggacccucaaacccaggaaagaauggagggcuuucgggcaugcacccuggugaccgcagggagggcgagugacuugucagcacccggcagagccacagccagccacaggggcgaccggggaaguaggcccauaccucccugcuuuugcucugugcccugcacugcuggacagccucacuggggccagucuguagcagagacaaaccacagacuuccucuucucggcccgcuugacccaguggccguuuccccaaagcugugcagccagacagccugggggagccagggaaaguccacacacccacuuggugaaaccaggcacaggauguccuagcccccucccccacagcgccugccaggguugcagccccucucccggaaggacggcgaaagacgugccaaaugacagucaugugcugucuggaagcgagaaauacccgugagcgaggcuucuaaucagucucuuucccggccggguuuggcugcccugccacugggagguggcuaccagcugcauuagcuugggggagcagccagucccaggcgggggacaccgcucuucucccugcggggacuggugacaccucuucuggacucccuggccagcccccgaggagaagacucuuauauccauuacacagaugaggaaggcaaggcucccacaggccaguucccugucccgggacacaaacucuccugcccugcuccuggcagcaggugggucucaggugccagccgccucugauggaggcuccgagacccacccaagggacaggauuuccacgcugcuuggccagggcaucugcaauguccucccugcuugggcccgccgcgcacccagggagcccaguucucacuggcccccaaagcggucagggcgcaggugcaugcugcccagaccuucccccucgcaccuuggcuugggaagggagacagcaagagugugagugugugugaaggugggagugugugugugugcacauucgugugugugagugccugugcgugugugugugggcuccuuccugggaaagaggucaggcuaccccagcugccuucucccacaggcaaggccucuuuccucucuaaaauggaacuucuaacaagugccccacccagauauccauugucaaccuccuccccaccagccuccccagagcccacaggacugcacuguguccuucuggacccugcaggguucccgcagccccuuccccacugcacauccugccugucugggcugggcucucugaggcagaggucccuuuggaccccuggccaacacccacgcccugagcccuuccugcaccaagcccccugucaacacucaggcaugucagcaaauccaccaacaccaccaggagguaggcucacugugggcccccacugcagacggggaaggccgaggcccaggaccagagcaguguguuggggacuccaccaaggaggcccaagcccauggcacugugcucucagccacacacccugcgacaccaggguggagggggguccaccaggguggugcccaccaaccccaccucacccagccuggcauugcuggcuaccacugagccccaguggauggguggguccacagugacuguggacggacucaguucucaaugcuuugcagggagcaggcccuggggagaggagcggugaggccucagagacauuuccuugagccuuaauaacaagcacccuugggaugugucaggucuccaccccagcugccugggaaacuuccaggcccgcccuggcgacacucccagggggcugccagggagaccucucagccugggcaggcaggaggggcucacccagugcugacacaccguccagagagcaaaaauccaccuccggagaaguccccucccgugacuccccuucagccucugccccuagguccacacucucccucagccccugcccccagguccacacccucccucaacccccacccccagguccacacucucccucagccccuacccccagguccacacucucccucagcccccacccccaggccuacacccucccucagccccuacucccagguccacacucucccucagccccuacuacccccaggccuacacccucccucggccccugcccccagguccacacccucccucagcccccacccccagguccacagucucccucagcccccacccccagguccacacucgccucgucaggggacggggcuucaggggcuggcagagggacauccugugucuggugccucucccacaugccugggcugaagcaggccaccacuaagcaacggcugaggucccagggccgggccuggggaaggcgagccccucccaaauggccuagcugcccccacugccagggcagugccgaaggccacagugacucccaccagcgucccaagcaggcugugcagaacagcccggcuuggggaaggugggaugugacugccccacucaucucccagcugagaguucaguucagccuccguccuucccccuccaaauaaucauccgcacugggauccucagccguccagaugggaaacagaugucucuggucccacacacuggcuccaggggccauuuaaaaaguuugcccucccugccucaacuugagaaacacucgguccacugggacaucagccgagucuuccacgagaagggggugacagccuggggggcacggggaggggcuugcagucuaugcccaggggcguggccacggggaggccgcggccauggacacccacuccaguccuuccaggccaagaagggauuuccacccccuccccaauucuaacaccgacaggaaauggaaacaaaaggcgaaagcccaucagucacuucccagcagcaaagacugcggucaggagaaagccauucucagcaaaagacccuccuccacccacgcuggcacccaaagaugcccagcgugggggccccucuugcaaagcagcggccccacucccggacccugccauccacuccaggccccuggugccacucucuuccuugugccaacucagaaccgcgggauccccacuccugcgaggccuccagagcccuucugggaggaggccuccgcuggaacgugucugggugaggagagggagaucggcucccaggcagggacggccagggugcgcgcaccccagcuucugggccaucccggcgggagucugcgcuccuuuuaggcgcgacccccaggaaggucucggguggugaccgcagauuggagagugagcugggcuggggaaagagugaggcggaucgcccccaaccuccggcaaagugugcgcccccgccccaccauccaggggcggcggcucuugaugagcucaugggggcggggcgccaggagucccgcccgcgagccccccccucguccccgcgaagcagcaguccggaauccgcggccagggacccgcgcaggccccuccuuagcugaggggcggccggguacucgggucccgacccgcgaccaccgcacccaucaccaccacagcgggaacugcccggcggcccccagaagccccggcccggccgcagaggugggcccccgagcacagaggccccgaaacucggcucgcagcccucagccccaaugucggggggcgcgguggccccgggcgaccccccaccccgcuccuggagcccacagguggccccacaacuucgcggcccgcgcugcgcccgcggggccuagcacgcugccgcgggaccugcccaacguggagugugugccugcccccucccgccccggcccccggcgcagcccuuacccagaagacgaaauugaagacgaagagcagguacuugaugcacuuggugcagcccuccacucccauggcggcgcgggcggcgggcggccugcggggcgcgggccgguccugggcggcgggcgggccggcgcggggccuggcggguggccggcaagggggccuggcgggccgaggggcgggggcgcgaagaaaggggcgcgggggcgcgggggcgcgggggcgcguggggcgcugggcgccggaggccuggcaggaugcgcgguggggucgccgccgucgccgccguugcgcgcucgcucucuggccgggcgcgcgccucgcuccgcaguacuuauagggcgccgcggucccgccccuccauaggccccgccccggccagcucac

SEQ ID NO: 15494 - RNA, 3375 nt, Homo sapiens
cuguucuuggucaauuccggucuuguuuccccaacaaaugccgucguuuccggggcugcuuccgagccggacccaagggccggggcguggaggaguagaggggcgagcgcaugcgcacaggacuacacgucccgacaggcgucgggagcggcggcccaguuccuugugggagcuguaguucugcaggcgcggaagccguggugcucggccggcagagcacucgguuucccagagggcugagcgcgccgcacggaggugcggcgccgaccaagauggagacugccgagcagccuugagccgguagguuuguggugagggaggacgggccgcgcgggccggccgagccuccgggaggucaccgagcgcagcuuuaauaccugagcucgaaggccccgcugugcucgccgacccccguaccucgcggccgggcccuugggacccacagcauccuugugaggcccggaggccuguccagcccgacuggacagugccgaggggcaccgagagccagcuuggcaccgagaguucguuuguucucuggcggggaggucuugcuggcacauauaguggagaaaggccgggcucugcguucauguggagaaagagacggcuuccuucagccuacggacaugaaggagucaacucuaccuuccacucguugccggcuuucgccgagaaccccgagaaacggacuaccggagucccuaucuugcagcccgauccccgcuacccgucggagugccccgcugaccaggcugcuucuggccgcggcggcguuccgcugcagaggacgggagugcgaaucugggaagcaggguucugguugaacuccagcuucgucugcaacauacugugugacuugggcaaauuauuucccccgccccguuccugccagcuuuaaaacggucaucaguggggggugcugcguauccccuuucacugggguggcuucuucacugaggagagucgcgccucagaggaacugagguccugccuguguucgaccugguggggggcacuaagagccccugauaguaccccugaccccauccuuauugggugcacaagacacaggucacucugggcgggcaaggaguuuugguagcaggagaggagucgguggauggauggcugaggacagugcagaaggguguggcugggccgucuuuuuuugccuggaaauucaaguucugaggcacccagucacuccagcacuaaaugggugcaggaggcagcacuugucugcccagcuggaaaggcaggguaugugcugaguguuacagguggaaggccacuggaggucgcuccaggagccgcggggauuuaccucugccuaacagggcugcucaaggugauggucgacaccccacuuuccugagagcuugacccucagaugccagggccuuggcugcagauuccuugggagcucccggggaucuuccagcaaauaggagcaaaucuuuuccccguggaucaggaaggugcacgcucuuuguggaauacgacugcucaccccgcacagcaagcagcuuauaaguggcccuccugccugauuucagcccuggguucaagcccuggguggcugcuuacuaccaaaaucgcucaguagcuccaagccugccugcagaggguuggcaccauuaaaugagguaacgagucaaaagucccuacccuggguccuagccugucaggggcuccgaaaacccaggcucaggucgguccugcccggcaccuguuucacacauguacacuccggucugagguugguccucucccccaccccacccaccugcaguugagcagcugaacagaggccaugccggggcacuccgaggccugagacgaccacgccugugccgcugaggaccuucaucagggcuccguccacuuggcccgcuuggcuguccaaucacacuccagugucaaccacuggcacccagcagccaagagaggugagaggagggcuuggagggggaggcgggacuccacccugugugggacaguucugucaguugacccuccacuuguccaggggcaguggaucugcagggggaacucauucucaauacuguuccuccugagaaacaaauuuucugggcuguuuugguuuagguguggcguggcccuggggacgcauggcugaggcaggaacaggugagccgucccccagcguggagggcgaacacgggacggaguaugacacgcugccuuccgacacagucucccucagugacucggacucugaccucagcuugcccgguggugcugaaguggaagcacuguccccgauggggcugccuggggaggaggauucagguccugaugagccgcccucacccccgucaggccuccucccagccacggugcagccauuccaucugagaggcaugagcuccaccuucucccagcgcagccgugacaucuuugacugccuggagggggcggccagacgggcuccauccucuguggcccacaccagcaugagugacaacggaggcuucaagcggccccuagcgcccucaggccggucuccaguggaaggccugggcagggcccaucggagcccugccucaccaagggugccuccgguccccgacuacguggcacaccccgagcgcuggaccaaguacagccuggaagaugugaccgaggucagcgagcagagcaaucaggccaccgcccuggccuuccugggcucccagagccuggcugcccccacugacugcguguccuccuucaaccaggaucccuccagcuguggggaggggagggucaucuucaccaaaccaguccgaggggucgaagccagacacgagaggaagaggguccuggggaaggugggagagccaggcaggggcggccuugggaauccugccacagacaggggcgagggcccuguggagcuggcccaucuggccgggcccgggagcccagaggcugaggaguggggcagccaccauggaggccugcaggagguggaggcacugucagggucuguccacagugggucugugccaggucucccgccgguggaaacuguuggcuuccauggcagcaggaagcggagucgagaccacuuccggaacaagagcagcagccccgaggacccaggugcugaggucugagagggagauggcccagccugaccccacuggccacugccauccugcugccuucccaguggggcuggucagggggcagccuggccacugccuagcuggaaugggaggaagccugcagguggcaccgguggcccuggcugcaguucugggcagcauccucccaagcagagaccuugcugaagcuccugggguguggggugugggcuggaagcacuggcucccugguagggacaauaaagguuuugggucuuuc
